United States Patent 7,365,185 (GENOMIC PLANT SEQUENCES AND USES THEREOF) - sequence listing, part 74

SEQ ID NO: 75266 - DNA, 59446 bp, Oryza sativa
  unsure (1)..(59446): unsure at all n locations
ggatttcaagatcgcaggtatcgatccgccgtccattctcgcagagttgcatcactgaccgtcggatcgtctattccgcccatttcatttgcctcctatactttccgaagtctcaaaccccctccctcccctcccttctcccgccgccgccgccgccgccgccgccgagcatgccgagcgccttccactccctcctcctccccgccattcgcaaccccaaacctagccgtcgccgcggccgcggccgcggcggcagcaaacgccccaagaagaccaccaaatccaagaaccgcctcgccgacgccgccgccggagacgccaccgccttccacctgaagacctccgcgcgcgccggtccggggggtgccgggagcggccggcgaggcgatgggggatgcctcgtgcagccgctcggcaacctcctcctcctcggcggcggcggcaacctccgcgacgcggggctcggcgcgctccgcccgctccccgacgacgtcctcctcgacgtgctcggcctgctcgcggcgcgcgacctcgctaggctctccgcggcgtcgagggcgctctacgtcgtcgcctcccacgacccgctctggcgggcgctcgtcctcgacgagctcggcggggacttcgccttctcgggctcgtggcgcgccacctacatcgccgccgcgtcgggcggccgcgcccacctccccccgcggggcctagagatcagggggttctactccgactacctcttccagagctggctctgcgccaacatggagatgcggccggagtggctccaccgggacaccatcgatcgccgccgcggcatgtccgtcgagcaattcgtctccgaattcgaggagcccaataggccggtgcttctggaaggctgcctcgagagctggccagcattgcagaagtggaccagggagcacttgctgaaggtctcggccgggaaggagttcgccgtcgggccggtgagcatgacgctggataggtacctccagtatgccgacaatgtgcaggaggagaggccattgtacctgttcgatgccaagttcaccgagaaggtgccggagatggggagggactatgaggtgccggcgtacttccgagaggacctattcggggtgcttggggaggaaaggccggaccaccgatgggttatcattgggccggcaggttcagggtcgtcgtttcatgttgatccaaactcgacatcggcgtggaatgctgtgatcaagggagccaagaagtgggtgatgttcccaccggaggtggtgccgccaggagttcatccaagtgcggatggagcagaagtcactagccctgtatctatcatggaatggttcatgaatttttatggggcatgtaagacctgggaaaagaggcctgttgagtgtatatgccgggctggagaggtggtttttgtgcctaatggatggtggcatttggttatcaatctggaggaatctattgcgattactcagaattatgtgagcaggttagagttcacatctcatgcttctgtgttgtttttattgtttcactagacgcaggactttgttgttagaaattaagcgaccatcaagaagtgctcttttatggccttctgtggtaatgaacataaaaaagggcatcaccatgccagtaataacagtgtatagaacaaattagaatctccagtacaaattcaaaataaaatccaatgttctaggcttgatgcttttaagcatatgttcattcacaaacaatctcagtggtgcacttatgcttttacttaattctatggatgttagctcttaagagattcaagtgtatgtatgttccttggtcgtttgtaggatttacaaatgacgatcaactgaagaaaagtttctgccaaataataattaatgtcaattgtctttctggttctaaaactatttaaggtcaacaaaggcttatttctatactttacaaatgatgccctcttcactcatcgagtcaaaattgactctgtgtgtaagcttcttaggagtagcaattaacaaaagtagtagctgggttctcctgatgatgccaggtgctaatggaagtatcgtgtagtgttgacgaaggtccctcctgatgatcctccttttgaaagaaggcatgaatcaggagagtgttctcatttcaatctgggttgctgtatagctttgatgtggaatcctcttgaatcttgtttaattgctgaacttgatgtgtccattagtctgcatgataactgttgcctaatcctgttacatctttataaatgacatgctatctcttcttttcccctttgaaatattcaggaggaatctgttgaatgttcttgactttctcaagaggcccaatgcaagtgaacttgtatcagggactacagacagggtaaacctgcatgacaagttccgcaatgccatcgatatgacttatcctgggatgattaaacagcttgaacttgaagctcagcagaaggctgctgctcgcaagaagaaagtctcgttctgggaatctgcggtagatgccaatactggaggattcaagttctcattctgatttcgtttctagcagctaggtctgtcagtctgatacttgattgctgttcttggtgaaagttcgacgattttgccattccatttaaatgctcaatcacatctgatttcctacctgaattcaggtttatgagcctatgcattgtctgaatctgtcttaactgtatcatcttaaattttggaggaatgtagtcccagacatgtatttcattgttgttgttgttgtaacatgtagcttacacaataataaattgatcattgaccttgtgcaatctcctatcttgtctgacttcccagatgtggcctctaatcttgtattctgatgtggcctctaatcttgtattcttagatgttagctttggtcctttggacgccttaagttgattagtggtacatctttttgctggtgaccgggcgccgctaagtatttgactctctgcggaatcttgcttcaaactgtatcatgattcatgacagggcaatgaattcacattaccaaaaggaatagagttgtatgtttcatatagacctagtttattggattaaacatccaaatcttagctaaaatacctccattctcttttaaatgcaggcaacattagtatctttcgaccaattacaaaagtactacgtattttcttttggccaattacagaagtacatgcctttgccttgtacataggttttacttagtttaatttgcttcgtaacattaggaggaagaacgctcctcaatcttcagaaggctgcaggtgtatctgactttgttctgttaaggcttacacatcatgtacagctgcatgtttgtaactctcaattgtcaacatgacaacatgggcatacaggagatactagtagattacaacaagttacatcatgtgtataaggctctaggtacatatatgcatccatattagtctttacgccttttgctcccaaataacaactgaaatctgtacaattattccaggaagcttcagcttttcagggatcactgcagctgaaaatccaacctcttgtatataccaggcagaagcaagatcccaagaggcaaaaactgctgcttgatccatgtatggctcaccaaaacaaatgtgcaatgaccatgacatgtgtgagaaggtgtttttctgtaatcgtaaaatcaatcgacggtcaaccaaatctttgtccgtatcatcctaagcaagcgttctcaaccatctgaggagcccaagaagacccgcatctagtacaggagatctttgttccagtcctggatgaggatcaaagcagcaaacaaacgtcatttttctgccaatatcagcttatgttgttcatcagcagacaaatctctctacttcttagtccctaagaccctaacataaataaagctcccaatccttcaaactcagttcattttagggggatgttagtggaatctgaacttaccaatatcagctgcaactcgatgagcacacatgatccctgaaaatgccacagcaattacaccttgcccaggaaaacagctgtcgccaacacagtacaagccatctattgactgtaaaataagcagtaaattttcagtccaacaatattgcagcacaagaagatttcaggacatcaagtcaacaatgcatattaacttacagtagtattgaaaggcattgctagcaatccctttggtttaccccgtggcatgggtccatatgtaccatcatttcgcgcaagaaatcttcggtgtgtttttggtgagcctacctgacaacaccaaatgttcaacaagtcgaaagcgtgttagcactagaatcaaaactatcccactacaattttttgcatgatagcagcatttaaaggtcaaacaaaaattagtcaagatctgaaaagaacagtcttagatcctgacgtggaagaactataagaacctacctccttgaggactattgaatcctgaagaccagggaacagctttttttcaagcctctttattatctctgtcgccacaagctcctttttcttctcataatccttcctggacagaccctgtggtggatattaggaataaataactaaataagtacattggtacaaaaggcttagtttctcacaatttgaaataaattagattacagcaagagcacagtccatacttcccaatcctctatccctgcagttgtaaaaatatgaagtatatggtgtccttcgggagccaaggatgggtcaagcactgtagggatacttaaaaatatgcttccataaggcttctccaaattagcccagtcatcctggcaattgtaattagaattaagttattatggactaaaactgttgtgtaccaacttagcattgtgtacccattgcctgtgatatctgatacccacagtggagtcatacctacctcaagtacaaaatggtggcaatcagtatcagcaggcaaaactgaggctttgacacccatatgaatggaaaggaatgatggtgctttaacataattcttttggaagtttttctcctcttctggaagctcttcaactttcaagagtttacctttgagtagaagtaattgttatttttatggacaagtacaagtggttaacaaataataactcaagaacaaaactgagttgtgaattttgagcaaaggttgtgaaactttcagcaaataatattgtaacaaatgaatttcaacgagccgcatatttttcaaataaaaatagataagcaggattaccaaatgtatcccatctggtagcattcgatatcactgttttagcaaagaactccttcccatttgataacctgactccaacctatagtaatgaaatgctcagctaacaagtcgataaaagctccagatatttagtctaagtaagatgaacttacagctttgccattttctaaaattacattggtcacattagccttgtagcgtatttcactgcctttgtcaacaagcccatctgccaaggacatagcaataccaccaacaccaccaactggatagttaattcccccgaagtgcctatcgcacaagacctgttatttcacccttgagataacagaaatttaaatgaatcagaagcaaaattctgagagtcatgcattccacttaccatgcttgcattaatcatgggtgtttgcaaggcattgactgtgctcacaataaagcactacaaacaaagtgaataaactggtgttaacagagaatcacatggtcgacgaaagaaaaattgaacaagtgagtaaactcacaaatatctcacacctcagcatctatgaaggagagtaactgctgatcttttatgaacttgcgagcaatatccccagcattctgtggcagataataagctgcaagagagataaagtcatgagttccattgtatcaagtcaaccaatctgattaagcagtaaatatgatgtactgatcaagttctcctctcaatcatcctttcattggtttttggaattgcatttgattcagctggagcttttccatagggaatacaatgggtcagctacaaaatcttgtagaggaatatatggatgcggttcttatacctagcgtcaaacattccagaggcttttgaaaaaattgcccaaaaagatatagaggctcctcaagggacttcagctccaaagaatttaatgaattgaagatctgctcatatatgagaaaacaactgtacttgatatatgcttgcaaagagtgaattcaaaataccaaaaagaaaaaaaaagtagttgtagataagagtggagaatgaaaatggtatcacagtaccttccaacatgtgccatagaatttcaggattccttccttttcatgaggaaatttattaaccagctccgtgacgaagtcatcatactctctatgcacaagaactgagaggtcaccaggtaggtggaaatgaaccgtagaaggatccggtataacttccatcttatgcccaactgcttctagtgcttgtgtaatcaaattcaagttcccctggatcacagacacaaagtcatacttaagataaaatcaacactcaagagacaaacaaacattatcggccactagtcccacccacacatggcattactctcagcaacagcaatattgcacacccattcacccaggcatgcccactgccaagtgccaacctatattcctaagttggacacctgtagctgcgattttcgccatcatcgcaacattccactccaatcaggtaaagtaccttcatatcagggcattacgaggcataaatgcacttgaaaagcaataactttctcatcgtctagccaacaacatccaaatcaatccctactttcccttccccaattcttgccgtcctcgacaccgcacttcacatagtgctcccagcaatcaatcactcactcaaaaccaaattcgccaacgcaagatccccagaatatactagcagcaacgcaatcatcccaattctcatctacacccaaccgtgctcagtcactgtcctcaccttgtcggagaagccgaacatgacggaggagccgacgtcgaaggtgaacccgtcgcggcggtagtacccggagctccccccggggatgacgtacttctccagcaccagcaccctcgcccccttcgccgccagctgcgtcgccgccaccatccccccgatccccgaccccaccacgatcgcgtcgtactctcccccaccctcctcctcctcctccgccttcaccaccgtcttctccgccgccaccgcagccgccgccgccgcgcccgcgcctttcctggtccctcgtcccagtgggcgggcggtggacggccggcctactactgctccggcggcggagggagcgaggagcggggcgcacgggcgcgcggcggcgaggaggaggagcggcatggcggcgccggtgaagcgcgggagctcgagctgggtggggtttttatatgggaggagaggccgcggtggaatctgcagcgagaggattccgccgcgggaggtggtggaggttagtggagggaagacgagggcgcggcggatgaggcgaagtggggggccccacatggcagcgagaggccggggcgaagtgggccggtgaccgttggtgggcccgccatgggcggcgacgaggttgggctgcgcattgagcagcccatgggccccgctttgcttcgcttatcgtaattgcccacgtggcacacagtaatagcggggttagtcgggctgggaccccacgtgtcggcgacacgttcccgcgcccatttttctttacattatcctcggagacggtggccgacgtgccgttattacctctctcgaaagccgcgcccctcgcacgcgctcaccgccaccgcgctcactgacgtcgtggccccaccgcctctacccccccacaaaaggcaatctccaccgtcacctactcctaccccaccataaaaggtcactgacaggtggtccccggagagcgggtcggggcaggcgaagcggtcaaaacgtacttaaaaggcgacccgcttgtctcactctctctctgctacagctagcctacgcggttgacatgtgggaccagctttgatggtggccccacgtgtcggtgtgtgggtaggtgggggcggcgtcggggtgacgacgggtgtctcggttggggtgagggtgggccccactggggggtggggtgagggtgggccccactggggggtggggtggtggtggccgagtggagaggaggcacgcgcttgctcgcctcgtcgtctcgatacctttcttctcctttccccatcgcctcctcacccagagagaagaggaggttggaggaggaggcgaagaggctagctagctagctagggtttcgtgctccccatcgcctcgcgcgcgcagccggatccgatcgggcgtcctcgtcggcgtcggcggcggtgcccctggtaaggccggatcccgatccttcccgttcggttgcggtggtgggtggtgtggggggcgtcggcgatctgggggcggttgggcgagctgggtccaattttggtggggggcgcggggttggattcctcgggttgtggggtggggtttggatgggggggaattggagacgatgtggtgtgggttgctgggcttgggtctaagtagggatgtgtttgttcgggtttggggtttgatgtggtgagaattgggggggtgttcgtgttgtgcgattaggggaattcgcggtatgctgcgtgcttttgttgaattgtgtgagaattttggattttaggtagttctattgtggggtggggggttaattgatttgggcgtgactttggatcgtgattccgggggacctgagccgtgccgtgtgaaatcgcgctgattggaagggtactcgttagaccaaattgttctgttctggggtttatgtttgatttggtcggcgtttgctatggtttggaggtattaattggagagaatttgagctggttgaggctctaccgagtaaaaatgggtcttgtgctggaactatgactatgattacatagcattacctgatagaatcattatggggcttctggaattctgatatggggaatataactttcttatttttcccatgtttggcttgatgagttttgacataactggtagtttttgttggctaatatgttcatttgctcggagtatatatcctatgaaaattggcataaatcttgcaaatctagttttcattagggatagaagttcttgaaaaaaaatgaactattgaaagggattagggaggatttgcactacagttttacaatatctcaagatcattttcaactaactcccccaagtgcaaaagatcatacttggtgactagcgagcagtgaattcgtatgcactatacagcaaatgaaaatgagtttaacaatgcattttacttggctacacaacttatctgtggtagttttttttttttggcaacttcggaaagctatactttgttaaaactgaatttgaacacctgtgccattgtttacaggctctttttttcaacaatataacatgtttgtttaagtgtatactatatttgttttcatgggatcattttggcctcagctgtgaataactgatgtgtttgctttccatcgtgaagccattttgagactttggtcaattgaagtgtttatattctaagcccttcttttctccatattctagatatcagtgttgtgattccgttgcaatggcatctggaactgatgagaaagccaagatggagggtttgacatcagctgcagcctttgttgagggtgggattcaggatgcatgtgatgatgcatgtagtatctgccttgaggcgttctgtgagagtgacccttccacagtaagatgccttatcttcaattgtatgttttttctcatatatgacattcttttaaccattttactgtgtttctttgttatgtagttgactggttgcaaacacgagttccacctccaatgcattcttgaatggtataatattgaccccagtttatgcatatcattggtgaaaaattcttatatttctgctgtgcgctgtactttgtctgtctgaatttatttgagttgttcctggatcaactgcaagcatgttgacattatatatcaatatcaaactatttgggtcagttttgatttcatgtggtcagctttgcatgcttgaggttttgggtagactatcaactgttctttttctattgaggagttgttataaaattcagtgaaggaatgaaccagacttctagtacataatatcctgctctctctagggtgctaatcccatatatttgtgcattgatgaccatgatacacctactgtcaactttttacacttcttccagtttgcattaaacgtcagtgtgaccagacaatatacctaaatactttcaactatcaaagtatctacctattagtatagtttccatgtgctaatttcagtatttccatacattcctatggatgcatgcatatcatgattgtttaattttattgagattaaatttctgaaagccctactacctttggtaaaaccatcacaaaatcacattttcaagtgattgtttcacaacatttgatctttcgaaacatttgacaaaactgaactttagttatttccatcatactcaatgtacttggccccgcttgatagttactagcatatatgttccattgtgaatttggctaggtttgtgagactaacagctggtgtcgatagaatacaatgataatgcttaaaatgtaattttgtgaatcctttttttaataaataaatgaggcctgttatgaatttttttctcaagattgcagtttgcgatagctttagcaaatgtagtgctgttttatgaaaatgtactcctttattaattgaaggggtgctgtattatagaattattcatagttttgttcatattacagtataggtaaataagatttgctatatatttatatagatccttcttatatatagtggaattgtgaaacttcagtggtagttaactagctgtaacttgtaaggggatttctccagagattatgaatgagacttcacatggcaaattccattatcagttcttttttctgtgtaaaaagatttttcatattgatgatcggtggtccttttgcataggtgtcagagaagttctcagtgtcctatgtgttggcagcctatcagtttgaaggatcctaccaggcaagtcgtcaaaatactttatgttttctttgcctatacagatatcaggcagaattttaacatgtaaaagggtactaacctctgtcctactaatatgtcagtcaagagctgctcgaggcagtggagcgtgaaaggaatgtaaggaccaatcaaactcgaaatacaactatatttcatcatcctgctcttggagattttgaggttcagcatgtatgtgttatgaaactaacttgagttttgatatattcctcctgatttgactagtgaagcattttctagtgttaacctaattagcaagatgaacttttgcagttacctgttgttggtaatgatgctgaacttgaagagcgtatattacagcacctagcagcagccgctgcaatgggaaggtcacaccaccttggtagaagagaaggacacaggggtcgttccggctctcatggtcgtccacagttcttagttttttcttcgcatccaaacatgccttctgctggttcagtttcttcatcgtccgttcaaggggaagtggataatgaatcaagtcctgtccacacaactggtgaattatcactgcatgctaacacccatgaagaagcaggcaatcaaagtcctgggatgcttacctacgatgctgatcaagatgctgttgtttcatctggaaatagtacccctgtatctagccctaggtttttcaacaggtaaattgagtcacctatatgcatgcactatgtccttatgttttttttttatgataaccaatatgatgatcctggtgtatcaggaggcattccactgggcaatcaactccagtaaacaacgacagagctgggccttcagatcttcagtctttctcagactctctgaagtctcgcttaaatgctgtctctatgaagtatggagttttattttcttaagttgcttcgaaagttgtctatcaacttttatgttaaatctgtttctccttttgtccgattcaggtacaaggaatctattacaaaaagtactcgaggatggaaggagagacttttttcgcgtcattcatctgtggcagatcttggttctgaagtaagaagagaagttaatgctggaattgcatccgtatcaaggatgatggagcgtctggaaactagaggtagtaatggtagaacaagtgatggcccagcaatatccacttctgaagttattcccagtacagaatcaagcaatgagagagttacagaaaacaatccaactactgcagcgacaagtagtggcaacacttctgcgtcttctgccccttgtgttacaacaaccggttcaaattagcatgttataggttccgaaagaaggcctgcacattcccattcttctccatcaaaggtactacattttcaactgaaagataattattgcgatatatgtagttttagtatgcattgcttctagacggaaggataatttatgcactcaaccgtggctgtcttaccttgtaatttagtcatttagttctagttaggttaagggttagttattggttgactctcacatttgagaaaatgccatttatgtagaaacgggaatttcattttttttttacatccaagcaagagacgctgccaacaattatgtttagttaaacaaatatggatatgggttacgtccatttattagctccaaatgattatcttagttcaactgtctgtttgctcacaactgattcatgttacacggattacaggattgccattgccaggcatgggcaggtgaccaaaagcaacgtcatgttgtcatcctcagcattgcataaatcacctccagaaaatcggaatgacaaatttgatgtattggtttgataaaagggctcagcccgaggtattaccttaggatgccgatttgttctgcttcatctatgtaaaaagggaaaaaaatcagggacaagtttttaccggtataaataatggatttggtgacataatagcaatcataatcgtgataaatatgattgatacagcaaaattttcctactgtgcgagaaagccaaactcatcgctttctacctcctgttaaacaggatgtttgaacagtcgctctgttcgttaaattgttttcataaaagatttgctctcagcaacccacaaattttaaaaaaatcatgtaaattcgcacgaaatctagctgctgctcttttttctttttcttttttttttttgccgttgtgtgcaaacctcaccgttctgtagttttaagtgctgacctgccagatttgccctgcgctcacgtttctgaaagtagttatctttgagccttgtcaaatttttatggagaacctggctaatttgaaacaagcttcatggttttcaacttttttttccctaaatgctactgcacttaatattttcaaggtcggattaggcaaacttatatcacgttctatcaagttgaaaagttaagtccacaagaccacaacagaatatatttgctggcagcaaaaactggaacttgaaggggaggtagctagctcagcaacatatggcatcgttaaatgccgtattgtgaaatatatttgtcaataacaaaacaaacatgactttcacttatatggcattgtgaaatgaaaacatgtgtcaacaacaaaaactatagtactacaattcagggtgtaggttactagctcaacaacaaaactgcagttcagaattgcgtgatggctagtacatgttgcaagtggcaccaaaatcgttacagctgtacccatagcggaacattcttccgactgattaagcaaatatccctacaaagtcgctaagaaaccaataaaagaatattttctgtcaggggaatgagaaaccctaaagaatagcctcaatcctttgcctcttgtgatcttacaactgacaagtagatatgcctctgaagattaccacagggtcaagatgccatctccaggcaaagattaagtgctgacttaactagatgaacgttcatgtctcacacaaacaagatcatctagcttgtttccatccatcttgtacagagatacgccgcccatctggacatggtgttcctgagcctccattcgtaagctgtcgaatgggagtacctcccacttcttgtagtttgagctctttcgtgtttcgctcatgtctggagttcctgatacaggtccgtaatctgggtcaactgttccccataccttgcagttgctaaatggccccatttgatcagattgaccagtttcatgcctttttaaacgaaaagccgcagcatgcgctgttctgatctcttccctgctaggtatatccgaccaatcttctaccctctttgctctcatgggggaatggattcgaattacctacatacaggaaacagcaattagacaagacaacttcatatagacaaatcagacgaaaacatgggcgagagcctggaggcttactccaaggcactccagaagttgataataagcccgcccttgcagtggattgtgtcctttccttgggggtgagaagtaccttgtcctgaaacaatgaagtgggcataaaacatccttgcacaaaaatcatagagaacaatagtaccatggatatctacatataacacatccatgcattgacttaccattctgtgtagttagggtcaactgtgaatccatacatgtcgataatatcacacatggaaagggccaattctattgacttcataccagtccctttagcacctcttctcaagactatgccttgaaaaagataaactgggtttggaagttcctgccagttaaaacaattgccaagtattcagtgtgaatgatttcagtccccaaaaaccatagtaacaagaagaaaatcacaacagcatgaaattcatgcttcacattagtatgattcaagaagagacagatagtgaattgtacaacatgctcagctggacgaaagaaaaatgtgatcatataaccttttacctttatcaccgcattgatttctttgtgcgtcaaactttttataataagaacctcatcagctgcaacaaaagcaggacagttagactcctgtttaaaagctcatctagtggtgactactataaaaagtgatctcatgcatctaaaatttattagaagagagcaacttaagtgaagtataataaattcctataagaactagttaagctacaaataaaagttatctggtgttattacacaaatgtccttgtatggaataatatattagtcctcaagtgatgcacaatactaattgtctctgcaagcttaacaaggcatcttccaagttgcgaaaaccagaaatgaacgacattgccatgtgctttctaatagttcgaggataatagagaacaccaatacgaatattatattttctctcatttatgaaaaagtaaattaaaacactatcaggattgaagttatctggaagaaaccaggattacagcattacaggagccctttagtattggcgccatgtttcgagcagcacccctgacaaccagtcgaaagtcccttttcaacccaacatattttgcatacttctgcaggccaaagataaaataagagcaaaattagtaaacgagtgtcaatctgtgccaactttagaagaaaatataatttttagatgtccggagttaggatagaagacacctaaaataacaagaagctaataagatggcaaggggttcagggtaggcattaagaagagagaatggagtaataacttaacaggaggagcttagctgcctacggggtcaacaagaacacactaaaataggccattcacataagttagcttagatacatatgaagtgttagcttagatacatatgaagaactcaatgagattaccttattaacaggtgcttcattatctcggaacacagcatcatgtgcatcaatctcttgtccaaactctgttttcaagagatcccctgagttaccaacaacagcacatgttgcaaactggcgaggatgaaaaggaggcttagcagggagtaaaacactaagaagctcttcgcacaaagtacgattgtagcatttgtcagcaccgctgcatattttttaaagcacattaaccagtatgcggattaatatcacttcgttacgaagaatagtgcaaatgtgcaacaagtatcaaacttacagctgtgcaatccttttggctgcataatccaaccacccatcaggtcgcacatctaagtactcccttgtcaacacagtcgtcatgttacggtactggcatcatattagcattaacacataagtatatattctaataaacacgctatttcataattcataaaccatgtactaacctgttcccacagaaggatagtttcacagacatcatagttgtattctagtggttcaaaatatttgaactgagtgttgtactgcataagtcaagagaagtgatatcttgagtggacctttgttgaaggacacaaatccgttaacagaagtaactgcatgtgaacatgacagggaatacttacccaagtgctgttggttcctttaggaaatctaaggactagcttgcaatgatcaataatatctgctgtgaggccaagtccccttcttgcctaaataaagttgagatttcagaagcaagctagaaaagaagcaagagagtaaagaacatgtaaatgaaacttctactgctgatcaaaggaaaatgctgcaaatctgtaacttataatacttgagaaggtctaaaactgaaactgagtttcacatagattctagatgaccattttgcagattgcctcattgttcattatggaatggtgtcctataaatcgcatcctttctccgaccaaattcatgcataacaaacaagaactaaacgtaacaaataagaaccagcaatttgatgaataatgtgatcccacgattgactgattgcaaagacaccatgcatggatgaacaattcatggttgtttcagcggacacgacacacgggtagaccataacagtataacactagtagctaattcactgcccctgcccttcactatgacacaatccacaattactgtgaactcaaattgatctcttcaaagcagaaatgtgcttagttaaaaacaatcaaggcttccatggcaggacaattatttgaattcaagagagcacagagcaagccggggtcacgcaccacgcactgctggacgcgggactggaagcccgagagcgcgcggacctcgtcggagtccagatccagcctactcgccagccctgcaagagaatccatccctccccatcaatcccacacaacgaaggggaacgaaagctaggttttcgggagagcgctctcactcggagcggtgaagaatgaggactggatggagaggacggcgaggcagaaggcgagggccagccccagaagcagcaccaccgtgggccggcgcggcggcggcggcaacgacgacagcggcggcggcgccctcgccatcgccggatcggaggcggatgcgatgcttccttctcctccgcttcactccactcgtgggaaaaggcagagaggagggggttaaagctctccttttattttctttgtttttacactcaaagttgcttataaggtggtgtttgaatttctgaagatatagggggtgtttggatccccgccacacattgcctcgccaaacatgcggctgccacaacagtttgactgatgtttgattaatacgtgagttgtggcagccacactttttgctagttcatttgcatgcttatttccgccacagctgtggcgattatttctctcgccacaatctctggcgacgccacaacttgatggctggtttgggctgtgaaccaaacagacccataaagatgaatatcaagtgtttcacgtaaaacgaggtagtaataatgtgtgattaattaatttttaattattacaaacttgaaaaatggattaatctgatattttagaacaacttttatatagaaagttttcgcacgaaacacaccgtttaaccgtttgaaaagcgtaccacgaaaatcaaagtttatccttcatttatagaggattcgaacgggcctaaatgggactaatcatttgaaacataatgctaggagtatttgaatttgaactaatgatggttcatcaaacatgatcagtttgctttaatttgatactacaatccataaaagagaaaatagtatgtcaaaattggcttcaactgtactagtacaagtttttgcaaatggccaaatgggatgctattgaattaatctaggagaattcgattttgatttagatcctactcccccatcccataatataaggtgtccacacatttccagattctacctttaaaatattttgaccaacattcaagtacaatatgaattaaatttaattgctaaaaaatatatcattggattcacatttgaatttactttcatatggtcaggatggcatatctcaaattttgcaaaattataatggcatggttccaattttccctataatatatgagaaattataagacaaatattagttttggagaccatgtcaaatttgaccatgtcttataggatagagggagtatctgaaaagcagaaattttctttttgacataggatcaacaaatccattaaccagaggctctagggaagccgccagagaccagtgggatacaaagacaggacttggctcatgaacacattcaatcctatctcaaaagtagaaatatttaactatcagctgataatattttgggataatttcatttctgccatgtctaatattgattttaccttttttagggtttttgtttttatccccacttttttaaccaaaagggtaaggtttagacggaattgagtgggaccgggtttatggcagtaaagaaatagagaaaaaaagaaaatattttttttaatttgttattgacctttttacccttaggaaatatccaagtaggggaaaccttccagcctctcgtgtgcacgggttcactcccgaaagaaaccccatccggcggcgcggcaagtggcggcgagcgtgcgtcagtcaggaacagacccctcccaccggcactttgcgcgggctaggcggcggcagggagggggctaggcgacggcgttgaggggacttggtggcggctgggagggggctaggcggcgacgggcaaggggtttgaaggcggcagcagaatgggggcttgaaggtggtggcagggaaggggcttggcggcggtaggggaggagctgtggggaggatttgtgttggtgttgggatgtgagcaggagacgacgatggtaacagcgaccctgcagattgaggggaccaaggggatgtttggttgatgcctaaccttgccgtaactaagtttaggctagttgaggcatggtggcacaaagtgtggcttaaaaatagttggccacaagtgtggcaagcttagcttcaaatttgagagtgtgatatgtgggtcccaaggctatgaaagtgtggcatgacacaattgccgtagcgaaccaaacacatacgtaagaaattgtggcataactaaagtgtggcgtagtaaagtgtggcaaacaaccaaacagcccccgagtccagatcggctgtccccaaggtggaagacggcgcgacgcagcatggggaggaagtgacggcagcagcggcaacggccgcgataccatgtttgcgagattggatttgcttgactttggtttggattttcttgagtttcttatgcttgctatatgttgtgtaaagaatgtgtctaatttgtgccattttatctttcttttttttttgtcaaaatgtgtcaaaatttctagcaaaattatgtcaaattttaaatcaaaatttatccatagtatgtcaaaattgccacgcttgtggaagtttatcaaaattgctacttgtacaaatggaagcaaatacacaaatgataaaaaaaatagtgtcaaatgtgcaatagcatgtaagggcatggatgtcttttttgccaaagatttaacaccgtcaacatgtccacccaaaatagggataaactttggatttgtttaaaaaaacaagggcaaaaatgaaatcctaaaaaataggagcaaaatcaatattgtatatatcaaaacaggagcaggagcaagaatgaaattgcccctaatatttttgttgggtaaggttcatgtctagtgggctagtgggatgtggccctaagttacacggttggccctaaggaataagcccactttgacttccttaactatatatcggccccctccctcaactattaaaatcgatcaaatttgactcccttgacagttttagaggactatttcactaacgtggtgtctacgtggcaatgttgagctgattcatgacattgacgtggcattagaattaaaaacatgtacgtggaatccattcgtcattcactaaaaattatggggcccacatgtcatctgtgtctttcttcctctccctttcggccgtgagcaacgggtaagatctggagcggcgggcggcggtggccgggagcgagaagctcgtcgtacctctggccgtacgcgtactgctcgagggagaagggcaacagtgttcgacgtgtcgttggccggcggcgcccttggcatggcgccgtgcggcaagcggaggggatcattgaggagaagaagctccaactttcaactatacttttaaaactattaatttatatatttttaaaatgctaattaccataattaagttaattagactaattgccgtaattagcggctaggacggtgtgaatgtaaaagggcatgtaacctgagtagcaccccaagatcctaagttcaaatctacgtaggagcaaatttcaaattgtgttatttgagggctaagttccctgtatgatagactaaattcttaatttacaaagactacatatatccggttggatgaagaggccggataaaaaatacctttctctataaagaaaagaaaaacggcgccgatggtacgtgcgcgcctgcgcgagttacccatcaagcgctagcgcgcgctaaataggaatccccagttgggcatacaccggaaattaaaagtggagagctggcggttccgtggtttgactttggagaaaccacgaaggaggcctctccatggcgactccatctgacgccgcgacgatcatatggagcacggagctcgagctagctccactgatagcaatggtgaggaaccgggattatttcgccggcgctcgattccacgtcctccgtggcgcgtgcgagcacctggcgcacgtcagggactgcgtgcgcacgagggcccgcgtggcggcgcggcggggcaggaggctggcgacggcggcagcctggacagaggaggcggagatctacctcctccggttcggcgagctgcggagcgcgcacggccggatccccaggctcatcttctgggatctgctcggctgctaccgcgtcagcaaggtcgcgtcgctgatgatgccgcaggtgaagaggctgtgcgaagaagggggaaggatcgtgcgcaggagcaagctgccccaaccgatggagatctccacggggttcgcgagcagggatcgtaccctccgggccgcgatcgagagggtgaggacgatccaacccaacggcatcgtcgcgatctggggccgcgccggcttggggaagacttacctactcaagctcgttgaggagtacttctcccgagatgacaccttcgatctcgtgctgcgaatcgcctctccgagagattcctccgtagccaaggtactatctatacatgcatactgatttattgcgagtagtataacactaggatattcagttttttttttgagaggtaggatattcagttgaggtatttacaaaatgaagagaaatagcacatctacaaatatataattttttttagcaaatgtatgatactttgcactggatatgttgttgacaaccattgcatggacagatataaacaatttggccctttcattccatatccatcataagatgcatttctagcatgtaactcttggccactttcaggttcaaagtgaaattgccaagaaactcatgttggctaactgtgacggcatgcaacatagagcaagaattttcgacttcttgaaggagagaaatttccttttattgcttgactgtgtatggcagagactggatctagaagaagttgggattccatcacttgacttggttggaagctgctacaaccgaagagtggttttcacggcatgctctagccatgtctgtgatcaaatgaatgtggaagtggagaacagaattgaggttcactgtcttgatcatacagaatcatgggaaattttcaagcagaatgctgatcttgattacttgggccataagcatgtgtacctgccaagaaatatttccgcggaattgcttggttcacctttggagctggtaacaattggaaaggccatgcacaataagaaggatgcaatatattggcaaaatgcccttcattatctgactgaatcatgccttcgtgacactcaatggtcaggtagtgaagaggcaacatttttcagattaaaacttgcgtatgacagcttgacaggaattctgaaagattgctttaagttgtgttctttatggccagagggccatatatttaatcaacggaaattagtagacttctggatagggtcaggattaatacaaggggatgacattgaagcgtcttacaacgaaggtttctctcatattaccaccttgcaagaattttgccttttagagccagcagaagatggagaggcagtgcaaatgcaatctacaatccgtgattttgccttatgggttgtacacagtcaaggcgaggacaagaacaaatggagaatccaaaccaaagagaattggggattggcagagcaagttctattagtggggcttaaaattacagaactgcctcgtattcctagcaatcaaaaaacccttgaagtcttgatactccagcacaattatttggaagacggttctttcgggaacttcccctcgttgctttcactgcagtacctagatctctcttttaataaattgtccaatatacctgtagagatttgcatgcaggtcaacctaagatatctgaatttgtcaaataacagaataaaaacggtaccagtggagttaggctgtcttaccagactgaggcacttgcatcttcggaataatccaaatctagttattccaaatggtatactaccaaaactccagaatttggaggtgctggatgtttgctcatttaatttactgcagtgctcatcctatgaggcgccaattaatgagcttgtgcgtatggataaattgcagtcccttggaattactgttcgttcagaaacctcgtttcaagggattagtaagacaaccttaccaatacggtccctctctattgtcatttataaccatgaagatgggtatgagactcatgtatcttctgaaaattcttgtatcaatcctgaaagacaaacaaacctgtttgaacttggtatttacacaagacaaaagactattgtgcttgacagcattcattcaatgtggaatgttcagcatgttgagaaagcatacctccatggttatttcgttgataggatcatatgccagaagctgcacactggagatatttttgcaaaactcagacgtttggatatagtacggtgttcaagattgaatcatatttcatggattattcatctcccgcttctagaggatttgctgctattttcatgttcaacattgcaccagattattgctactgcacaagatggtgtcgttaagacaaatcaggaaaaggaaaatccatcagttaataatacattccccagtcttaaaaggatgacactgatcgaagctggtgcattggttaggatctgcagcccgttcttctcatttccttctctggaatgccttcagatctctgcatgccctttgttgaataaacttccctttcttaccgttccgagcaaactgaaatgtatacgcggtgagaatgaatggtgggatggtttggaatgggaagaccaagatcttgaaccttcacttgaactttactttcatggcctctctgctgaagatcaactatctgaattgtatcttttcaatagcctggaagtggaatgggctagtatctttaccccttgatgaaagaagcaactgctggtggtgacaatgcatcttcatctacacatgctgcgaaaccagcgagcgaaccttccaaaacgaggcccacaacaccaacgatatcttgctttgcatcaggccattcccaatccaatgactaggatggtgtccataacattaaataagatgccacataggatgaaaaattatgtggcaagtgaataaatgaggaaagagaaggaaaccatgtcttgcatgagacatggtttctacacaatatccaagacatcatgtgagataagaagcattaaatttaagtatggaatagtagtgtttacattggaagaggagtgtctagtactagtttcttaatgatgtggagtttgtgaaaaccatgtctagtgtttttggttgggaatggcctcaacgatggtaacctaaacagtttgttttcccaaagccgtacttcataggatctctgatcacataacttcaattaggttaccggctgtgggtaactcaagactatacagtgacacccactatagatgattttgaaaaggaaagtgaaaggaacaaagaagaaggggatgagaaggatggtgagtgggcccgactagaaccaatggcgttagacaacaggagtggtgatctgcctacttttggggggcatttaaccatttgccatttttagcatgtacaaacatcaatgtggagcaaaccatttagaatttctctagcagattgagtaaattttacaaaatcctaggtattagggcatccattacataaaaccctagttattgtgatttgtttcacgaaatcacatgttttgagtcaaaatgtttcaagaaacctcatattcatatagactacttatattttattattacataagattgtttttttcatcaattcacattagttggctaaaaggacatactcttctcgtctactttatttttttctcaattttgcgccgaaaaagcttaacataataccggctgattataatataataataggttaagtatacacataaatgatcaaaacatgattaacaacacttgttaaaaagcaactaacgttatatatgtactaaaaagtatctcatacattctttttacaattattatagataaatatattagtcaaataaacgatgtaaatttatacctggggttttataaaacattttactctaaaacctggggtttcatgaaacaaattacaaaacccagggttttgtgttacagaagccgtaaaatacaaggttttgtgaaatttactcgaaaataacaacctacctgggtctcccttttcacacaaggaaactaagaaaaaatgactttgtacctctccttgaaaagattttctctagaataccaggttggaaaggttggtttctgctgcacatgaaactctggtcaagtcactcctatcttcaattccatcctaccagatgacaaccttgctaatccctcaatgggtcatcaagaaaattgacaggaacagaagagcctttctatggaaaggaactgaacctgataatactcacccaggaacaagccttgtgaactggcaaacaagcaaatgcactaggggttgggagcttccggatctggatcgagaggcagtgtgacgaaagagctggtcagacagatggaattcgatgagtccaaactacgtactaagatcgaccaagtatggttattggggcggtaggactcgtcaagcaccagacgatagaagcttcaattcagatcccccacatgtcagtttgtagtaatgcagaggaccctcactctagaagcttagtctttccgtttttccgtttttctttttttttatttggttgttactctattataaaacccagaatctaagtatttctgtaaccatcagctgtgtatatccactcatggatgatataagtgcctaatttctatccaatatgtgaaaaaagagagactaagggaggaaacattttttattttgttgtttcttagttacgaaacctagaatcttaaccttcggctatgtatccttagctagctatggatacaaatgcaaaatttttatccattatgtaaaagaataggagagccaaagtgaggaaacattttttttattttgttgttttctagttatgagacctagaatctaagtatgtaactttcggctacgtacgtatatggatataaatgccaaatttctatccattatgtaaagaagaagagagacaaagggacaaaatacacaagcatggagcatagcaagtcgacctcagcgggggacggcactaggctgggtggctagggaatcccttaagccctagccaacacaggatcttatcggccaccgttgcaaaggaagccctttctaacacgatgatctcacgagcgacaacactacgaccccccgctcacactccgtgctgcaggctgaggtctatcacattctccatgcttcccctccaatttcgagaggatctccgtaatccgttgcacctgcgctgcttcttgccatatagaacaattactcttccagcatccccaccctcacctaccataggggttctaaactcttgaggggatatttcctgattgcttacatgttatttaaatagttatttttttaaaaaaaatcaacaagatagattaatatatgataaatcactccacaaacatgcaaagccaaatttaacttctactagttgcaatagaaaaacaaattaaactatagctagctaatatatattcacagttaaatttgtttttttcattgcgacttatagaagttaaattttaagttatatgtttgtgaagtgatctatccactactacagaaaacacaaataggtgccggttttcccaatcggcaccacggaggcagcactaatatgaaaagaaataggtgccggtttaagaacaaacacctttgaggttccctgaataaaaaaaaatctggctcgatgacgagccgatgcattgagccgagcagtccctcctcccacatccatccacaccacagcaagaacgagcatatcatcatctatccatcacatatccaatccacagatggactcatccacatatcaatccattcatccacaacacaaattttgacacttaaattcatcctggatcttggcaataaaaaaaaatccatagatggattcatccacatatcaatctattcatccacaacacaaattttgatactcaaaattcatcccagatcttggcaataaaaaaaaagaatccacctctctgtcgttgtcccgccatcgttgtcgtcgcatggtcgcgtagccgccgccgtagtcgtcatcttcgagtcatcacgccgcctcccctcggcgagcccaccacctgcatccgcgagccccgccgcccctgtcgcagcctcccctcccgccggatctagcagaggggagggctcctccacctgccgctgccgcctcccctcccgccagatctggcgaaagggagggctcctccaactgccgccgccgcctcccctcctgccagatctggcaaaagggagggctcctccaactgctatcgccgtcgcgtctcctccgcgagcccgacgcctaccgtggcctaccaccgcagagccggtgggaggatgagaagaagagataagggaggaggagaataagatataagggagagagacagtgggagagagccggtgggaggaggagaagaagaaaagataagggagagagattcacaatatcgagagagataaaaagacgcccacccggccggcttgtctccacctggctcggctcgttttaagatgtgtcggttttctaaagaaaccagcagtgcggcacctttaataaattaaaggttttttttcaaaaaaccagcatctatagtataggtgtcggtttttctttagaaccgatgcctatagttatataaaaatgccggccttttttgtgtttttagcccatagaggagggaaaaggcctataggtgctggttttagtatttccagtacctatagtgatggcatctatatgatgttcatatactaatctatcttgttgattttttttattttttccataactatttggatgagatacaaagtttagaatccactcccctatgatgccctcaagccatgccaatggcatcgtagatgacctcctatccctagatcgacgcttccaactgtgaccaagcagatggaacaccgccactgcaactagctaccagatctcaaccaaggtctccaagtctcaaggtacggatgtaagtgcgctgtcgcactacccatataaaaacccgtgttttagtttatttaatataaaatttaaaagaaaaaacggaaaagaaagcccactcgccccagctgcgcttgcatacctacctcgaggcgtccctcgcgtccaggtcaagtcccccttccatgccctcgtctaaggagtggacgacggacgtcacgaaacggcatgtgtgccagtcgtttttggttgatcggatcacgcggacggacgaaacagcgtgacattacatttttttctctcttgtttttcggcggctgccgcgtcttcttcttgctcctctggtaaggtgtactacctcacatgcctaatgagaggaaaatatagaagagcgcgttgacaccgttgactttggattttccgtctccttcctccgaagtgcagagaagaaaaggaggagctgagctgagctgattgcttgattcctcgctcgttcaatctactctaatctatctctataggaagggaaacccaaaccataatgcaaagccgtctcgcagaggagttgcgagcgctgaagttcgaccgtgtttggcggccaagtcctcatcgctcggaatcggatggcggcagctgcagctaccgcaactcgatccagcgggtcgtcaccgcgtccgttgccgccgcgtccaccagcagcaccaccctcgtcttcccgtcgagtggctcggtcacgagctcgtcttcggcatcctttacctcctccgctcccggctcggaggcgcacggtactccaagctccgggcccgagagctacaggttgctgcgcggggaggcgttccggggcctcagcgagatcgcgagtcatatggtcagcgacaggtacaccgagaggctaataacggagttctcccggccgcggctggggagcggcagcggcggcggcggcggcggcgacgagatactgcagacctggttctccgaccttggcgttgactgggttctcagagtcgacgagatgaacctgcaggagaagccatggagcggcgtggaggagatgatcaaggggtggctcgccgcgctcaccgtcatggcggaagccctccgtctgacgaaggccaccctcagcagcggcgatggcgactccggcggtgtcattccggtgcttccgatcgagaagtacaggccacagatatctgcaccggcgtggatcgacgacgaccacgccggtgttacattacatgatgtaagtcctggctctggctcgtcgaatctcgaccaagaaagctcagatccggctccaaacacgagcaggagcaggagcattgccattgctacggtcaagcaagctataacagcgtattcccaagcggcgtcatcgaggtcctacaggtacgaccagcacggagctgcagggcctgaattccaattcgcgctcttcgccaaggcaagcctggtgaagatgatgtgcttcccggacgctatcgccgcgctgagcagatcgccggagaagatcctccgcgtgatcgacatgtacgcggtggtctcgggcgtctccccgagcctcctggcgctgctccccggagcgaccaaatggttggtttccgagaggatcacggccgtgctcaagacgctgagcggcatgatgaggggcatactccatgatctggagagtctgatccgagaggaggattcgtggcggacgacggcgcaggggaacgacatccacccggtcaatcagtacgtgctcaactacatcaacctgctgcttgagaatcgcgacgtgctgaacccggtgctgcagaatcgcgacgtgctggtccaggagggcgaggacgacgacggcgacgacgagctgttctccatcggggagctataccagctcgcggaggagaaatcgtcgctgacgagcaccgtcgccaggctgatcaactcggtggacgccatgatcgaggacaggtccaagatgtacgcagccgccggcgggcggatgcacatcttcctgctcaacaacgaccacttcatactgcagcaggcggagccttcgttgcagtcgttcatgggcgcctactggtacgcaaagcggaagcagcgggtcgatcggcgcatcaaggagtacctcgatctgtcctggggaaatgtcgtctcgtgcctggggtacgcagggcagagccgcaggaggtcgtcgcttttccgtagtgtctcggcgctggtggagttcaactccttgttgcagataacctaccacacggagaagctctggaagatcaatagccctcagctgcgaaccgtgctgcgcaattcggtgtgcgggaaggtaatctctgcttaccgagcctacctggagactcagggacagggcggccagttaggaacatcagccacgtatacccccgaggatctggaagatatgttgcaaaatctattcgaagggtgaacctttcttttccatatatatggagttttgatgatgtttttcttcggcgagtgcatgatgtgcgcggaacccatgacccaaagccaacacggacatgatagtactccctccgttttaaaatatttgacaccgttgactttttagtacgtgtttgaccattcgtcttattaaaaaaatttaagtaattatttattcttttcatatcatttgattcattgttaaatatactttcatgtatacatataattttacatattttataattttttttaataagacgaatggtcaaacatgtgttaaaaattcaacggtgtcaaacattttaaaagtatcttcgcgttgttttgctactttacttgttttaatcaatcatttaaatgttcttctcaaccttactacaacgcaccaccgttttctgtcttcattgaggacggttttgtgccacgctggcacgcagacgaggcgttatcactgactcatcacaagataggcagtaaattaaccgcccggccgtgtccccttctccgtttgactggtcaatgcattctgtacctccccacttccgatccgtaaccttaaagcaagtttaattttatagccaacctctagctctaaaaattaacacatcgtttatagctaatctaataagttacccatacaacggatgaaagtgggctatttgggtatgcgtgccgtcagctcatctaaagcaaataaagatagcaccaacagaggttgacagcgacggcacactagaggcggcggccactagacgacttctactcaccaaatctaaccgttcagaagagtacgtatattgagaagcagaggtgtgccgacatcatttatttttcttttctttttggttgagtgttctcctccttgtcgagatgtgagtttaagtgctttttttttttctgtatatattcttcgtgtacataggggccggattaatgaaagcccactgtctaaaaaaaattatactcgctagtgcgtagtattgtagtactccatctgtttcaaaatatttgacaccgttgattttttagcacatgtttgaccgttcgtcttattaaaaaagttgtgaaatatgtaaaactacatgtgtacatgaaagtatatttaacaatgaatcaaatgatatgaaaagaataaataattacttaaattttttaaataagatgaatggtcaaacacatactaaaaagtcaatggtgtcaaatattttgaaacggaggaatactattttagctgggattatggtctggttggagttagattcccttggatatgctgtagtaattgattactctaaagtcacctttaatatatatattagcctcgggagtgattattattcgagtggttttgcgattatgagtttttttttatgtgcaagttgactaccttttgtgcatacagatcagtagatggatccatccactggacaagatgggtgttcggtttcatttcatgggagatttttttatgatggaaagaaggtgtattacccttagtgggttatatgtgtatgatgtggagaaactaataacaccaccatatgtgactgagtgaagggtattagaatctaagaacaaaaatgtgtcgcaatgatgcaatggttatggtaacaggtgttccagttttggtgaaaagaaagaaccaaatttttccaagacttcataagaatttctctaattggtttgctttactccttattggttttgctatttattgttttattttatgcaagtattatttttaagttcaaatgtcgtgagatgataaataatgacattgttacaccttaggtgtcaacttttaaaaaaaaatcaatcaccttttatgtaagcagccaagatagatatattttctcgttgtttattaatggatagattgggcgtgggacgtaaggctacgctaaattcaatggtctcttagagtcccattgttttacagagtgtgagtaacacccatttgggatcgattgaagcagcccagcagagcacaaatggctaaatataactaaagatgcatcattacttatgggatgtaatttttataatgcttccctaattcattcgtcttgcttttattatttgagcatattttcttaggaaaatcatgaaccaattgtattgtttggtctacctaaagacattggatttttttttatgttatggtttgtgctattcatatttgagttagttctttattttccacatggtgaaccctgcaccctggtgtaagcaaaacacaaaatctaagtgcacctgtcctggaaccaacggtgaaactatatatacatatttgaagaatgatgtataataacacaatatatgttgttaatattttaagtatttaatttatttagatggcatgcaaacttgtaaaatgcacggtctataccacaatgacatattgcttatatatagcaaaacattggatctaaaattgtcaatttaattataaataaagcaacattttagatagaatataaattagatatgtacatttaaaattatggtcagcttaattctaaaattttagttttctctttttaatttgataacataaagaattaggaagagaaagagatggagatgtaaaagaataggaagaggaagagatagggatagggagagcgtacctacgttcttttttttttccggcccacacttatacgaagtcatacgtacataagtttttttctttttatggcccacggcagaggaagggattattttcttaaataatagatctaatctaatggtctaaaataccgggtccatcaatttaaatgaaaatcgatagttagattagatagtgttatgtggcggtctaggagtgtttgtaagagtgacatgttgcgtcttgagagcgtttgtagaaagtttaatggatttatagtatataataaataagatatgaaatatgttttatcgagatgaaaccagcgtgtactatttctaattaatatagcttagctgttgcatgtattgcattgcatgcctatacaataacaaaaataaaataatacattgtatggattgtttcaaccgtcaaataaatgtcttattgtttagtatatggtacctttggaattgtaaaaaatggcatttcccattaaaagtggccttgagccacctaaaagccactgtgatgtatggatggaagttcgttgcactggtcgttccttgtaaagtgatggagtaatgatggcctaagagcaagtttcttgtaaagtgatggagtaatgatggcctaagagcaagtttaatagtatagccaactactaactctaaatcatttatagtcaatctaatagtcaattaatacaatagttaactacaaatatatactacatcattaataattggtctcacatgtcatatacacataacgttttagagttcgtgttacagctggctacaaatctatagctcacttctcttctctctcatctcttatctcctccacatgtgcttatagctgacttataatctattattgtactccctccgtttcaggtcataagatgttatgactttggtcaaagttaaactgcttcaagtttaactaagtttatagaaaaaaatagtgatattttttatataagataaatttattataaaaatatatttaattattaatgtaataaaactaatttggtaatgtaaatgttactatatttgcctataaacttagttaaacttgaagaagtttgactttaaccaaagtcaaaacacttaaaacctaaaacggagggagtacctgctaagagtattgattattaatgacaactcataccattcagcatgccaacgtggcacaaaaccaccctcaaatgggcgcgatggggtattgtgtagacggagtgccttctttattttgtttcataaggacaaaaaatagacaactcaatattgagcgacataaagtaaacttatcccaaagtaaatgaatataaagtcaaaaaaaattgagttagaactttattatatttaagttgaaagttttatttaatttgagttaaaagcttcactaaatttgaataaagcacttgtagtagaatttaatttcaattgaagatgtcaacatcaaaactactctattcgtccaaaaaaaatcaacataggcaatgatggaacataacctatgacaacgaatctggacatgctcatgtacagattcgttatcctagttaatatcccatccttattcaggttagcgttttttggggacttagtcttctagatcagttctctataccagaatttcatcattacttgtcagcttccgactgaatccttcatcccctattggatttgaacattttgaaggtcattctaaaggacaaatatttagacaaggccctgttagaaagcaatgcttcaaattttctctctcacccatctctagtctatcagtacatgtcccattgttagtctagacttgccgaaaagctgaagagcgttgtcagtctagacttgccgaaaagcttaagagcgcaggcatgctaccagcaatgttctcctaacagtcctagtccgtagctagttccctctccagaaatctatatctttaccgttgcccactattcagttaaatatgtcctgaacttccatgataggtttccaccctgccatcatccgacatccccttctgttcagtccgattgaattctaactttaacctaatagctttctcaaacatggctaaatccttaatacccaaacaactgttctcgcttggcatacaaattattcttcaagcaaccagtcagtgaccattgttgacttctaccactcgaatataaatctgcatgctctctttcggtgcgatgtatgtaccttatatagaaatgctcattgcaacatatattgcacttttattagtgctgacagactattttatggaccaattggtccatagtgtgcataaaaatacatgcgcaaatttgagtcaacttattatctaattagttggcttttttactaagtaaccaacaaacaattctaaaatagtttttggcaatgatgatatttctttttccaatatttttcataattactttgcaaatgtggtgaccataaaattgttgccaaggaacatgcaaaacatcgacatatgggtgaacgtattgagaatggaagagaatagattatagggattgtggattgtagtggagtgtgggagctagtgcatgcttatatgatgcttccttctcgtgcatggttatatgatgtttccttctctttggttgattgcgatgtgcatgtttctactcctagtcggtagccagttccctctccagaaatctatatgtttaccgtctcccaccatatgtgtcactgttcaattaaagatgtcatgaaattccataggttccaccctgtcatcgtccatggcacggcatccccttctattcacttcaattgacttccaactttaaccaaaaagatttctcaaatatggctaaatcctttatacccagagcactattctctattggcatacagattattcttcaagcaaccggtcagtgcctattgttgacttccacacttacatttaaatctgcatgctctctttcagtacgatgcatgctccttatataaaaatgttcattgcaacatatattgcttattagtgccgagagaccatttcatagaccaattggtccatagtgtgcataaaaatacatgcgtaaatttgagtcagcttgttggctaattagttgtttttttatcaagtaaccaacaactaattctaaaatagtttttttggcaatgatgatatttattttcccaataattttcataattcatttggtactttgcaaatatagtgagcataaaattgttgccaagaaacatgccaatcatcgaagtatgggtgaccgtattgagaatggattagaatagatcgtaggtgttgtggattgtagtgaagagtgtgatgaccgtattgagaatggataagaatagattgtaggtgttgtggatcgtaatgaagagtgggagctagtgcatgcttatatgatacttccttctcctttggttgattgccatgtgcatgtttctatgtgatcaatccttctcctttgattgattgccatatgcatgtttctatgtgatcaatccttacgtgaatagtaggcaccagatgttgtaaaatgtactgatggtagatatttagatattagtaggagatcaatttttgtaggcaccttcccaaactctcacgagaaatgcactccatagaattttagatatcaaattttttttttgcacttttagtttgttggaagctaactatatttatactatcaatctaaccatgaaaccatgctcgatattgaaggaggataattttggagagttataccgactagtttagatgtgaagagtaaaatagatatttggacaatagtaatacatgcatgtcacactcacaccaccatatgtacataggcaccaaaataaaaaaatacttagattcataaaacacatgcctgctagtttagtttctagtagctcttaggaaaaacttgcattcacattatatgccattatagcataacagatgtaaccgtggtacgaggaaatgaagaatctaggttcatgcatagtcggacgcatgtattgataatatcatcacaatgcattttgaagtgtgtcttgtaatagaatggggtgtcaattgtccttccatcatccattatcattgccgacatcaccatttctatgaacacaatcggttagtataaaattaatcaaggattcgaaagagaataaaatactaatatatagaactcatgtggttacctgatgatagcaacataaggacaagactaaatattactattataatgcacgtcctcgtccttgtcatatcttgaaactgcatgttgtttatgttaagaatattgatgtcttatgtttcagattgatgatgcctactgattgatgtttcagattgatgatgcctacatatggacaagactaaatattactataatgatgcacatcctcatccttgtcatatcttaaaactgcctgttgtttatgtcaagaatattgatgtcttatgtttcagattgatgacttgccaaggaaataaactaaaataaagatgataacatgtaaatatgtgcatctcatcaatcattttaaggaacaataaatgtgcagtaatagaaaaatacaatttattagtttcttaattagaaatataattgcatttgtagatattaaaataaatgtatatctcaatatttgaaaatatgattgatctaaggaaaatactcgggaattaaatttttaaatatatatatatatatatatatatatatatatatatatatatatatatatatatatatatatatatatattatcttgtgggaatatatgaaattcaaataaaaatatatttgtgttgtcaatttacatgatgacaccatttcatcacgcgacactgtgtgatgtagcttatttaaatgtggacattgccttgggctatgagccactgcaccaagcatggacaaagcgaaggtaaagtcacaaaatgcatggctgttttcacctattgccttccttccaaaaaaaccaacttaggtggggatgcgaaaccacctagacaattcgttatcataggtaagcatgtgaaaccacctagaacaatgaatttggattcgttatcctagctggtgtcacattcccacctagattggttttttatgggacggaggaagtaggcgataacaaatgggaatttggtccaatttggcccttcggcaacaccaggtgtcgctaggtgattcggtgacacggttatatttttgcaatatcatcaaatttgatatattcttgtaaaatcggaaaaaaaacagttcgatacctggtagctgactctttgtggcgcttaaaaatatgttttgtgttatgtcaaatacgaaatgctccaaacgaagtagaaacatgaggtttatttaccatactgttaactaatctggtttatattaaaacaaatcaattcccacgtgcttgatgaattaactgaaattcagattatatgcatcgtgattatctggcatattttatctcatattacctcctactactaattaattgattgaattttttaataagcaaagcattttgcaccaagcataatcatatccaaaccttcctcagcaatacgcagtaagcacgacgatgattgaatttttagttagcaggaaacgtctctctcttttctatctctagcctgattttctactagcaggaaatgattcttcccttcggcagtaaggttcgggtacatacctctacgcacggaaaacataatggctcattagagcatgtttcttccgtttcatattaaacctctttatatttgactattttatagaataatttaaatctataacacaaaattagtttcattaaatatatcttgataatatgttttctgttggaaatgttgttatatttttaaaaacattgaaatggatggagtaataaattaactattagcttaaataaacttaaaaagtagaatgaatactgttttttaaagtaattttcctatatatctttttataaaaaaatcacttatcagctcggaaagtacctaatacagagtttatgtaggccggccaggaactctttgttgcctggcatcgaattcgttcggttcgtgggactaataaatattttatctgttttatatcatataagtcatttgattttttttccgagtttgatcaaatctctacttattataaaaattaaagatatttttaccaatattttgatacgtcatccgtgtttgagtcggtttttaaggatattcgtttttgaaaatacatatttgtgtttgagttggattttaagctcatttgcttttgtaaacacaaaagaattcatataagaaatctcttttaacaaactccgcatgctaacttgaatgaatgtcggactcgctaattttccaaaagaaaaatccaagcaaattcccacaataaatttaccataactaaaccatataacaataataatattaaaatagcattcacctgttgcaacgcaacatttttctagtttatataaaaatttagcaacatctaaaatattaaattaattttattaaacctagcattgaatatattttaataatatatttatgttgtgttgaaaatactactcccttcatcccaaaatataagaacgtatgattgaatacgacatttctagtacaaattagataggcaggttatccaaattcatagtgctaagttaatgttacatctagtactaagtccttatattttaagacaagagtataatatttttccgtaagcccattattttctaaaaaaaagaaaagtaacacctagtttactagtattaacgaaaagatggaattacaggtttatagaatcatgcagttttaatgtgtcaccctacggcagatttgggagatgaatgcaacaagatatcaaaaggacaacaaacatgacacaatttcattgaacggaagtcaacaataatggacgttgtcttgcaaagctgaaaactggccaaatgccagtagagcgaaatgaagctcatacaagtgggaggaaacaaaatatctggagcagataccaattgcctactactgcctacaaagatgattgggacttatgtacaagcaagaaaatttgaaccgcattctgccccagaatatcagaggatgttcatgtagattcaccaccgactaaatgacggcggccggcggacgtttacctcttcctcttcccacctgagcctccagcagccttcccagcagagccagaagcttttgatctaccagccggcatcttcttcgagttcaagccattgccattgctcttcaggtcgagctgcacttggatccctggatataaaaccaaaattaccaaagagtcaggcccgaccgtaaatagcagaaggtaagactggtggagaatccaactagtcaaagtacgagaacctttcttcttatcactctgcaggtccagttttggttttgtgtcaccaggcaccagttcatctgaaagaaataaacaaagcaggttggtcaaacaaaacatacactgaatacaaattatcgatttaaatgtcctaatgaaaattgggctgaagctaatataattgacatgacatggcattgttatgccaaacactactagcacaacagctgacaaacataggcctaagttgcataactaaagattgagaataaaagcacaaatgtatatgaagatgatatggcagtatgacatgttactgtaccacagttttcccagtatgaaacaaaactagtccagatttacaaatgctcacttatcaacttctgtttcccttcgtttcacgcatgtcctcatccgatgtattccctccgtttcacaatgtaagtcattctagcatttcccatattcatgttgatgttaatgaatctagatagatacatatgtctagattcattaacatcgatatgaatgtggaaaatgctggaatgacttacattgtaaaacggagaaagtactccattatttcaatttttgcaaaacacagctatagcctcctatgtgatagtcatttcatttgctgaaaaagaaaaacttaccattattttcagcatcagaggaatcctcttcatcgccttcagatgacgctactccattttcttcaggcaaactctctcccactggctcaaggattgctgccactcgtttctttaatggctttttcatgcctgggatatttactagatctgctgctcgaacaacacgagaactacttccttgtttgtatgcttttgttaaggcacttttaacagctggttgaataccatccataggatttggatgaccctacagaacaaaatatgtattcagaaacaccattggaagtataatgacaaggcattactaatcatgacaaccaagtcagcaagtttactcagctaaaagattcatgcattaatgcttctagaaaaaatatatcaagcagggagttgagtatagacaaacagtcaagagatgcaaccattgtggcactaaagattcacaggcaaacactccctttcagtactttggaaaatgtttgttctctgatttcatatctacacgatcacatgtttataaatttcaatttggttctcaaaaaattgcattgcacaataagaacttatagcaaatgagcttttgcattcccgaaatcaattgaaatgccatcattagtgtagtgaaatatacagtttgcaactttgcatgcaacctagaacctaccatctagagtaagtattttcaaacacaagggggcaaacctagcagtagcacattacatattgtaataagtataaaaccattcaaagagattaataatgaacataaaatagatggcacaaacatagggcttctattagaataactaccaaccttaaattttgataattcaacaattgtgtcaaagtcttcctggcttaaagagtaggtatccataaactccaccactttttgcacagcttcatcctgtgattttacaaatataagataaccagcagatagctcaggtaaagattcttaacagggaattattgtaagaagactggtaatactattacataaaggcaagataacagtatgttaaaactcagaattgatgagccgtgtacacaagtcaaggtatggacgctctcctgcagattttttttttcagcaaatgaaattaaagagactccttacttcagaatactccagaagatggctagtacactaatgcatttagaggtatcaagataaatttctaaaatgccagtgtccaggtcattatcctcatcatgaaacattcaagtataatgccatagaacaaaacaaggagttaattaatagatcacatctacatataccttgggcattgtcttcagtggatcagtcaattgtctcaagagaagagtgaggtaatccagcctcaatgactccctgcagttctcaacaatataagattggattatctcatgataaaccatcgaaaatcatcttaaagatcagattgtactcatgtggaccacaacatcttgaaaaggcatgggtttttattcaatgttgctaaaacaaagttcaaaaaccaatggtgattttccttggcttattgactgattcaggcaagttaagaaaagtaaggcttgtttaatttgctcactgttaagaaaaccatgattttcaaacatagtaacatcaggaaacaagcatgacatgtccatcaattaatatgttgccagccattgaaagaaattcaatggaaatttagtgcctgtcttcttgagcatagatggaggtatcaaggtatatcatgctggaattccatgttatttgattaagttctaacttccaagtgctaaactaattagccgattcactgatgagctgattatccttagggtttggaattacgatttaggactaatacacaaaacatttttattcagataataacatgaaaatctatttgaaaccatgaactggcctaaatccattcagatttataagcacaatggaagattaagatcatatcaacccaaagatgtaacaatattcaaatccttaccaaactaaaaaaaaaagcttgggtttgtttggcaaatttatatagttagtcagatatttaagatgccgcttgtgacagaataaaacaagagaagaaaacaatcaatcaccttgctttacaacctgatacacgatgcatcatacgtgtgaagagtaaaaacagaatccatggaatgccagaaaggataaatttgtagaatatgtaaaagtatatccacctgtccaaatttgcttgctgggaggcaagaatatgactatgggcatcttccagtagccttatgtttttatttgtggtcgagtactttcccaaccatccaccaaacctattgaagtttcgctcaccctacagatttattatccaattcaatgagccagaattaccaaaaataaactaaacaaaaaaagtaattgatgataaggtttgagctttactgcttcaaggatctctctattcccatgcatcaaagcagcactgtaagatgtgaaatagattagtggatcagtgagacatttgaattaaatcgattacagcagataataaccaccatatacttacggaactatagatgaagacaaacaagcagcttgggacaattgccactgtcgatatcttcttatttgtacattaacaatatcagcgtccgctatagattcagcagcacgagcaagaaaattcattcttttaactccactgtcatccttcccaacagtgataggccgataattgatatagttttcctataccaggcatgtgttaatatgcaagcttaatcacacagttaaggaccaaacagaagtgattgaaaacagttacatgaagtaacatgctacaaatgaccataacaattgaaaaagatcataataaagcgcatatttttacacagcaaaaaattgggccaaacaccaatgcaacacatctggaatttacttaccataatagctagtatttatgcatagattatagatggctagcatcccagctttcaaaaagaatggggtgccattagaggaaaagttgggatatcgcattcagtagggagtgtgcacgcctatgtatcaaccaacaaaaaagtaatgatcaagttacctggcgcacaaactatataacgattgcttggtactaagagaacataaatagcattgcaacaaataatggcgcttcagctgttgcaactacagaacccactagcaagatacatgtcaatgatatgagaaggctgtgatgctcattcaaaaatgaaggaaaaaccaagttgcaagcctgatgagctacttttaatacaaaaagtatcgggaaacaattcatagcagaaaatatctcaggacacaggacccacaagaattctacagaaaaataaacaaaaacagatttgcaccatcagtgtcccctacctggataatcagagggactaaatcaggatcgctcatgctcaaatcaattctctcatccatccgtagtctcccaccattaaaaccaaacagcctgaaagttgaatcaatatctattatgaatttaaagtagcgggaaaaatacaacccaactcttgcattgcaaattataaagtcatccaaaaatccacaaattatagatccagaaacagctggttcaatagcagagcgtatgcacttgagcaaaacacatcattcagataaaaatcggtagacagcatgaacattaacagttcaaaagagccaaaatagctacaacttccaggtaaataaaatatgagtatagagtaagaaattacttttttagcccctctgaaagccatgtcaaaaaaaatccattaaaataaacaaatatatggagaagttaccaagtatatctacaagctttctcttttgtttatcaatgaatgaaactagcaattgaatatttgccgtgcgccttatcaatggataacaaagtagaaatacaatgaaacttggatgtacaatttgacagaaaatattaatataatcaatacaagattggaatacgaaaattcacataattcacatttatacactaagaaattattgcatgtcagtcaataagaacataaaaatatctagaaatactgatgaggaaatagaggacaattgaatagaatttataaaaagtataatcaatgcacatacttgtcaacagccgtgaagggggaaatatcttcatcttttgtgctactattaagtcgctgtcttatatcatcatatttgaccacggactgggagaggctcatatattgcaaatggttaagagccatgcgaatatccccgtgtactctttctgcaagttcttccattgcattctagcagatgaggaaaccatatattagtaacatggagaaaaggtaatgacaagaaaagaagagaaaaagaactataaatggttttgcttttatttttgttgtgttttcttttctttttcccaaaacttttgatggaagtttagaagcagagaactctaaacacacctcttgagcttgaagaccttccttcttggcaatttccatcaacctcttacccatctgttaaacacagaagttaaaaccaaccctatattacaacttttgggtcacgagcaccaagagtaataatgcttacccttccatgtaacagtctacaatatatacgatgtaaggagatggaaaaattaaaataagaaataaatgtgctacttagaacagcaagaattcctgcctataaagaaggtttctatgcaatcaggaatacatttgtgcgtgaaaagctatgttggctgtgaaatctgccgtacgtacgagtatttgagtgatcttggggatagccattgtttaacttcagattgacaaacaaataggacttatattacccctaaataagttgctgcatgcaactgtatcgtaactgcctaaaaattgcaagaaattgagaatatgtccagaggtcaacagataacctgttgcttggttggttttctgaagttgagtagcaagcagtaatttacaaggctcttcaatttctggctataacggtcattgcaaatgcaaattataggaatcttggacatcttaatgctagcaataagatcagcaacaccaccacgatctccagcagacataccatcaacttcatccatgactagtacagccttgggtcgttttaatctgtcaaaattcttgccaaatttatatacaagataaaaccaaaggtccaaaaaggttgatgaaacttcatgtaatactgaccggttgttactataattcagagttgcattactaataagctctttgatagaatttgatgtactgcccccaacacctttctcaatcttagagtctgccttaccacggctatcacttgcattaacctgttatgaacattagtcattgcatttatgcctcaatagttgagtaagaaacaaagagttgcctggaaggttgcaaagtatgcaaaacagcagaattacctcaatagcctgcaatccaagcatctgactgacaactttagcagttgtggtcttaccaatacctggaggtccactcaacaacacagcctttttagctccactatcagcctgcttctttcccttacccttctggccagaatgaaggaattggtcctcccaacttctcaaccaatcatgaagctgtttaacctgcatgtataagttcatactaagtaattgtgcatagatgtatgtgaccagcttaaccgaaagcagaagcactaaccattgattggttcccaactatgtcatttggaactttgggccgatacttttcagtccattgcaaagaaccacggtcaacaatgttgaccttttggttgtcaatggaggcacttcctttattactctttggtgaaatatttttgcctgtggtaatttgattaccatctgaaaattggaaaatcaagatatatgtaagcataaacaacctgcgaaatgttaatatcaaacaaataaatcaaataaaacttagtcatcagatgatgtcagcaatggatacaacaatcgctggataaagctagcatctacaatgggtaaaagacacaatgaacactagaatcatgtctcaaattcatgcaactttgagaatacaagtatctaatagttaggttatgctaagcaggattgtgcatgcgctatacaactaagaagcatttttacgctttcagttacctcttctttcaactttaactggagaactcttcattggtgatttttgctgcttttctgaatttttgtcgctttgatgttttgccacagtagcctttgcaggctttgatttccgaatcatatcaaataaaccatcttcagttaggaatgggacgctgcaaacaagtacagtcatgtgttagaaatgacaattaagaaaatatagttttcttgagtgaaaagagcaaatgataccccagttctttcgctttatttgatttcactccaccaacgtcttcatcagccaataggtaattctgtcaaataagcgatgtaagcaaactataggctaaaaaacattaccaatgcaagtatcatactattatttcataccgtctttttgctaatagagccggtcacacggcctccataacgcttgattagatcagttgcctcctcacgttcaagactgcaagtgtatataaacttatgatagcttattcgcggcattgtttcaatcaggaaatttgaggatattaatggtgcaccgaccatccaccatttacatgaacataaaacaaattaaaatatgaagaaatgaagacaatagaaagcacctgtcaagagtgccacttatgacaaatgtcaaaccagttaaacagtcaggggcaccctccgggacttcctacagaacacgaataacaagtttaggattgagttttctggcaaattataacaagaaggaataagctaccttctcccctttgtgaggaggatccttcctttcaccaaagttcatgaagcctctcccaccccctcctctccctcttcccccagaggctcctccccttccccttccagctgctttggaaggggtcttggcatcttcatccatcttatcctcctcaccgtcgtcatcaagaccaattgtctttccatgggctgctcctgctcctcttcctcccctccctctcccccttccccttccccttccacttccagatgccttggaaggggtcttagcgtcttcatccatcttgtcctcgttatcatcatcaagaccagtctttccatgagcttcagcagtagatgcacccttcaacttctttgatggtggtggcttcaccggagttttcctttttgaaggtgccacaaagtcgtcgtcatcatcatcttcttcttctttatggacttcctttgctggcaaaggcttcatgtcatcctcaagctcatcactgactttctgaagttttcttttaggcaaacctctcccggtaccttttcctgcactggtgtcttcctccttttctgttttggatgcaaagtacttgctagtcttccttctagctgaacaatcttgatcacaagccgcctggatgatccagtaattaaattactcaacagcaggaaaccatgatgtatcaaacaattaaggtaatggaagcagtgtataatttgcagactgcagtaagtttgtagccaaactaacagaggctaatgcagcagtacaataaacctaggatcagagcagagtaccctgttacacgttattgtattagattcatgatgcgcaatggaacatgacatactgaagataattcatcacttttatcgcctacatattctacgccaaaaactaaatccaccattgtacattctttgtagtttgtaaatgccagggatatcatcaaacatttgcacaaaataatgcccagatttaatcagcaggaggagtatgaacaggcacatgatatcatcatcatatggtgagactattggccacaagaaactcccaggttacataaaattgtctattgttagcaataattgatctgctaagccaattcaccatacaacagattacatagaaattcctcaacaaaagggaacatgtacagcaggaagaactcaaaaggcacaagcaaaaaggattggcattgtaccatagatggcgccgccgacggcttctccggaatgctgagcacgggcttcttcgccaacgccgtcgtcccagccggcttcgctgcgccaccattcttgtcctgcgccttcatgaaccatttcctgatgtccgaagacttgtgccccccacaaagaacacaaaaaagggaggagaaagaatcagccaagaaaccctccccgcgtcgaacgaggaaacaatgcgggcgagattgaagaacacccaacccaagaaactcaccatctccaatcccccgaaaagagaagacccggatcttcccggtccccacacccgagcgcggcaagattcgagccgatgagcaggtgaagtgcgggggccctagggtttaaggttgggggcggaagcgagcgagcgagcgagccgatccctgcttcctccctccctccctccgacctcacctcgcttcttggggcgcttcctcgtcggagtcaccaccggatgttgggggggatggaggggaggaggaagaggaggagaagnggcgccgcggcgggggtgtgcttcggaaagagtcgtcgcgcgagggggaagaggagagggggtcccgggtttgggggaaaaggaggggaagcggcgcgcgattttggcgagatgggcggggccgggagggctggatggatggatcggtggatgcgtgcgtgacacaaacattcattggtttcgctttgatggggtttgtggcttggtgctcttgctcgtagcaatgtcctctctctctctcaagtaaaaatccaacatactcccttcattctattaaaaaaataaatctagaattaaatttgacatattatagtacgataaatctatacatatatcgaatgtgacaaatcttactaccatgaatctaaacatatatcatctgtttagtttcatagtactaaaaatgtattacatcttatcctagattcatctttttatgtgacgaagggagttaggttctctcaacgtgtgtgattgatgtgtctatgaaagaaagtcatatcgtatagggataaaagaaaatttggatgagggtaacagagtttggatatactatatatgggcaaaatcattgaattgaaatgttaatttgaacggctgtatttgtatttggagttaattggatgctgaaatgagttttcgatgtaagataagaaaaaatgtggtttagacttcaaacgtaatgctcgtgcaagtagcaaatttaagaacaatgttaaccttttgttgtaaagagtaaaagaaatactatagaaaccttaaaaaatatgtgcaatcaacttttcaataaaactaatgtttacatgtagcaattttctttacttttggcattgaaacccccactaatgtttataaccttttggtagttggctaaaggtgttcatcctaagcccataaaccgaatctttgttaatattacagtgttattttcgacgatacagttaaatagaaatgatgtggtttttaatgcaggttatatctaaagtaacataccgggtatgactttagtctttggtacttaagaagataaggcaatcgaggtgaagaagtataagggagaagagagttccagagttcctttttctaagtatggttggaattatagaaggaggctagaagtttaatcctttgttctcttttgttagtcggataaactcttattttaagttgtggtttctcttataagggataagtactcgtgtatgaacttttgaccatatatatccatttagtagttgtgttaattcttttttaatttttatggtgtttggatgcctttctttcctgtattagcctccttcaggtcagtgtcacgcgttaagtttggctatggtattaccctactatgacttataagcatggtatggttattaagttcacaatgaaatatgagtccgaattgtaatagttgataacatggttgtttaattttccttgagcatacttttaaattatgatgccatttaatttccttgaactagtaccactgtttttagtgagttttgtttaattgatcatgatttactttgtgccagtttgtgcctaccgttaccaacagggagcttcaggagcataacaatttggaatcccaacaaccaatccatgctgctgtagaacataatgtttgtttttccaatatggaagacatgcatgatccatcagcgcaatgcaatagatagtatgtaggtaatttagttcttaggggcgatatcaatggtaaaggctcgtagcatagattatttaattttctttttctttatgatgtgccttttttgattgatacggtcttgtttgaatatggagtgagtaacaatttttaagtttttgtgagaagcttcttaaaacatatatcgtcacatttggttgtttgttttacattactaaatagcgtagtagcattagtacgagcatatcactagtgataatggtttttttaatatggcatccctgtaaaaaaaatacaataagaccatatatgtaatagctactgtcggtgacatgggaccgggagtatcatgacttagagacttgaggcagacacgatcacccacgtggcctaaccccctcgggggggtcgggcccgagggtgatatggccgcccttctctttgtctccccgaggggtcggaccgctaccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgacgggtcacagaccggtcagatcgtgggttaggtggcgacaggcggtttgacgcacgcctcgccccatcccgtcaggacgagagcctccaagcactcgtccctagccggaaccggcgtgttagctcctggagatggcacgttggttccggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagccatgttcccacgtcgcgcctgcttccggtggaagtggaggtaggtatgggcggtcccgtcagaaggtcattcggacggcaaccatacaagtctccgtctgtttatgaataaaataggataagtccccacaaaaaagagagagatggtgcatgtggtatccccttgaggtataaaaggaggaccttgcccacttagaaaggggattgaaggggggaaaaacaatcccagaacgatcgggggctggctcgcgctttgtagcttcttcatacacagatccaccaaaacacaggagtagggtattacgcttctcagcggcccgaacctgtatacatcgcccgtgtcttgtgtgatttcactctcgcgaactttccacagaacaagagcttagaacctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagcttttcctgttcagcccaatggccgaacaagcaaaggcgcacaacctctctccgagcgttagcggtgacgatggggagccaaacccacgccgtcgagctcgtactccaccgccccctccacgccaaagtcctaggagggaggaggtgctcgagagggtcgaaggatccgcgacttcgacatccacgggtgatggagaagggcgccgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggccgccactcctttgtcagcgcctccgacccaggaagatctgcgtggggggccggatgcctgcatcgatatcgagcgccggcgtaatggccgacgtgctgcccacgcaacggagggcgcctcctcgtccggagtgtctcatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccgtgaagggacaggcgcggggttggctaatgaacttgccacccgcgtcggtccactcctgggaggatttgtgccaacagttcaccatgaactttcaaggcacatatccgcgcccaggtgaagaagcggacctgcacgcagtacagcgaagggatgacgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgtccccggatctgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcgtacgaggaagtgggaggaggagaggaggcaggagcgcctagagggcaagtccccggcggttccttccggcaaccggcgaagtgaggccaagcagaaggaccccgccgaggacatcgatgacggcgatgatgacctaggtttccaagagcctggggccaccattgccactgtcgatgagggagcgtgtgctcacgtttctcgccggagcctcaaggccatgaagcgagagtttctggccgcggcccctactcatgaggcgacgcgccgggcacggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagccttttacgccatcaaggccccggggatggtgctccggccgtcccagccgattatcggtgtgacgccgggtcacacttggccgctaggtcatatcgacctcccggtcaccttcggtggatccgccaacttccgcacggagcaggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcaacctcaaagtcgcgcttgcttgtatggagcagcgcgcggaccacctcgccgccgcgtccaagcccgagggtggcgacgagatgcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcatcgtctcgccgtgcggccgggcgcaaggccagtccggcagaaagtgcgacgccaggccccggaatgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcgaatctagcggaaacttttgaaagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgtcccggagccaaatgaacccttgctactctacttagcggcgaccccacaagtggttagtgcggtgttggttgtggagcgcgatgaggacaatcctcattccgcgcacccccaccctgtgctggcttggctcgggagagagcagggaggagaggcccccgagccgaacggtggcccaaggcccctgacgaccggagctggtcctctgcctgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgttgtcctccgaccccgaggtcgtcggcacagaagacaagtgcgccccgcgaggccgcttggacaaagagcgcccaagggatgtggcccctagcgaagaggatcggccccaccgaaaggtgcagcggcccgtctactttgttagtgaggccctccgggacgccaagacccgataccctcaggcctagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcagtcgaactttctgagtttgatttgcactttgaaccacgccacgctatcaagagccaggccctcgccgattttgtggcagagtggaccccagctcccgagcccgtctcagtccccgaggccagctcgggtccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaattctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgatgcccgtcggagtccaggcctcgggacccgaggggagcgctcctagctcccttagattgattgcttggatcgctgagatccaagcatacctcacagataagactctacccgaggaccgcgaagggagtgaatgcgtccagcgcatctccaaacgctacgtgctggtagaagggaccctctatcggcgcgcggctaacggaatcctcctgaagagcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataaccactccgcacttaaattcattaagggcatcatagcccggtttggagtgcctaaccgtattattacggataacggcacccaattcactagtgaactttttggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctaggcgaaccgaaccacgccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaagcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacgg

SEQ ID NO: 75267 - DNA, 642 bp, Oryza sativa
ttatccccaagccgactcccggtccatcaccgcaaatactctcccgagacatcgagtcacctacacatggaacaaacaaagaaatcatattccgagaccaagctatctccaacttgactcattagcagcaaacaatagtattatatacgtatagtatccatctagaagtcataatcatgaaataaactcggatatccaaataaacaacccgaaatcgaaaccgacacagtgtcggcctgtcagaccgcgggctgcgccggtctgaccgcgcaatacacgccggtctgaccggctaccagagcccggtctgaccggtcacataaaatgacgaatcctgcaatcatctgtgaaatccattcatctccaaaaccacttcgtgaataaattccaaataacaaaaccaataatctccgatgcccaattgttcatcacaaaataataatcaaaaacacctttgattttacaatctcccccttgatgaacacattggcaaacccattaaaatgttttggtgtttggaaaaataaaaacaaaagtggtaaaaagcacacttcgtacaaacgtacacatcgtgctaaaaatccaaaagaaaacttctcccccttttgaaagaaagaaattcccaattggggctgcaggaat

SEQ ID NO: 75268 - DNA, 2532 bp, Oryza sativa
caaatatacaaccagcaattcagatgatttataagtaactaaatttgaaataataataataataataaagactatgaaaagaaaaaaccatctacaacacaacatgtgattaattaaaatttaaaaaataaattatgaaattagaaaaataaaaacaaaagtttaagaaagaatacgatttatgaataacaaaagttcaaaataaaaaaaatattaaaagaacaacccataacacaacaatggtaaataacaataaagagggagggataacgggtgagccgtaaataaataaatagggtgtagcggttgatgggatattttaaaacaataaaaatataaatgacgattagattcaattttaaaaatctcaatgacgattaagagaaacagcagcgagcaagccgtcaaggagcgcagtcgtgacgtttgactggacttctaaaaagaaaaaaaacaacgataatcataatatcatatttgactttttaaattccaatgacaactaagaggagacatcgggtggattgtagaacagtacaatgacgacatttgatgtaacttctaaaaatataaatatgtcaatcgacaagacaatgaactaaaaaactataagatctaaatatgaaagtttcaaagaggatgaataaaagttgtgacaggtcgggcaatcaaataaatgagtggtaaaaaagtaaggggtgacgacttattgacttttaaaaactaacccgatgataataagattcaggccctctttgtttaggcttaggcttattggcctagacttttaagtcagcttattggcttatatgatttataagctagtggatttaatatcctaagtttagtggtggagtcatacatctatctcatataagccaaaaaagcttctccaacctagcttttggcttaatagtgttagagtggcttatggcttcaaaaaagccaaatgaaaaagctgcttgtttgttttagtttagacttttcgacttataagttggcttataagcctaaacaaagagggcctcaatcttttaagatcggctagatggctatttaacaaatttaaataaaaccatgcttaaaaatatataattctggatgggtgctagccgcgcaacaaataaaggggtgacaaaggagtaagggtagtaacaggtgtgacttctaaaaactataaacccggggatgataatgttcgatctttgaaagtcctaaaacaacgagatagatatttaataaattttaagtagaatcatgtgaaaaattagataattttgtgggtgctagccacgcaattgcgcgggccacccagctagttattaaaatttaaaacatcttctacatataaagttttcacacgaaacgcaccgttaccctactactggtgcggaagttatgtgacaattttgacaggttcagcaataatcagcgttgagcaatagaaaatggatgagttgccgttgcatattcaggtgtgcacgattaaaaaacaaaagcaaaaaattgcagacagtgagaatctttcgttctttcaccgtagggcccggcagttgagtgcggtagtaggatgtgtgtattggtgggccgtgtgggcaactgggcgtggtctccacatgcggaatgggttacctctctcaggctctcaccaaccagatcaacgtcggaaataatttttaactttcaatttcttaaataatactctctccatcctaaaatataagcatttttaacttagtctccgagatgctactttgatcaacgatatctataaaagtaaaatattttaaataaaagaagttgcatattatgatagtttgtttaatgataaatctagtaacatcaattttacatgattgatctttttttttctattaatagtcaaagttataaatatttgacttgacactataataaaaatgcttatatcttgggacggagggagtacgatgtttgcagtgagaaaatcacaattatataaaagtaaattcaattatcaatcaatgatattatttttatcaaacaaaactcaacttattattaattaagtatctatagagttcaaatttaaaaatatgtacgtgcattattgagtggatcggaaggagtacagaagagcctcggccttgaactcgggcgtcactgcacctaccgaccaacgcaacacgcgaacatcccgcccgcacatccttcttctgtcactctgatcacacatggacctcgtgggagatcggaaaatatatatagtcgttggatacaaaatccgttaaatctttgagctaatttcttattacaaagtgctgttggttgatatgtagcctcgccagctacctctgcgtttgttgttattcattttgagagttggcaccagagttgacaaactccattataaccactcagttcttttttttaagatcaaagggcgagagcccttccgtttccattaatagaaatgagatagtagctaccacaaactggaaaaacgaaaaaaaaaaactgtctgatagtcctgactatcctaaaagttgagaa

SEQ ID NO: 75269 - DNA, 9543 bp, Oryza sativa
gcgtgttaatgagtgaggttcactcccgaacacaccctagctatcctggtaagaacaaggaagctccagtgctaatgaagcaagcggatatttagattagcgccataaagttggattaagattccagggagtcggcgatggtgatggctattatcttgttcattgtcaccctgttctgttatcacttattagccatatggagcaggtgtgcaaattatttgtgactaatgctgagaatcaaacttgatgcataaatactgcatacaattgtagatagccaacaaactttgttcgcggtggcggctatcttagcacttgtgtgaggtcgcattactatgcattaatggctattgtttagagatgaaagtggatggagaaaccgaaagtgatcggtgtgatggtgcccaagcgagactaagtattgttttattttctcaatgttgaacggtcgccttgtccactatcaaaatcccgattgtgcgtgttgaactagcccgtgtgttgtgtgcatgctggcatgctgccacactcaaatagtcataggactggagatggacacttcaacgtactaacaggttacaaggggtgtgtttagttcacgtcaaaattgaaagttaagttaaaattagaacgatgtgataaaaaagttgaaagtttatgtgtagaaaagttttgatgcgatgaaaaagttaaaagtttgaagaaaaaatttagaactaaactcggcgaaggataaccaaagttgtcgcgccagcatttgtacggtcctgaggaccaccaccattcctgtgcgtaagtaaattatactacgtagtactgaataccgatccattatgtaaaagcaggtttaatagtatagctaactactagctccaaatcatctataatcaatgtaatagctaattcatacaatagttgcttactatactattaatacctggtcctgcctgtcatacacacattacgtcttggagtccgtgttgcagcgggctacagatctgtagcccgctgctcttatctctctttttttatctctttacaatatgtttacagttggcttatagcctgctattgtaactgctctaaaatactccacccgtcaacctgaccgacctagctatatgaccctgacccaataaagaggccaaaagatggcttattggggaaataagctaaacgacttaattacaaacaaaaaataatttacaaataaaacttttatatacgtattattaatgatataaatgcaaatactgaaaaataaattttgatgaaaaaaattcttaaaatcaatttcaaatttaaggttgaaaatttaaattttagctgataagcataagcgaaaaaaaggcaagaaaaccccagataatcaaccttgagtaaaatagaagcgggctaacaactatcctgacagtactgagtataaaacagatgcacatgcattcttacctccacaatagtttttgctcggaatctttatggacttgcaaatttcctgtgggcatggagttcgcaatctttcatctggctcggcggcttgacgatcagcacatccacaaaactgcacccggcccaactccctcagctatgcaaaagggataagacatgaagaatacacttcctagtcacagatgcatacagagcttaaaaaagatgcaatcattctttaccttagttgcctgaggcgatccaaaatgggcaggcaaatgggcatcaccttcgcgattgccttgccaacagtgtatctttttggtagctactttcccataaagcggtgcgcactagcacaacactgattcttccaccacatcaaaatcaatcgaaccaaaatgcaaaacggcagttgctcccggatggaaacaccccttggagcttggaattccacaatctgcttattgcacatggcaagctacagcctacagaacgccaccaactgaattgacatatatctaacgttttgttaacacagttatcagtcacataaacgttccagctaatcaattgtaggttcaagtacaatcatacccttacaatatagccggataacaggatcttaaaaaaaataagtacaatcaagccacgagttcagcaagaaaactggaattacacttttgtcgctttacctaaaccatttgatactcatcaccttcctggagacttcttgcacaacccctcaaccctcatgctaaaagttcaacatcctcaatcctaaatagtgctcatgatagcaacctcacctatcaaatcgtgcaaaaaggactttattagccaaccaaaagttgcaaatggaaaggaggggattgcaatcagggtcgacatacttagcaacagaacaaaagagggggcagtggatgctaaggaaaccatacttcaactaaatagctattttagttaattgacctagcataccgctacaaaagtatcaacaaattactattggcgagtggttagcttctgtctttgattgctgcccaggaccattctaagattattatttttttaattattgtaggcttcagtgatgcaaaggcataaaagaggtactataacattgcggtatggaccaacatgtttctacctagatccaaaagtaccttagtttaacatgtggaataatgtgctactggtccactacagctaccatatcaaggtcttgttattgccacgacagtggtctaataacaatcaagattgtgaaaaccatttacaaattgtactgatagttacaacaatggccggccctgaccctgatgttgactaatttcatgaatcacaatattgtaacaaattgcgtccaaggtcaatagtggctgcctatctgtcaaaagccagttataaaccaggaaacctcgacctttttcttgcaacactatagtatccgaacgatgtagtttcttgcaacagaaaaactcagtcgagatacaaaatacatgaaaaactttcatgatagattgtcttgggctacaaacttttcattccaaaatgttcaaacaattttttttccatagaagactataaataattttaagatgcctataaataatggtgcaaagaaaagacagaacatttcagcagatattatgctatggaatataggtatctaacaagaaaaatcatcctacgccaaaagtgtttataatagagaatatcttgtgacgtatctctgattaagtgcatcaaatcatctttagttttaactataagctcatgctggagcttaaattgttgatgacataattaatataggtttgctggtttatgatgcatgtagtctacaggggcattttggtttattggatgcaaatgatggcataaagcgtttaaggtggtgtgacatttccttagcaaatcttttgcactcaaattttaaaaattaaatatttgaacttgtatgctaataaaacaccataatcacatagtacggataatactgccttcttcaatacaaatttgacttactagataggtcttcaagtctagaaaatagagaggtcaggtggtggtccatatactgatttccaggacaatggaatagtccatccattggacccatttcctgaaaattcacagcaggatttgtaaacacaggattccaaaatctgatcacagaatattgaatatcgatattcctaaagaaggaaagtaaggcaaattaccaacggttaatagatgaaaaactaataaacttgatatatagatgtaccatggaactgttcagggccttgagcaacaagtttgcatgctgcctcagccaactggaaagattctggcatattgtccccttctgagcagtagcatagtacacaagtaactttcaagcctttagcctgtaataaaataatgtcattaaacatattacaacagtgacctctaatggtaaaaacaaatcaatcaaaccttgcaggcagagaatagtgctgcaaatggcaagctcgagtagtaatcatttatcgtcatctcctcaggatcaccagtcatatcttctgaaagatgaccaccttcaactaggctagcaagacacttccacctttgctgagatggatcgtattcctcaagcttcttccagcctaagttctcacatttcggatcagaaccgtcctcgttgcaacttgaaaggtaatatacttgcatatcactaatagataaaacaattaatgagaatgagacgcaatcctaatcctaatcataaaagacaggatatgtgaagctatacatttcaattacctggatgcatcaattatccttctcttgcctgaatctaaacttgaaaggataacaacatggtctttttcaatgctgcttataaaattagcaacattttttgcaaatgaaaccaccatcccctgaaccagtataaaaggtttaaaggtgtcacaactcatgaaaaaaatcatcaattataggtgcagactgcagacaacttataggacttcaccaactaccaaaattccaaacaaagagtgaaaggcccaagcatcgcctgcaactctagtctcacccccatcgtacctctttaaagaaaaggtcaatagatcaataactatattttctctaaatcatttcagaataacaaatgtgctatgtaaatttagttcacaaggaacaaatatccaagggacagatgttagtctaggaaatgtaatgtgtgatgtacaaaaaagaaagggaagctgattctataatttcaaacaaatggagtacaattttgatattataatatcaaatacaatagagctcaatattgttctttatgcattcttgaaagaaccctgaagcatgtgcaacaaagctcacaagattctgtaactacatgaatcataatcacccacgtaagcaagtgaaaagtatctttaagtactctttgagatttataaagttaaaaccgaaaatatgtggcaaataggtaaaatcaacatactgtaataattggggaccgttgctgtatgaaggccagcctatgggatggagattcataagctgtaaagagaaaagagacagaaggtgacaaagtaagtagacattatatttcaattattattcacacactaagtagtgccattgctgaagaacaatatgcgtggctgaatcttaaggtattttttttaatttcttgtgccgattattctcttagacctgaacaaggcatttcatcaagtagctggtgtgcagaggaggaattgttcatgccggactataacacatttcatcgaacagttggtgtgcataatagaaggatttaaagtacgaacacacccaatcaccagttcaccacccctaacacaatccaatccatcaagcgtcctgctagcatagcacagcagagcaaaggacagagcacccaaccttccagcgcgagcgcgagatcaccgacggcgtcggggccgaaggcgtcgttgccggcgcagggcagcacggacggctcgtcgaggtacgccacccgcctcgcgcgcgacgaagacaccagcaggtcgacggcgagctgccccacgttgccgatcgagagcgccggctgcagccccccaaaaaaaggatcaccaacccgcgtcatgagccatggaggcaaagctattcaaaccggagagaggagagaggtttagggcgacccggaccatgaggagggtggagcagtcgggcgagaaggactccccctcaacgacggcgtgctccatcgcggcggcggcggcgctggatcccttcaaaacttgggcgagaagttgaagggctcgagtgggctagctatggaggcaggcagcggatgggagaaagacgagaagaaatacgccgcttttgttgcgtagaggagagtggagacggagagaattcgatttcgttgtgggctcaaattgggccgtgattttagttgcgggctttgggagttaaatgggccggattggaggtagcctggacttcctggcccattaattaaaatcagacgtatccaatcggtgcagtgcaggtcgtttggtaaaccggacagttattactgaacggtttacgtgaaccttgataatagttactccatggacacaacccaccctataagctcttcgtttcttggatactcaggccagctacttgattacagagcttcttggatagcacgttactcatcatgcccaggattagatcattcaaacaaaaattcaaagaagatcctaatactttctttccaacaagatttacatacagaagccactgagaattggttgacaagggcaaacgttcaaggttcaagtaaagagtagtccccgccaaaaaagaaagaagaaaagaaagagtaaagagtagtcacgggctcacggcaatagcaagccagttgagaaatcagatgggacatcagacaaaaagttatcagaaccagcactagtgctgcatatattaaccaatgaatcgactccaaatttgaaggattacaacccatatgatacaattgatgcaaaatagcaaggcaaagtggttatatacagagagtatatctactatatacacggtacacgcttccatcaatccattttaccggcgaaagcccagcggccagtgagcggcgtcaggcaggggcgaagcggtccatgagcatgcacacggtggcctcggagtcggagaggaggatgctgctgtccctcgtcctcgtcgtgatctcctgcacaacaccatcaccaaccttactcttgcagctctccccttcgctctgagctcgctggccgaccccggcgtcggccgccggtgccgccccccggcccatcttggcgaactcccccagccaaactccaaccaggcccgccattgattaatgattagtctgttcctctctgcctctccgagctagctgagtgaattcactagcttcgcacacacactccaaagaaaagctcagttgagtagtagtacttgactggttgcttcgttggctaaccgcgcggcgttggggctctacttatacgcgtactccggctccggcaaccgtggggagacgggaagacgaagctacgtgtctagttgttgcgatatgtgagagcggagcgggaggaggaatagtcgaggaaagctgcgtgtggtttcggcgccgtgcgcacggccgcgcccgcctctcttattggcgttttgtccgcttcgggctggaggaggaccacgccacgcgcggcgccatgtgacgcgcacggcacggcgcgacgcgggtctgattcgagggaggcttgggggccatcgtgtggctggtgggtgcccgagcgagcagcgcgcggggaatcagcgtggatataccaccggttgggctcccgcgatccggcgagcggatgcggagatgccgcggtgggatgctaaaccgacggggcgtggagtggtatttgatccgggggatcaaaccggatcggatcgtactactgtgcttcgtgaggtgcaggaacgccatgtcgtggtcgcgcacctcgttgttgtggactgtgttggagtaacggtgtgccaaaactgcgggagcattggagaacatcgatccatggtattggtaaatggtaatggtatggccgatagtttcagaatcaccgaggcacgtgaaattgtactagtatttgtgattttgtgcacctttgcaactgttgcgacacaaggtttgcacgtttttaactcaacgttggttaactaccacgagctgacgataatgtttttactcccccacaaggaatataattttttcctcttctttacttcttcaccatctgtaatggctcaccgctggcacagtcggtaccctgtaccctgaatcccttttttcataatgaatggaagatttagggactgtttagttgatgaaatgaaaattttttaatgtcacatcggacatttgaccggatatcggaaggggttttcggacacgaatgaaaaaattaattttataactcgcctggaaaccgcgagacggatcttttgagactaattaatccgtcattagcacatatgtgttactgtaacacttatggttaatcatggtctaattaggctcaaaagattcgtatcgcggtttacacgcaaactgtgcaattagtttttttatttatatttaatgctatatatgtccaaaaattcgatatgatgtttttttttgtaaaagttttttttttaactaaacaggtcctaggtggagaatctctcccctcctatgattattccaaaaaaaaaatttctactcccccgatttactcagcttcatcgtagagatcagatcttttgtatgtcagttgtcgatcagcttctggatctgagtttctgaattatgatacgtgttggtgttggtcagtaacagtaaaggaggcaaatatctttcctggaagtgaagcgagatatttcacacgtatcaacaagtagaacactcaaatcaaaatatctggttttcaagaaaaagatgaaaatatctgatttaaccgagtggtggcgatgaattatagaatccccttcactcgaatcgtctcatgatcgtgtacttcgaacccgctaaaccatcatatctcgattgaagaaaagtgggctttcgctacagagacttccaggattcagacagtactgcagtgatatttcagaagatttacacaaaaatcacacgagaccgtcgaaatcaccaggttcagattcatagctaaaggtatagtagctattttacgatggagagagtgccctgtaacgccaagctaagcctactctactggccgaagcaatcgatcaggatggacaagaaagcgtcttcttggatcacgctcgccggcgcgccaccaacggcagcggcctgctgcttcttggcagccgtttccacggccgcgccgtcaggcttgttctggccgtcgtcagaacgagccgtgcagcctcgcttcgaagccaccgtcgtcctgaacgcctgcgcgccgctgacccggatcctctcccgttccaccgtccaaatgtctaccaggctcgacatcgatcccgatcgatccgatcgccgatcgaccacagtttcttcagaactcagagcagagatcaaacaaggtggattgatgaaagcaaagatcgaacagagtctggagaggcgtttgtatgacgaccgggacaatttatagggttttttttgcagctagcacactgatgtgctgatgtcagggctgctgggacctagcagaataacaattggaacctagtgacgccattcttggcacacaggattgaagcaggtcagccatctggatgtcgttcttgccgctttaatttagacagtgcaacgcccaccggggccgcggtctgaaagccggcagggacgcgggggaggagctatctgagacacgcgcgcgatcttgataggaggacgagctagctagctgcgcggtgggcgcgcggtttcgtgcccatgccggcggtgagcgggaaattccggtgggtggagtcgtcgtgttaccgtgggctcgtgacggcgacggcgacgacagatgcatcctggactgttctgccacgtcgccatcccgcgtactactgaatctgactccccctgcaagccaacgcttttgcttactgggctgcaggaat

SEQ ID NO: 75270 - DNA, 5360 bp, Oryza sativa
caaattaaacatggtagggactagatcaagaatcctagccaaccagagctacgcattgtgtgccgcagagatgaccgggtagcttttgatctgaaggcagagagagaggggtctctgcagggtgtgcaggaccagcgagggtgtaaaatgtgctgacagacacctctcttttggatgtgcacatattcagcaaagcagaggtataatgcccccaagagagccctcttgggatctttccgtattcatgaaaggaagaggggtatgtgacgatggaagacgctagctgcaggccgaaatgaatgtggcggaatgcgacaacacgatatgggtggcactgctgctagagagagtgtgacatgatagtgatatatccatcaggacaacatccatgcaggcagcatcgatctcaagcggtggtcaggtcgatcagaaattgatcgagcagcaaatttgtaaaaatctgcaaattttacacgctgtttaattatgattagatttgcttatacaatactgaattgctgttaccgatctgatcactagctagctagcataaggtaaacagtaattaacttatgtacgtacgtacgagcagtacatatgagtggctgtgccgatcgaatcagcacgcacgtgtggctgtcacgtgagagcaagggtgagcaatttgggataatagattatatggatctcttagcgctagctgcagctagctaggaaggagcagtagtaaacaagaatggcaggtggccatcaaaggctgtacagctcctccgatacattccgatctcgtcgtcgccttcatctcgcacaaacaattaaaccctaaataatccgtggaccaatcaatcgctcggcacgaccaagttaaaaattaaattaaccccatggcctcgatcgaaaggacgacgagccgcatgcatgcagatcgatgcgagctagtgaattgaatgaacagcgaagaattaaagagagagagaaaaaagaattatgtacggcgattccgaccgcggcgcacgtaccggttgtagttaacgacgcgacgacgacggcatgagatgggaacaagcaggaagaacttctcgaggcgctaaacaaatcggaaaggggaattccgattccgggcctgtttgatgcgtcccgtagctcccggtcagcgcctaatgcggcgtgttcctcgcataaagcatgccccggctttttcgatctctagctacatagctctctctgctgctgctaattcccatgcaatgccgagttaatgtgctgctacttctaccgtctgtttgtgcgtgccttgatcttggtccggggtgctatcgcgaactagtttaatcgctgtcgtgagttggtaatcctgtctgtcttaccaccacactgtgtggtgctcatgtgccatggggtcactcactcactcactcactgtctgattatttttttctccctcgcggcaatggtggtcaggggattcagttgattgcttgctagatggtgagacctgagatgtgcatgatatgatgtgcgtacgtacgcggcagagaggcaataactatatatggggatcaagatgtctggagcaaatggcatcattcccatgtcttagcttagcttagaccaaaagtcactaccactgaaaaagcgctacagggaattgcggggccaatcagagctgattgagcctgcctactgcgtgcctaagcgctctagctagctactaacagtgaaattaattgtcctctctttttttttctctctgaagaggagcgttgtagcagaaagactaacatgcatacatggtggcttctctgatgacaatcccgctgatagtacatcagtactaataataatcctgtagtactactctgcttcttcagtgctagctgcatggtcgtgggactcactggctcaggcatgcacgtctaactcggtctaactcaccaatatctagtgtcggggcagttgcccagtccatggccccgatcgtatctctaccttagtggaaacaccgaaactggagagagaaaacaacaaacaccaacaccaaataaccaccttcttttgcaatccggatagatcgctaatcgatcgatcggaatgtcaagtgtgtggccgtgtttgtttggttcgtcatgagtgccctcgagactacttgggcatgcactttgcagatcaccccgtgctgtcctgcatgcatcccggtgtgcgccccacacgacttattttctctttgcgtgcatgcattggcaatcgtcgttccatgtagtcgatcatgcatgtgtgtgtacatctacatactggtccgtcgttcgcacgtacgtacgcttccaatattcttcaatattcatggatcgatcatagagtgtgtgtggacctcgatcgtgttgagttatgatccaaattcatttgcacacgtataaagatcagtttcggacgaagcgaagcggaggtttcatcttcatatatatactttttgtaagccgtcgttcggcgttgtaaccttcactccgatatagtgaagatatttgccggttagcgctcgtagttttttctctcctattttgaaagggttttcatgttaaattttgtgttttctatatgatttatctattattttttatcgtttatttgcctatcgttttctagcagatccatcggaacatgcatgtacatttgtggtctcccctactgatcgatcgatgcggtgccttacctttcttccaaaggcgggcgcggcagctgggttggccgggccgtggcgtacgtggtcggtgctagctgggcagtgggcaccgaccgcgacgcccgcgcggcctaaagctgccgttgccgctgccgcgctcgctgcaattcgtcgcggtggccgtccgcctgcatgattgggattggctctcgcggcgcgcgggccgcggcccagcttagcctactccctcccccactgcacgcggccgtacgtggcccacggcgcgcgcggacgagtccacgcgacttttcggtggaaatcgccgccttttccacgcgaccattggtgttttttctccttcccgtctgccggtggtggcctggccgaatggccgatctatcgtggatttgtgagagaaccgtgatgatccgtatcgatggatccatgatgagttcttcgctgccgatcgatcggtctctgatctatggatggagcggtagccagttccgttgtcagtttgataaaaagcgaggcaaagaagcagcaggtgtgtcaacagagaccaccgggctttgttgggtctcgtcggcatatgcacgcagtgcctgcgttttgcgacaacgagccacttccaaggataaacggccaattgctgcgacgagatgacctccatcgtcgtcaggtgtcccggaacagagaggcacgatgcacacggaatggaggacgtggtacatgttagtaccttttttttttcccggtgatatatatgcttttatatatcgaggctctggtcagactgtagtcagtcagagaaaaatagtggtgttcatgctttaggaatactaaagtctgtctctgtcatgggaaaactgatttatcgaagtgattttttaaggacatgttagattacagcatatgtacttttttactttaactaggaaggtagcccgcgcattcgctcgggtatgtttcgtacactaagctggagacacttataagagagaaatattaatcagagaacatctgccataatttctctataaattgttttgtcggcattaattacttttataattctctaacctatgagctttatcctatatcatattttagtaatatctacaagtaattatttataatcttcttcatcatttgaaaaaaaggtagaattattttctttacaaaacatgtcaacaaaagataaaagtaaggtgtttttctctttttttaattgcatatatattatcatggtttaatagaggagaattgggtgggacatgaagctccactaaatgtatgggtttatatagcctaatataactgatgtattttgagaggtgatccatctataaacatttcatgtagagtaggtcaaagcctccacacaacttaatatggatactataatgataaaatataattgtgcagtattagttttgaaatgttatagtattcatattactatagcatgaatacacgcttgttttttatataagacagatataatgataagaaataatggttccacaggtttaaaaggcataggagtattccaaaaatgtagcttaaaaattatgtttgttttaatattcaatatcattgcaaagtgagtgtagctcaaatggttaggtttcttgtagtggaaaatgccaccgggttcaagtcctaaactttgacatgggtgctcgcatttacgattaattattctttcattggtaggtgacgtatccatcgacagcgagatgtccgtggtgatttctttaatctcaaaatatgttgtctaatcttttggagatactcaaagggggtaagctatgtgtttgtgagttcataggggtgagtgtgcgtccattaagttgtgagcgcttacgtttgttgtgtgtttctaaaaaaaacattcatagtggtaggctatgtgtttatgcattcatatgggtaagtgtgcatgttttgtgagtgcctgtgtttgtaatatgtttctaaaaaatatccaacattattgattgtttttcttttagtttgagagctaaacaatatgaaggggacgggtggtgttgtgcgcatgtgagggcgaggaggaggtggaagagattttatttttgtaatttttctaaataatttaaagtgatagccgatgaaggggtgtttcattttttttaaaagaatttctaagatactttctttgttttataggacgtggcacatggcgatttaagattatgtttaagaaatagatttatagttaaaaataatggatttttttagaatcttaggacatgatagctgctcgggagggagtttaattgattttggttatatacaatgatttagtataacataatatatatttttaattaatttttgattgttaggatattatttttttaaagatagatattatgggtcctagttttgagttatatatttttataaatacatttaattttagatctattagaaaatactttgggtgttgtattttctaattaaaccacttagattgttttaaattgttctacttgaagtacatgttattaatcagaaggtttaaaaatctactttatattttcttcaaaatgtatgaatcgatgaacaatagttagtccgtagaatatatatgacacaaagtaataaatttctttaatattatacttaacttggatctttagttttaaattttata

SEQ ID NO: 75271 - DNA, 25327 bp, Oryza sativa
atcaattgttctttaagcatgacataaatacttttgtatttgcacaaaaaaattgaataagatgaatggtcaaacgttgctcaagaagtcagcaacgtcatgcattaaaacattaagggagcagtttctttataaaatgtaccctacactggctccgatgaaacggaggagaaagatagaagggagggtcggagcaggggagaagaggacgctggagagtaggccgctggagagcgatgaaacggaaactgcagtggtaggagacacctgccgtcttcgtcttttccccctctttctccctctctattttcactcttcgtaagcttttttcagcgcacttaacagtcggttaacttattttttttgtccaatttttttgttaaaaatactccctctttattatctttttttctccatttttttaaaatactccctccgtattaaattttaatgtatgtcgttgtttactttttatcaacgttagaccattcgtataatttaaaatatttatgtaattatgatttattttattgtgacttgatttatcatcaaatattgtttaagcatcacataaatatttttgtatttgcacaaaaattttgaataagatgaatggttaaacgtaggtcaaaatatcaacaatgtcatacattaaagaaggagtagtttctttataaaatgtacccaacgctggctccggtgaaacgggggagaacgacagaagcgaggatcggagaaggggagaagaagatttgagagacttggacactggagtgatgaaacagaaactgcagtggtaggagataattgtcgtcttcatcttttccccctctttctctctctccattttcacccttttttagcttttcttcactgactgttaacattagtaatatgcacgtgctaaacgctatgttgcaactcctatttatctttaataattttaaaatttttcgtggtagcaaaaaaatattattatatgaactgtgcatttgagctttaatttaatttatctcatacatcaaatatttcacatatagtataataatatgatatactaattcatgcaaatatataatacatataatccgagggcttcacgcgcttccctgtcatagcgatttgtgtccatacgtacctaatgtaataatatgattgaaaatctccatttagtcagcaataatgctcgggagtaaaattatttacacgatatgaaccatgtcagttatgttccaaaaacaccgtaatctactataaaatccataccatgcagtaaagtactattattatttttattagatacaaaatacattcgataaaaaattgtagagcagcaagcaatagaaaacgtgatccttagcacgccaacgagggatgtaactctacgtcatatcgtagttctatttggctattctttcattgcttactaaacattaaacattatccatgcccatttggagatcaacaagcaacatatattcttacatagtactaaataattgtatttgcacagtcaatcatgccatgtaaaagccaacaagatggtaaaatcacccaaatccacatcacatacttcataggatcaaacatatatcgcatacaactcttttaatgatgtttatatagtctggtagtgcagccggaaaagtttactttgcatatgaaatttatgtcaccaagtaataaataggcatgtattcaaacaacgttgtattaaaatacaagtgtgtttgaggatacaataatacacatctccatcattgtacatggtataaaataaatataaaaaaacctcaaagttgaaagagcacgtagaaaatggacacaaaaatcactctgatcatccaatgctaccggcaatacaaaattttgtgtaaaatttgtcatttaaattatcctaatcattactctgacaaaacaaagatgttatgtctaatctatatcttgaatcagtataactccagagttcctatttcgcgcagatatttaactatttgtcacttttagatgtggcaaataactatttgccactggactcacatgtcatagacacatgtagacccacacgtcattgagataggggtgacaaatagttaaatgccaaatctaaaaatggcaaatagttaaatccctaccacaccttacgctaggcgagcttgggaatcagattccattgctcccgctgttttccccaccgcatcgccacctccccattttcttcgctgcattgcctcctccaacgccacgcaacccgctcctctttccagctcctcccagcctcgcttgtacagccccctacaacagtccagcttgaggtcagacgccactcctccgcccttgttcgctgctcctctccccatccttctcctctccgtaacacgccggtgagcaccccatacctgccatccgcaaagccagctgtcgctcctatgcaactgaggcactaacacaagctcgaggtcctctttctcctcctaagctgctagcgcaggagcaccaaatagctgcctcgtataactcagaatcttcatatataattgagaaattattttgggcaagacaagaatatggtaggcacaactacgcaaaacaagcattaattagaaggcactacacaatgtactttaaatttcttactgaaaaatattgtcataaatatgctagaagctcatttaaaatttccctgcaatgaccatagaatgcatgtccaagttgcatatctagctacatcaattgaatcagacatcaattagtgtgatcatacaccagtcgctattctgtccttgcgttagatccttgcatcacgatccttgacttcgtgttatatcagaagtagagcaatcaaagcaagccgattgagacatgcaaaacataatattgatatttgtcatacagaaaattgcatgcctatacttttatcctggcattctgcaatgacaaaaaatacaatgggcaaccaatcaaactttggaaccacccatcactgcatagaaatatattgtgcatttggactccctatcaaactttttcttagttcagagaacagaatgataatacgcatgctacaatctaattcaagtgcccgaaaaaaaatctcagcaaatttggtagcaaaattcagtaaatcgataatggtcacctaattatgtttgtgcttgaactgtccaagtggaaataaaacagggaaattaactcactcatttgtcaaaatgctcaactgaaaacgataaacttgaattgccagctatatcgaaaagccaaaaacagattattcatgttagctcagcaaccaaacctatgagatacgagatttcaaacattactactaatatttaccacattagctagaaaggcgataatccatcatatttggattgattatgggaatattgaacatctgaataaaaaatgcaggattatgcgatatttggcttttgtccagacctagacaatatgtgtacaaaaaatacacctggttgaatgtgttgctccagccctcaggccctcgtgaggctcatcctgcggcaaacacacttaaattgtttgctagaagtttgttactgacagcaaaatacagagcaagcagagaccagtaggtatttcctacagggctgttttcacactccatacggccaattcatgtgaagatggtagaataaacaagctatgaatcatcaaagcatcgatcctaataccggattaaaatgtacataagtaaatttcttctgtagctgcagctatttgtcctcaatggattaacaagaaggcaaaggtgatactgaccaattatgtgataatgcaatgtatgtctgtggagtgatatgtgcaccaatattcaaccgtatcactcaatgctcagtgtcaggatttttcacgagcaccttatatttataaaactacacacaacctatatggatgcttggtgttgttcacaacagcaagcccacaaggccaaggtctgagtggttgatacggcatcatttggctttttcacatgcacagctaacagctagaccatcaatctgtagcttcagggaacgaatatataagatgtagacacagtgtagaaagcagaaaatcggaaccgtaggataaccttgaagaggaacctgtcagtcttggctgatctatactttgctgtagcacaaaatctacattgcaaaagatatggagaacacaaagatatcattcttctctcagatcaatgtgcaaactaaatttataaacactttatcatatggtatctgaaagaagatgtatgctgccccataagttgatttcaaaatacaagttgatgcttagattatcatcgatagcacgattgtaatataccctgtagctattatattccgtcttgagctgcacctccttcctcggtgcccaggaacatcttcaaaaaagcaccttccaagcccaaaaaccatagcaaactattagaatatcacaaatcccactgaaaataacaggttagacagaaaccaagaacaatcagcttatttcctactccgacaggatgtatgttgtacctgtttggaatcggcctatgacaccttgtgcgtgggtgttccggcaggggcacggaggagatcgtcaaggcggccgtcggtggcgatgcggacgggagagatcggcgcgggcagagcagatcggtgagctaccgtcggtggcgatgcggacgagagagatcagctcgggtagaagggaggatcggagtggggggagaagaagatttgagagagttggacacttgagtgatgaaacggaaactgcagtggtaggagacagctaccgtcttcgtcttcccccccccctccccccgctctccgctgactgttaacacttaacagtcggttaaattatcttttttccctctatttttttaaaaaatactcccgtcgtattaaattttaatgtatgtcgccgtttactttttataaatgtttgacaattcatcttatttaaaatatttatataattatcatttattttattgtgacttatttatcatcaaatgttatttaagcatgacataaatacttctgtatttgcacaaaaaaatttgaataagatgagtggtcaaacgttggtcaagaagtcaacaacgtcatataataaaacatgaagggagtattttatttataaaatgtaccccacactggcttcggtgaaacgaaggagaacggcagaagggaggaccggagggggggagaagaagatttgagagacttggacactggagtgatgaaacggaaactgtggtggtaggagacagctgtcgtcttcgtcttttcccctcaaaggtcccgttcatttctccaacaagagttggatgaagataacgattttcgtggcacgtttttcaaactgttaaacggtgtgtttcgttcgaaaactttcgaaagttgttctaaaaatatcatattaatctatttttcatgtttgtgataattaaaactcaattaatcatacgttaataccacctcattttgttaaaaaacttaatcttcatcttcaccttcatcttcggaagaaaagaacaccacctttttctcaccattttttctcccttctttagctttacttcagtgaccgttaacacttaacagtcggttaacttatctttttttcctccaatttttttaacatactctctccgtattaaattttaatttatggcgtcatttacttttttatcaacgtttgaccatttgtcttatttaaaatatttatgtaattatcatttattttattatgacttgatttatcatcaaatgttctttaagcatgacataaatacttttatatttgcacaaaaatattgaataagatgaatggttaaatgttggtaaaaaaatcaacaacgtcatatattaaaacatgaagggagtagtttctttataaaatgtaccccacactggctccgctgaaatggaggagaacggcagaagggaggattggagcaagggagaagaagatttgagacttggacagtggagtgatgaaacggaaactggagtggtaggagacagttgccatcttcgtcttttccccctcttttctttctctattttttcacccttctttagctttacttcagtgactattaatacttaacagtcggttaacttatctttttttcctcccattttttttaaaaatactccctccgtattaaattttaatttatgacgtcgtttactttttaatcaacgtttgaccattcatattatttaaaatatttatgtaattataatttattttattgtgacttgatttatcatcaaatgttgtttaagcatgacataaatacgtttatatttgcacaaaaaatttgaataagatgaatggctaaacgttggtcaaaaagtcaacaacgttatacattaaagcatgaagggagtagtttctttataaaatgtaccccacattggcttcggtgaaatggaggagaatggcagaagggaggatcggagcggggaagaagaagatttgagagacttagacacttgagtgataaaacgggaactgcagtggtaggagatagatgtcgtcttcggtttttccccctctttctctctctcatttttcactcttctttagcttttcttcagtgacggttaacacttaacagtcggttaacttatctttttttcctccaattttttttttaaaatgctccatccatattaaattttaatgtatgtcgttgtttactttttattaatgtttgaccattcatcttatttaaaatatttatgtaactatcatttattttattgtgacttgatttatcatcaaatgttctttaagcatgacataaattattttgtacttgcgcaagaattttgaataagacgaacggttaaacgttggtgaaaaagtcaataacgtcatacattaaaacgtggagggagtagtttctttataaaatgtaaacaatcggttagcttataatagttggttaacatagagtttatagtacgtgcagcaacacctttataaaacataattaattcatattaagaccggcaacaaggtttttatatgttggataggaatctaggcacacatagtcaaacctaaaagagttgttaaactgcagatctcaaagttaaggatcataaaaaggttaggaaaaataagaaagcggtggccgctagtgctaccgtggtggccggttagggcaagaaattgggggaagaaggaagataggcatggacgctagtgctaccgttaacggtggccggtgaccagcgttaactagttcttggagaggatgtaaagggtgaactgaaggtttgaaagaatcgcctcccgggccacccaatggagcgacacaggagtccaagcaactagtttttgttgtaccgacatgcactaaatttatctattgtatatgttattttgctataaaatattgtgtgaagatgacaataatacaaaactctcggttctatatacccatccaagaagatactatagaacttttgattttgatttatagtgcagccatgacctgccgaaaatatgattgtatgttcaatgaaagccacgtaaccaggtgataacaatccggcccaggtggggttggccgagacccaataacttaaggttgctcggaccccaacagttcataggcacacctactcaggaaaatgcccaatctccctaaaagactagtccaataggggaagggtggctctcccttttaaggtggcttcctcctcccaaggtaagcaaggtgggattattcaaaggctcacacggtcgccgcccgactttagcgtctttgccagtgggtaatagtggaggatgtcctcatcaacagggaatttcgacgttgtatatacgattgtaaagccaaagacaaaaaaaaacctcgctacaagctcaataaacatgttttcctatatgtccgtggttcggaaaatttacttctcgaaataatttttctagactattagaatatgtgtcgaatatactagttctatttggttatagttggacttgaagttgtaataagtggtagggaatagagttagagtcggactctgtaacccgacatctctcttaaatagagagcggggcaccacaatgtaaccatggcaactacaatgtagcgtacacataaggagaggatggtggcaaggccatggactcatagcgactaggtgctatattgattggggatgagcgcccataatcagaaccccggggatgtaggcttcgaatgaacctcgttaacaaatatcgtttattcctgtgtcgtcatctggcatgatttgggtgataaatgactgaagcgatcgggaaggttagtcgtcgttctgctatatcgactaacttttacaacatgtggtatcaaagcagaatgtttcaatattggatcaagaaaacatgtgggggaggaaacacgaggtgaggactgcgcatcgacaggagatcgtcagccgtggcaatgagatcgatggcgacaacgaggactttgtggaggtgacgtcctcgctcgcgatcagaccggcgatggcggaacgtgactggaagacggggcagggagtggccaaaggcgttcggagagatcggagggacggcgcccaatgcacgcggcgatcacagatccgcggaggcagggaggccagtgacggaagggcgaagccggcgagcatgtggcgcagcgcggcagacgtgcagggccgaggacgatgtgatcgtggatggtggacatgagggctgtgactgcagtacgtgcaagggcacgaacaacatatatggagtatgtgctatacacgaactagtgatacacgcgaggagctgaggtatatgttggtattttttaacgacattactaaaaatataattcccagcaatggcgcagaaatattcctagtatattatggttacagagttcatctgcaagcgcacggatataccattgtagcatttcactcgagagtattacaagggtatcgtatttatttaatcccgtgaaaagatcatagtagagagaacctgactaataacttatatgttacttgtgataatccaagggtagattgacacacatgcagggagctactcattctcatactaaaatatctaagctaagtgggaagaaaatagaaagagagtatattcatatacttctagtatacatagtatacatacatcctagttaactgacatactagctaataccctctatctgatgccctcctggtacttcgagaagccacccgtgactgccaagttccttacgacagcccgtcatgaccatacaaccgaggataaatacggaggagtaccctccccaggaaattaacttagaactatatacacgcgtggaggaatacccgtactgagctgtcaccattagcggcccacatctcatccgcagcatataaccccaaataatgatatcccgtaatctagacaccacgcctaaagtaccagatactactctaatatcatcgtcatgacatagagtaattgcataagaaaacactatactcataccaatacatctcccagataagctagcagtataatcagtataacatgaacataatgtaaagttggcattcatatactcggaaagtattccaataccataaatgtataaagaagagtattctaacaaaagtacaaagcttacgaaagaaaagagaagagctactggagccatacccgaactcttccgaaggcttccggactccgatttctactctattcctactccactagcttgagaacactaaactagcttgagagaatatgatagaactttgcttgaggtgtgtgagtgaagtgagaaagtgaagtccttaaataggcaggtatgacggttgtaactgttgcgaaatatctaaagtatcccgcaaccgtcatcaggagaagatctagagcgtccctaccaaaccccacatccaacggtagagaggtgggttcagctaaacccggttcggccgaaccaggggccggcccaaccagcccacaatttggctggtggtctcctggacttctcttccccgcagacttgtaaattttagcctaattggtcgcgtcatttctgagtttttggcccattcatacataagtttgattctcgacatcgtccgattgatttatcgtctggtttgacgatgttgattcttctccacttttatggttattctctgtaaaaggttagtgaaccaaatactagtgaaatattattattctaacatggatacgcattgcaagcataactagttctctattttagtaatatttacggtcgaaactaatattattctaacatggacgtgcgcgccatatgctggaagatcaccaactggtacctgcaaattatgtgcctgaacatgcatgctggtctgttgatgcacataaacgtgcatgtgcatgtgctatgatcagggagggcatctgttcatgcattgagaaggacgtgtccgggtggtgcatatgcatgtgtgggcaacgtttgctcgtatacttgatgagaagccaagcagcatgttcggtacaagacgggggtgtcacgtggagactgaggccgactcggtcctagcctcacaggtcaccggtgcaagaatacggaccgtattccaacagggtcaactatccaaactcgggtactgattggttgaacggtcttaagacctcacggctatggaagcttgaagggcaactgtgcgtcccgacggagaccgatcaagggctaagctaaggtggctcaaggcgaaagtatgcaggcatgggtggccggatagatcaagccgacagggcagagaaacaggtgctggactagttggattgcagagtttggctgatcagaccagttcaacagagtgatggtttcgatcaaacgaggatgggccgaacggttcgatcagatttggctggttagacccaggggcaaagccggtcggattgatacgtggggcgagtagactggtggcaacaggctagtcagatcgcatatgaaattatctggcggaacataatatatctgggactcgatgaaaggttgagatatatggagttggtccagaattgaagaaaaggtcttgggcaacagcgggtgaaaatcgttgagggcgtcaacggcctgtttagcagtacatgatatatctagaatctgcggggtttgcatgatggggatatatgaaaatctacgtcactaaaaaggaagagcgaaggttgtcattgtaattctttaagagattcgaggcaacagtgaacttctcaatttatcatggagctcagtctaaggatgcggaaaaagcgtggatggatttattagctcagttcataaaactaaaagaaagaaagggtttctttatcagtctggtgagtttgatttgtctatttggtgatgacgggggttgtttggctatggattatgtcaagtcaaatttaagatggtagatggagttgaatatggtctttgagaagtctatgatgtgacagctaggaaaggtctaatttcgcttggcaagacggctgtgatgataggagagaatgtgaagcactgttgcaggtggagtccatctaaacaaattgcagggatagcggagtctgttgaaagcggtgggtctggcacagactcgtcgagcggctcatggtgaagctgcgaaaaagaagacaacccaagtctggaggaccggtggatcggcatggtgattctactacttctaggtgacgtatattcgccaaggtagaataggtgtcgaatatactagttctatttggttacggttggacttggagttataataggtggtaggggatggagttagagtcggactctataacccagaatctctcttaaataatgagggggcactacaatgtaatcatggagactacaatgtagcgtagacacgcagggagaggatggtggcaaggccatggactcgtagcggctaggtgctatattgattggggaggagggcccataatcagagctctggggatgtaggctttggctgaaccccgttaacaaatatggtgtgttactgtgtcgtcgtagacatgttttgggtgattaatgactgaagtgatcggaaaggttagtcgccgttccgctatatcgactaacttttatagcatagaccgcgaagattctactctaccaaatgaccttctcacaatcacaaaaatcatcatcagttgcgtcaacacacaacacaagtacacacacaaccgttctgtagccgcaggggagggcaaagcagccgcgacccgcgagcagctgttgcttgagccgaaccaaaaccaaaccggacatgaagcgggccgtctccagcatccgcagccgcgacgtggcccacctcgccgccgccgccaccgccccctcgccagcggcggcggaggcgtgggacgggcggttccggctgcacaagccgcgggggcagcacctgctcaccaacccgcgcgtcctcgacgccatcgtccgccgcgccgcgctgcgcccgggcgacgccgtcctcgaggtcggcccgggcaccggcaacctcaccgtccgcctcctcgagtcccccgccgcccgcgtgtccgccgtcgagatcgatccgcgcatggtcgacgccgtcaccgcccgcgtcgacgccctcggcctcgcgcacaagctcacggttcgtctcgccgtgcccaccatccgctcgatcaaatgcctccaagaaagctaacggggcccctcctctcctttttgccaggtgatcagggcggatgccgtggaggccgagttcccggagttcgacgtgtgcgtggccaacatcccctacgggatctcctcgccgctcatcgcgaagctgctgttcggcccctaccggttccgcgcggcgacgctgctgctgcagaaggagttcgcgcggcggctcgtggccgcgccgggggactcggagtacaaccgcctggcggcgaacgtgcggatggtcgccgacgcgaggctgctcatggacgtgagcaagagggacttcgtgcccatgcccaaggtggactcctccctcgtcgagatccggccgagggcggtcgagcccaacgtcgacctcgccgagtggctggccttcacgcggtcgtgcttcggccagaagaacaagaccctcggcgcgatcttcaagcagaagaggaaggtcttggagctcttcaggagatcccggtgcgcggaggaacgctgcgacggcaatgccaatgccggtggcggcagcagactcatcgcacttggcggtggcgacgacgacggtgacatgagcgacggcgacagcaatgaaggccacgacggagcacccagcttcagtgaggaagaggtcgccgtgttcaaggcgaagatcaccggtgcgttggagtcctgtgagctcgccggcaagaggccctccaagctgtcgaacgacgagctcctgcgtttgctcaagttgctcaatgaacaaggggtacggtttcagtagcacttatatccgatcattgctcgccgtttttctacctcagcgagcagtagagccaagaacaagaagatgaaggttggcatgttgcagctgaggtcaggtctcctgccatccatggcggccggttgccacatcaatacatcatgttcatgtcagccgtcactggcagctcgtcagccacaggacgccagattacttcaagtatgctcgtcaaccggtcgatagatgtgttcggagatgtggagaaaatgcttcaagtctcaagcattacatgcatgcaactgtaaaagcagtgtgctactgagagagacatcttggatgctagaggagcattatccatggtttccacatgattgagcactatttgccaaggtgaagttggcataacatttttatgatgtagcacatgttagtaatatcgccagttttcatcgaaatcaagcaacagttcatggtaatgaccgagcagatcattgcgtatggacagtttataatcagatgctcgattctctgcaattctgcatactttctgtagaaatacctcatccgcgttactagccaaggcacagaaagcatgaccagtgaaatcataggtcataacatacgagtctggcattaaagtttgtttctctattgtttcctttatccgatgcaaccattgtcaatttgtcctatttctagaaaagaaaagaggttgttttcagctgttgtgtactgtgctactatgatattatcatgccaatatgccatcaaaagcttatacactgttacacatttctactaggtgtataaaaagctcttactatcatgttatcaaatacttggtgagtggaaatgctagttagtttaacccacaaaaagataacacttctgcaaaagatggaaatgaaagaaacatgtaaaatcaattgattttcaaaaccctgtagcatccatcatcatcatcacacccctgaggcacatgatgatcaatttacattcgtaggtaggctggtggcattacaatgatccaataaaaagcggacagatggaattagattttaaagctaagctggtatctgaccgacagcagaattccagctgaacattccattggaattgcgaatcaaaattcacaaaagtgaaccaatgagtattacattctattcccagactgaaggcagaagcatcagattcagaaaagcaaaattcttatcattatcatggatcatcatcacagcccacattttcttagttaatacacaccgaaattatacaattttacacgctaaaaatgctagctgcattcaagtaaaacctagccatagaattgtgacaaaaagaggaaaagctaaaaggccaaaaaaaaaagtgataagaaagtttagtcctataccatccacaaactccttatcatcgtggcggcagagacgagaggaggaagaaaggaaggaaagcattcacctcatcatcccgacgacggcgacgaggggaaggcgtccttgacggcggaggcggcggtgaggtagttgagcgtgttgcggagcgtgtcccgctcgcggcgcagcctggcggcggtgtcctcaagctcgaggagcgcctgctgctcccgcggcgcgccctcgaaggtgttgccgacgtagaaggagaaaggggtggggaagaggccccgccgcaggtccccgacgtccttctcgggcttgccgttgaggcggttggcgatgcgtatgacgtcccgcatgagggcctcgacgtcggtggcgagcgcctcggcgtcgtcccccggcgcgggggtctcggcgggcgggcggtcctcgagccactgcacggcggcgacgaggtagggcttggtgcgcacgacccgcgcgacgcggaaccgctcctgccccttgcagatgaggaagaagcggtcgtcggcgaggcgctcgtgcttgacgacctccccgacgcacccgacgtcggcggcgcccccggcgccggacccggcgaacaccaccccgaagcggaggtcggtctggagcacggtgtgcatcatgatgcggtagcggaactcgaagatgtgcagcgcgtgggtcgcgtccgggaacagcacgagcggcagcgggaacagcggcagctccaccagcccgtcgtccgactccgccggctggtacggctccggcgacgacggcgacgaccccgaccccgaccccgacgcgctcgccgcggtggcgaggcgggcccctcgcccgcgtcgggccggggcggaggagtggaggcggggcgccgggcggaatgcgctgttgggggaggcggccgcggcggcgaggcgcggggaggggaggatttgggggaggagcaccattggaggatctctctatcccccgcggcggcgaggcgaggggaggggaatggttgggggggttggattttgcggggtgatttctcaccgggggttttgggggaagaggcgagccatgggaaaacgcgatggatttttttttctgttcgatttcttcttggaaggatggatttttgttctggggcccacgtggaagttggagaattgattgataatgcggtgggggtgatggcgtggaggagtccacgttgggggcttatccacctgtagctgggtgaggctacgagaaagcctagaactggcaaacgggctgtcccgttattgggccgaaagaactagcaaggaaacaagctcactttagatccctcaatttgtcttccaatctggaattggtccccaaagttataaaaccgaatacaacgcttttccaacttacaaaaccagtgcaaatgtccccggttttaactgacgtgacgcctacatggctcctttgactagatcttcgtcccatgtgcaagggcggatccaacgtgggtgcaatggagactcgagtcccccctacacccacaagactcatggatacccccggagcatccccttcgatttttttcaccataaataataagctaaaggtctctagatggttagaggttgaagaaactatgtaattgagccccccctccaattttttgttcctggatccgcccctgccctgtggcaatgacgtggcgcttatgtgacaatttgataaaaaaaataaaagactaaaaagttaaaacaaaatatgtgggacccacataccagtcaaacaaaaagataaaaataatgggacccatatgtcagtgggttcaatttcctccacctcaccctctctacctctatctcctctcttcaccggtgagccgaagccaggcggagagggaggaggtagggaggctggacgcaggtggcgaagagaagggcgacgacgagtgtcaactgatcgggacagagatatggctgggcatgaaaatggtagggcaccgacaacttcttggccctcttactccatcaccaacatcctcgtcacctccatcctcctcctcgccatcccctccacggtaaggtagtagtggcggtgggcagccagcgaggaggagggacgcagcgatccgtggcgaggaaatgggaggcaagggaactggagagatcgagatcgccattcccttcatgtaaggtggcaacaacgaggaggggcccaggagtggtgttggcgacggtgcggtggcagtgttggtgatagtgtgggagtcgaagatggaggagaattgtcgtcgggatggaggagaaccgccaccaccagcgctttgtgacgtcatgcgctgcacgtagcacctactccgcatcaccgacaccctcctcccacgggggcaccaactccctgctcctgccgatgctgacaccctcgtctattcctatattttccccatattaaggacgacaaccaatgggagaagggcggcacacgatgggttccggtggccaatgggagaaaagtcgtgcggcgcgcagcgtcggtgtttagagggctcttgagcatgcggtcgccgccctcgcgctaacgcacggagaaggacacgacatcgcactcctagcaaaggagcccgtgcggcgggacccagcccctgctcccgtgaccctcctcgtcctcgctccccctgcggcggaagaggagccgagcagcgtgtgacggtagcgtcgagcgggaccttgggcgtgcggccataaccctcgcgcatgaagaaggacgcagcggcgcactcccagcaaaggaggagctcgtgcagcgggaccgaaccctgtccccgtggccctcaaccggagggataggactccgcctcggcctcctcctctcccatagcacattgctcctgatatgtggggtccaccatttgttttgttttggctgaattgccttgatatgtgggtcccacgctgactcaaccatcgtatcagccaaaaccgtacattatactaccttgggacctctagtacaccgctttcacaaattaagggacacagtatacctagtattgcacttaggggatgaaatttagacttggcgacacagtgagggacctaaagtgagctttttccgctagcaagcctggtgagtagagcgtagttcaattcacgggctaacggcctgcttggatacgaattccatatatatatatatataaacttcatccccactaaatgtatctaaaaccgaactttggcttgggccttgtaatagactaacccatctcggaactgtcttcctccacctcccacgaatcagctcttaactctaaaaaaacaattgggttttatttagttaaattttgctaagtgtcattcaccttgtctttagttctcgctcgattagtcggtgactatagattcagagcccttaatagtcggtgtgttgatttgctgggttgattagatctaccacttcaattgtaacttttttttatgcttaatcacctattcacaaaatttagattgcatttatcttcttcgtataatgttccctcgattgcattgattgcactgtaaggatcattaaccgtgtgttatttttttatgcttaatcacctattcacaaaatttagattgcatcttatcctgttcgtacattgttccctcgattgcattgcaaggatcattaactgtgcgtcacggttggtacgacattgtttgtggtgtagcgattgcatggcgtcttggatttgttctggttgatagccacgtcgcaagcgtcaaactcgatcaaaacgagagttatgtactcataagaagattaggccatgagagagaacatcatcactatcttaagttagtttgttagattgcgtctattgaattagctgatccataggccaagggacgaagttttgcttgttaatttgctgccagcacctatccacaattataacatgacaaaaagctccataaccaaaattttttatttaaatttacccttacaatcctctgttattactagctacaagtacacacgacgacccaaattaccctcttcctccgaaagaagagaagctttccaggattaacccgcagtagcagcaaaagctatagatgcagcaactgcatctgaaccctgaccccgaccccttcctctgacctccccgattcccaacttaacccatctcaccctaatactaatacaccggatcatggtcgtcgccaagtcgattgccattggatgccaagaacaaatgatggctgtgccgatcgggtctctccctcatcggaggctgttgacgaaggcgaggagcgagtcgacgtcccgcttctccgacgggtacttgatcggcctcgcggtgcggctcgggaagaggaggatggtcgggaagctctgcagctgcagctcctgctgcgcgaacgccttctgctcgccgtcggcgcggaacttgcccaccttcacgccgccgcccgcgccgcccagcctctcggcgagctccaggtaggacgcctccatggcctggcagaaggggcaccacggcgcgtacagcaccaccagccacggctccgcgcggctctccaggcggagcaggttctcgacgccggcgcgggtgaggctcaccacgccgctgctctcgaagatgtccggcgcgccggccgacccgttgccgttggcgccgccggccttgtgcgccgccgccgccgccgccccaccctggtcgtcgatgttccccttgtggaggccgcactccttggccttggcgtcctcccaccaccaccgcccttcccgctcgtgctggccgggaagcacgggcctggtgcacggctcgcacccgatcgagacgtacccctgggcgtgcagggcgttgacggggacatccatggcgcggaggaaggtccacacgtccttgccgtcgacgttggcgacggggttccacttgacgaggctgccggcgccgccagcgaggccctcgaaggaggggtcgacctggacgacggggatggcggcgcgggtgcccggggactggtccttgcgctggccggtgatccaggccctgaggccgcggagcgcgcggcggagcgggcgcaccttgcgggcgcggcagcactcctggtggccgtcctcgtagaaggagaagaggcccttggcgcgcaccagcgcctgcacctcgccggcgtccgggaacatgtactcgatccggatcccgtagtgcttctccaccttgtcgaacagctggtacgtctccgggttcagccgccccgtgtccaggctgaacacgcggaacggacgccccgtcagcttcgcgtactcgatcagcgccacgtcctccgccccgctgcaaaaaaaaaaaaaaacgcgacgagatctcgatcagttttcattttcaaataccaccacactcccagttgtgggtttatatgtttaatatttaaccgattattttttatcatcaatacttttatagttattagatgataaaatatttatagtattttatgcgtgatttattttttaaaatttttataaacttttcaaatatgacggatgattaaatgttgaataccgaaactcacaaatacacataaaatatgaataaggcgaccgatcaaatattaaacacataaatttataactacacttaaaatttgtgcgaatttatgctccatttgattaatcctgcatcagaagttgcctacacggctaggcgacaagttaaaagttgcggtatacaatttgtttggaatctcctaaagggtcaaagcataaattatcgtgtggtagtggagcaaactattctgtctgcttgtgcgtggttggtgggccatgattctagaaacaacgtggcgaaggagatacagtgaacctggacacgggcataatctgatgttttgctcgaaggtgacctatgtccaggttcattgaaccgggcacttataacgggttttgcatttcctttaccatcacccacgaatccaacgtgaccggttttagatttgtagtactcctattttagataggacacgaaatttaatgataaatctaagttggaagcaagaagcaactatcgtatgatacactcactgtcgttcaaatcatattgaacatatttatacatctgcggctgaattttttcgaaacaaaaagttatatactcctactatttatccctaatataataatcctagtcccatgtgatggaaattttcttattttcctaaatcggaaatattagctgatgtatgacaataacactataaaccgaaacgtcgtccaactacctgtcagcaaatgggtcccacttgccagggacaccgtaatgatacaaaatactcctatgaaactaggaatcttcaggaccacccgttggatttcggaagataccgtgatgctgcaggactaacgggattaggcgctcagcaagaaagcgcctagccccagtgcaccgtgagcctaacgggttaacgggcgaaattaacgggtacggatccatccggcaacgagtaatgtagtacctgaaggcgatggcgatgtcggatccgaacatggcgagtgcccgatccatgatctccagcggcgacgcgccctgcagctcctgggccagggcctcgtagtccacggccggagcaggggcgtcgacggcggcggcggcggcgtcctccgccacgggcgcggcggccggcgccgccgccgcggaggcggagacgggctgcctcgccggctccgccgcgcgcagcgggcgcaccgccctcgcgcgctgggccctcgccgccgccgtgcccgccgccggggccgcggccacctgctgcttcacggctccaatcctcgcagctgcacagccaaaaaaaaaaaacggaatacagagaggaatttttataagcaaataattctcgcctcaaatgaggatgaatccccagagaaaacaacgcatttcgctgggagaaatttttgaacgagcaaatcagcagttaattcccgattttttggacgatattggagctcatcagagtaatcctcaagcttgcaaacttcaattccacagtaaacactcaaattcggctaaatttttacgaacggcgagcttggatgcgcgagggagcggagatcgagagcaagaaattctcacctttgaggtcgcggagggcgacggagtgggacgagatggaagcggtagcggaagccatcaccacctccgaatccttcctcttcccttcaaaattccgacaaaatttggaagcaggaaatgtttttttttcttggttttccctcacttctgcgagttttctgtggcgtacgggggctaaagaggagggcgggttacatatagctcgcgcgggaggctgggttcaatgcacctggacggaatcgggagcggcggacgggagggacacgtgtcacggcttcattggctggccgcacggggagggggcgatcgaagcagtggcgtcacgcggagccacaggaagggccgcccagccaagccaggccagccccggtgggggccacgtggcagcgtggagcgctgagctggccgggtgtgtggctgcctcgctccggttgcgaccaagccggccagccacctcacatgccagatgccacgcttggcattggtaatctttggttaaatgataaagggaaatcatgttcgttcgtttcttattaacaatactactgcctctctctgtaccaaataatttcaaataatttaatttatgacatgatgtttctagtttaattaagtttataaacaaatatagtaatatttataatactaaattagtttcatcaaatcaacaattgaatatattttcatagtaaattcgttttgagttaaaaatgttactattttttattataaatttgatcaaatttaaagcagttaaaatttgacaagagtcaaaacgtcttataaactgaaacgaagggagtaatagttaaagctcaattaattatgcgtgtagctttattatttttcatactctaaacttcattatctaagatattttttgggagggtatatggagattggagaataggttatttttgttggaatgttgggttggcaggcagccacgcaggcggaagagtaaagccacctaatacatgctaacggcatgactagtttagaaatgatgtacaaaaacaaatatgccaacgaaagaaaggatgtaagacgccaagaaaataagaaataattatcatttaagttaatggaaagatagcgtgaggtactaggagaagcagcaaaagtgtgatggtaggatgccaagtgtatggctcatctttcgtacaataaaaaggttttattgtgagacacttctaattctgtttagaaataaatatacttaatctctactattataaaaattgaagatgtttttttttagtattttggtacgtcatccgtatatgagtcggtttttaagttcgttcacttttgaaaaatacatatttgtatttgagtcgacttttaagtccattcgcttttagaaatacataacgagtcatataaaaaatcttttaaaaaaaactcccgtgctaacttgagacgaacaaactcctaactgcaactcatgattttttaaaaatatataaatattcaagtgaattctcatagtaaatttttaccttaactaaaccatataacaatataagattaaaatagcctttatgctcacagtaaatttttactttaactaaaccatataacaataataagattaaaatagccttcatcacgagtattttttttctagttattacataaatacgaagatattgatcaatctgggttgcataaataattgccttttaagaaagttgactgattagcatcatggtgaaaatcatggtaacattttattatcccacacaaaactttacctgattggtggacacctaaaaaatatcattttttaccgggcatatttaatattttaaagactaacaatcagttcatactagtaaggacgacggtgtaattaggcattaatcaacttgcatacgtatatctctactctacgcacctagccatggctttacttatctgtttctatttttatctcaaaacgtcaaggtcttctttctcatcacaatatttcctctcttttttatttttcaattcgcgtagacgtctcagtgtcacccacacatacatacactctgacgacactaggagatcactccattgtgtttacatacaagctgacgacactgaagtcactaatcatgttaattacgatcgagtcgcaccggaacattattaattgcatccatcactgtcacggcatgcgttaattaaactttagcaaagatgcgaagattcgttgcagctgggagaagccgaggtggatggagccgtcgcaaactcgcacatcatatatcattgcgagacttttggacctttttggatcgtcaaaatttagcagccatgaaaaaaaaaatccaaaggatagatttcttttgcctgtggatgcagtatgacgcctccttccgatctctcgctgacaggtgggccccaaaagtgacgatttgccaattggtagggacggctctgggtgggatgcgagtgattgtctttgcttgcgttggatggctcttgattggtctccgggggcgtaggtctctttggggtcaaatatggccggtacaactttagtagtactccactagttgtaacttgtggagatccacaagtaattataatttcttttcctttctgggttttctttaagttgttatccctctcaccagttaacaccacttacaagaaaaaaacacttttgtgatgcataaagatgcagacgaaagaaaaagacaaattaagggatcgtagagttaataaaagtgtggcattgctcagcgttcatggtcgttttcttatacggatattgagatggcaacttgagtgcctagttgcaatataagaatctgtttaggttgatgtaattttgaaccatactattttttaaaattaataaacatgtggattcatcattcatttagtttgttcgtaaatataggcattgcttaaagaattttggtaacaatatatttactataatttaccaaaatataacaatgttgtcaacttaccaaaattttggtagggcccctttgaatcaaaggaatgaagaaacggaggaataggaaaaatataggattctgacaggaatgtaagaccccctttgattcaaaggaaattcataggaattttaaaggattctattactataggaatttttcatacaaagccttttgaatcaaaggaatgaaccctatggaatcctatgaaattcctatggaatgcctcttcccatacaagttttggaggaattttaactacaggtagaactcatggaagaaatcctttgagtctttatctctcctcaaattcctgtatttttcctgtggtccaatcaaacggtcattcctatgtttttcctgtgttttgcaatcctctgttttacactttcattcctgtcagaatcctaagtttttcctattctccgtttttttcattcctgtgattcaaaggggccctaagtgtaaaacaga

SEQ ID NO: 75272 - DNA, 6555 bp, Oryza sativa
cccccccccggcgcgcgtccagccccccagatgaacaaacaacagcaaaccaagcgcgacgcgagacggaaatggggcggagagagtagcgcgtaacccgcaagctccacgccaccaccaccctccccgaatccaatccaagccctagcgccaaccgccgccgacgaggacgccaaatccctcgatctcctcctcctcctccgccttccgcccccccaaaaccctagccccggcgggaggaggcggcggcggcggcgggggtgcagatcttaggatgtcggactccgcgtccatggccgccgccatcgaggcgcggttcagcggccgcgacctcatcggccgcggctccttcggcgacgtctacaaagggttggttcgcggatttaccttcctctccctctctctctcgtgtttcacgctcgcggatttcgggacgatgatgtgtgttggggggaggaggtggggaggggcgacggtggcgtcttgtttcgctctcggggcgagcggcattgggcgtttcgagcgttggggtgcttcgagacggtgtagcattctgcatttctccgcatttcatgggggggaatttgggtgtcgcggctagttaggtgccattggttgttcgatcaggatctgcgaggaaaggtatgcggttcgagtgtgtggcagggaaacaaaagaaatgctagtttagtgccttaatgagataaatctgttttaatttctccgtgttagctgagtggcagggttcgtgccatgagttctataccttgattttgtggtttatatctggtgcaaaaagatgtccgcgtagggaatatgctacggcagttccttccacttgaccggaacttgttttttttttccagcctcgtggaaagtttgtattttctggtggtaaaactggtcagaatcttattagtaacgaggaactagactagatagcttaggtatactaatctgtatcatgactatgtgttattatgatccggctgtataatcatccgtttatatgtacacggaaaggaaagtatcacatacatgtaactgggtatggttttttgctatacaaacgttaaaacgactggctggaccgattaattggtcaattaatggttaattatctgattgagctgctcaatcttgtgttaataccaacaaatcttctctagtttgcatgtgcccgtagcttgcagttggcccaattaagttcatgcttgcagatacgttgcttccatgtctagtttgcactttgtttcaggtatatggtgctgcttttgagtttccactttgtatgctagtatgcgatgatagcatgatgtgtagcagacacttgtttatgaattttgcagttgagaaggttgcaaagctaatgtatgatccacatgtctacctactgaaaccatcattagttacatattaaagatgatatttccttatttgatttgtcaccgtacaaatgtatagttcaacccaatgtttttaaatatctccaaaaatgaacaactgggcacatatatatttttatttgtactagataaatacctgtgctttgctataaataaaataaaataaactataattttccctaaaataaatatatattttctatgaaatgtgctacccaactttttgctgagggaatactgacgttaatttgattttatatgtgactatccgtttagatttgatttttctaatattaagaagtccaaggggtattcaagggggtaatttgcaaaatttacaatcggagtagatggggtggcatattcactgccaccaccactcctcttcttttaaaggagtatagatgaatgttaaatttcggtataattccgaataattatctgtattatgactaattgcttagtggtaccttgcccgttggacaccagtattccgacttatacaacactgattattattgtttgagacacagatctccatgatacttatgccaaatatcatatggattatcctgaaaaatttgttattcgcatgatgcttgggctaagataggtatgtggccaagtttatatgctatttaatttaagtacataaatctggtatgggacgaactaaaaaaaaatctctttcctgagttgtaagcatctcaaagtaagaaacttgtgttggtaccacagtgcacacatagagggttacatctgagatgcacttaaatctttatctcttccacatatcagttgataccgggatcaattccatgccttgctgatgtaatttgtttgtgcaatttagcgtggaaagtttcaatcacacaatatacttggaactttagttttctcgtttttatagaaagtactagcttataggatgtttgatttactgacatatttttatagtcgttacataggatttgttgagtacatttctttctgcactcccaattgttgtgttcgaatccaacgatcaggagtgaatgtgatgatgatgctctaactcatgcctcattttgtgcatggcttttttaaagattaaagatttaccttatattttctccatgacctttcttctaatctaacctctttttctgtgacagtaaagttcagttcttactttatgttttcttgtcatttattctataggtttgacaaggaactgcataaggaagttgcaataaaagttatcgatttagaagaagcgtgagtctcttcactgaagttccctctgactccttatttaccatattatatcaggttttatggcatataagccaacatgtttcttgccatttgcaatcatgatatcctttttttattggcttattgcaagaagaaaaggtgtattgtgtactggtgctaatatatttcttgtaccagtaacaaagtggtgtattctgtttgctcttttagatttgcctggttcttttgatatagttttctacactaccagaattttatattagttacttatatgtcctttaattctatgcagtgaggatgacattgaagacatccaaaaggttgttctttcgccttatacgctgtatcaattacaggatatgatgagatcaaattgaatgtggataatttatttcctaattcctaataggattaatttcatgttgcaggagatatctgttttgtcacaatgccgttgtccatatataactgactattatggctcatatcttcatcaaacgaaactgtggatagtaatggaatatatggctggtggttctgtcgctgacctagtatgtgtttattttttatattttatttgacacggcaaaatcttatattatctacatacaagttaataaatcatttcagtttcaagaatcattcaattggttcaaaatttgaagttggtatgatttctgttttcatctgtagctccaaactggccctcctctagatgaattgtctattgcatgcattctgagggacttgttacatgcagttgaatatcttcattcagaaggaaagattcaccgtgacattaaaggtcttgattatttctctccctttccctttttattgctggatttatattgaatatgagcatttaataaagcatttgggtcatcaaactggaaaaattggggccatgtaacatgtcctgaagaactctacagtctatacctccctttgtacagcatttgttatcatactggtatattctgactgcagtacctcaacccctggttggttgtgctgtgttcctaataactacgggccagataaccctcatatctactgtcctgtccaccaagtacaatatccacaaaaccattataaaggaggctttctggacagggctaacactcctttctttgagaactaatgcgttaataccaattgcacatttatctttattgtcagaactcaaaagatgttgataaaggtcaattatatcatgttactagtattatactattattcttgatttatcccatctttaagttggatggtttagtaggatgtggttcaagaggcgacacctctttctcaccccatccactattgttacgttgcatacttacacctattattttctatcaagataaatcgtcactcactgtttttttattaaagtgaagtttctttttcactaacttgggaatcctcagatacacagaacaattagatatttgctgttgtttaattaaaatctggcagattaagatgtaagggctggtgaaaaccttcatttgccattgcattagtattggcgctagatgaattgaaaagtttagtgttgctggtggatatggagggagaacaaaaccccagcaaaccttgcataatcttaaacataagattgagttctggaaagtctgcaatgcctttccacacttccacaggtacaatgatgtggaagatcactgtcaaatagggtcaaataggtctaccattagagtctgtatgaaaagataatggagagttagcaggcagttgtatgggttgcacatttaaattgttcttcactacacagaagtaacataccaatacatttgatgctagtattttcatagcatttgattgaacataaacgaatgaccccactattgtgtgactactgattagtcctgatatattgatgatctttgactcatttattttctttcctattttactaatgtgaacctgtgaagtataccacacattctaatatacacattctgtgatattttgcagcggcaaatatcctcctgactgaaagtggagatgtgaaggtataacctttctacgatttctcaatgattttatgttccattgtcaggatggtcctgagttctgttattaattcttagcttacaatatctatgcaaacgtttatatttttattccataggttgcagactttggtgtttctgcgcagctgactaaaacaatgtcaaggagaaaggtgcgatcttaaccatgattcttcaatgtcaagttactcgatattgctgtatatgtgcaccaggaacctagtgactcatctacaatcatattttggctatatgcatacgttacttgtactcaaatggaaaacttttggagggtgataaatctaatcaagcatatcacaagattattatttatgctttagcgcaattcaaaatttgaattatacagccataagcacttatcagtattaattaagatggaagctccctgttctgctagtatcattcggtagtgtttttagctcaaggacaaacctttgcttttggaaggtaatattgctaatggcttttaattttgaattgtgtagacatttgttggaactcccttttggatggcacctgaggttattcaaaactctgacgggtacaatgaaaaggtagctgtgcgtttttctttaaacagtttgctgcttactgaactttttacccaagtctgtgtcctgatgcaggcagatatctggtcgttaggtataactgctattgaaatggcaaaaggtgaaccccctttggcagatatccatcccatgagagttcttttcatgatacctcgtgaaaatcctcctcaggtcacttggttaatcttcaatccctgttctttaatgcttaattgcaatatacgcaaagcatttgctttgatccactagaatatagtatattaatttttaaaaaatgcagcttgatgagcatttctctaaaccgatgaaggagtttgtgtcactatgtttaaagaagaatccagcagaggtaatattcttctttcatgcttctacctgttccattaatcacgtcatttgctcttgtttcccaaagatattcatgaaaacaagaatgttgatgccaactgtttcctgatttgccttaccgttgctgcctttgctccactccattgcatcttctgcccatagtcaagtcgtgctccctgactgactttaggactagtcgtaggacttgattacagtgaaacatacacagtatcgatgttttccttttgatactaaattaaatttggacttccacctgtcatagttgagatcatgatttgtgactagaaggggaacagaaataaaatcttatgatatgttgtacagaatgagtatcagggacagtacaacagctttctggatatttaacatgctattgtggacaaaacatcatatgcccgtttttccaacaaatttggcatattgtaatgttgggggaaattttaatgctttatgctttttttatcaatcgcatttgataattattgatgtctaacctgcaaaaaattgtgttttaagtccttgcccttaacgccttccctttataactttctcacagaggctaagtgccaaggatcttcttaagcaccgctttgtaagaaatgctagaaaatctccaaagcttctggatagaataaggtatgtggtatagtacttctgttcataacagagagaagagttaaaagcagtcttttgctgataattgagacatctcaacacctatctgattcccttgttcctcaattgctgttattggcagagagcgaccgaagtttccagtaaaaagcagtgcggatgccacacaaaatggtcgaacacatgttgaagaagatgatggtactggtactatcaaggttgagagggctacaagggatg

SEQ ID NO: 75273 - DNA, 40948 bp, Oryza sativa
ctgaattttgtgatgatgaaaatcaccatggtgtacatgttcactgctagcattgtgtggtttgtattaatgctacaaaatgccttgctgctcatgaactgcttgacaaaatgcctctcaatgttctatctaaaattctgagcatgttaatatgtgtctccccgtaagtttagatggtcataatttgtgctggttaaatatcctaaaagagttcttaaaaactgatatttgatcaaatattttagtgattctatcgtgcatattaattccctgtagaaatattatatacatattagtagagtagattatggagagttgctaaaaattgatcgccaaccgtttgaagctcactttgaagatctactgcgaaagatggcttcatgttaccagaagacaaggcaaggcatcaccacgtaacagaaagaagagtagagaaaaagaatgatatcaaccgccatttcggctgtgtttagtttctaaaattgatgagaagtttggagaaagttggtagtttggaaaaaaagttaggagttcatgtgtgtagaaaaattttggataacactaacgatgtccagcttcttctcattatgacagcaggagggaacacagatgctttttgtgtatttagtcaataactcagcttactggatgcttatattttatattctgcaatgtaaagagtagatagcatacttgagaatcattggtcgtcactgcattataattgtacatcatatatcctaggaaatattggatcaattgcaaggacatgtgtgcagcgtgagcagttggtgtgcatcttatcggggttaaggttagtgtttattgaaaaatacattgaattatgtttcttccttttctttgttatgttattcatctggtactacatgtgaacggcaaatttactttgtaagcattttcagccattgggtttaaaggtagacaacacaaagctctgtgtgctgtattgggttattgggcatatcctatggttttatgccagatatgccaaatttccctcttctgtgcattaatatagttaccaaatatgcatgaattttgaaccactgtttttttctctacatcaggatggagaaaaatggttatataagcaactaagcaatgtatttttggtagtgaagtgtacataatggatacagcatcacttgttatcctgatatatttatttaagatggttttcttgcatgtttggtagtgcaaatggacaccatcaaattgccaatttgccatgatcttggtgcgtgtatggaatcaagtagaatggtagtctcctgcaattgctccacgatgactgaatccacgcggaaggctgtccatttttggcagttcagacttagagagaggttagcattggcctattctttggataggtttaggtcatttatgtgttgagtaaaatttggctaagaagctacggcatatctgttttacgaatggaaaaaatgtagctattttttcatgtgtccttgttgcttgattggtcaggcaagttgccaagttattgctccgtattgcaaattcatcttggtaccatattaactttgacaatctgctttttttggtgtatcaataaatcaagtaaataatgatgcaatgaactcttctgatggacaagcaacagaaaatttacttgataactatattgtttggacgtatgttctggccaataatcttgattccttcttatatcagtccatccttatccttgacgccttatcagtacactgtaatgctcatactgattgtgctggctgagacctaggcgggggccaaggccttcatttaggtcagtacacaccgcctcaggaggtttattccttgtccggtacatatggttgggatgttggatccatttcatttatttctgcaggatgagattgtgaacaatggattatctgttattaggcttgggatgctggtctgatgcaaattactgtagattattcaagtcaaagttactatagtttttttttactgttggagttctgtttcagtgccaaatattcgctgagcatgatgttgtgttgcagtggtgccctaattgcgatttcaatgggatgttctagacagatgtgtggagtggggtggaggagaagcgtagtcgatgatggtgaaacacagcgtgtttgaggaacaaggtgatcgacttgaagggcgttgccagcaaccaggctgcttctttgaacaccttggttaggtaatatattcaagctatgttagatggaaattacttttatggaaataggtgcatttgtgatagcccatatattatttctttatagttattagtgcaattacaattatttagcatgcaagctaatagtacttctaatgaggctacaaatgcatatcatacttatatatgtttgtccataacgtgttgtttagaacagcttaaacaaaccaagcaggaataatttttatttatgtttcctgatcaattaggaagtatatttacaaacgatggcatatgggataagaggatttcctttctttttgtgctatgaatcccatcaaatttctgctatttttagttcacgcaggagaagcaggagaagagtatacaccgtgcttttgctctcagtattgcgaaccagctcacaaatatattccgtgaccgagagaagtgccaatacaatagttttaggaagttgtgttcgatgatcagttctgagcaactgagccccttgtagagttgtccccattgcagtggataaaattaccaagtgcctaacacacattccatcagaagtacaacttgggttttgaaagacaaaaaaattgctatgtaattaacaatgtataaaaattctatattgttctttttttcaatcaatcttgagtatatatctcattctcaaacatatatctttttctattatttgatttgaattatcaaatactgtcgtagcgttagcacatgcatattactttgctatgtaattaacaatgtataaaaattctatattgttccttttttcaatcaaacttgagtatatatctcattctcaaacatatatcgttttctattatttgatttgaattatctaatactgccgtagcgttagcacgtgtatgttactagtatttaaggatggagaaagtacttgttctttgtaacatatggattttgtagtatttttgtgttttaaagagatctatttaaacggaaacaatttgcattgagcattcgacgcgagacgaaacatcgggcggttacgccatgtgggcccgcatcgatttaaccataacggctcgaccttttcatcttccttaatcctaattattctcacattttctcttaccttcctagctattgaacaggttcatcgggatattggcagaaccgccgttgctggtggccacgactgcaacaatggtagcagggtgttcttgatctggtcagacgctagcttccggaaccacacgattgagcacgtattgtcgagggtggcagcgatgaggttgacatttgtaggggaggtggagctggcaccagaacctaccttaggagcactcctcccgatgctagtggctgtcgcccttccactcctcctgtagtcgccaagctgtcgcatccggttctacgccaccttcatccgcatgtcctccttcctcatctccggcaagtcaacaataatctcgtgcgcgtagctagccagcatcgtcggtctgattcgagagttacattttgttttgattcaatgttctgatttgagtgtttcattttgttttgttttcatgtttcatccattgatttcttggtgttgcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgtgctgcgacgcgagatgtatgtatgcatcctccaaagtcttttttcgcggcatgcaatcctgaaaagtaatacctctgtctcacaataaatattcgtgcccaacatttgaccgtccgtcttattagaaaattttgtgaaaaatttgaaaatatttagttacacataaagtactattcatattttatcatctaatagcaataaaaataataattattaaaaaattttaaataagatgaacaatcaaatattaaacgtgaatatataaaactatatttattttgggacggatggagtagtctgttggctcgcgccttgatggcatggcatctttttctctcttgtgctgatgctgaccaagacggcacatgtgctgatgtgcctgcgtgcagtagtttctttggctggctgctggttttggctacatcaggccgtgtaatggcacatcatgcacacgcacgaatctgatggatacagagccgctagtccaagcagtactgctaatagcgggcctatctcccgtgctttcgtagctcctccctcctactactactgtgtaggagtagtgtgtggatggataggatacggatcgatggcactgtgcctgtctgttctgcacgacggaggacaagttgtgggttgcgtttccgcgtcatactccgtctctgccaaaataaatgtagtttttcatatcttacgttttcgtttgaccgtttattttatttgcaatttttttacgattaatatttttattgttatttgatgataaaatataaatagcactttatatgtgactaatttattttaattttctcataaaatttttaaataagacggatggtcaaacgttggatacggattcccataactgcacttattttgaaacagagatagtacgtacctagctagagtaagggcagttaggccttgcagtgagcggacattggttttggttcgttgtcataccggagctaggtcaatttatcatacccattcccccgcgaggctcctcatgccttagcaacaagctaagatagaggcacggtttgcgagccgtgttgggcgaggccatgtctctgtgacatggtctcgcccttcttattatgaagcttataatgatgtcagcttaattcgtcagatctaaaatgatggcgcaatggatgaaatcaggaaaaacggaacatgtatggtggagaagaaagatggacctaccaccacggatatcaccacatgaatgcaaaggagaaagaagatggatctaccaccacaggacactccacaacctccttctccctcctcacccctacccccaccagccggaaaagaagaaatataaaatgtcaggggctgacatgaaaaattaaagctaccacttaaaaccaatttgtcttatattcgctcaataaaaaaaccatttctaggatggagggtttttttaagacggagggagtagaagagatatggtactaacctacgtggtgcacactctcttctcagtggccactcataggagtagcctcgtgtagttatctctagagagatggtatagattgctcccatagtgcaaatatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttggccaccctagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactcctcttaggccatacacagtaaacgctctaatgtttacaggatgtctggatctaagattttctaatttttagagatttttttattttactttcaatgaaaacatcacctatctcatcgtgcacttattcgttcatcggctacatccaaaatttaggttttaaaaattaattttaagctaatttgaagctttctattacaatctatttttcatacttgacttttgaaccgtgaatactatcgatatggaagtcttacatataaattatttttattgcttagttggttttacaaaccgtagtctaatcaaggactcctttaatcaatcatcatagccgaattcgttggttgaagttttcccaatcatccttttatggaacgtttctttttctaaaaattctcacggctccaaatagaggtccttgtagaaaattgaatgtgttgttgcttgttgttggactgggatactatagagctcaaagcctcaaattacgtgcaagacgacgttcctactcctgcgtaccgctcgatgttggttggcctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgctgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaactctagttcactacgaccatgaaaccccttttacactattaacctttttctttttttttgcaccattggattatagagatatgtggacatttttcaaataactgcccgcctatcaatgtattttttgttttggtccaagggctcgtcttcttctctctgtatcatccctctctcgtactgagtaaaaaaaacactcatgcttaacattaggagtatttacttatcacttaaaaccaagagtaaagtttttactctctgtggattttgagagtaaaaatattacaaacggttgaatcttatcagtaaaaaattacaagtggttaaatttaagagtaaacaaaatacacacaaaaaaaagtaggtggcagcaaggtcacaacttggcgaggtagctgcggcacatccacctgcgatctcgatgacagtttggtaagggataaccgagaagacaatgctaagaggtactgtggcgttgcgactagcgggagctagcttccgagccaacttcggtggcacatgggcgagtggatctggggtggcgcagcatgcgacgaggagcaggacaggtggggtgaggaccaggagctctcaattcagtgtccgggatgatgaggtggccgctgcttgcacatcttgccggtcaccggcgctgcattggtcattgctgctgccaccgctcgcatgcctcgctagtggccctaattccttgtgttgcctctcgcatgccttgctgttgtctcggtggcgaaaggaggtgggagagcgagagatgcagcgtgagagggagaatgggtgccagggactaaatgcaaaaaatggtgagaaaggaggatgtcatctggtgcacatatgttagatctaacggtgaagatgggggttgcgtgtttccacccaaatgagaggttgcatctgaaactttccgcaattacaatggatgccaagtataattttgttttggttagtttagttggtaacatataacatatgaagaaatcacaaatcccagtcattgggagtggaggatgcgcggccagtgcccatataccaccatcaccgtcatcacggttgcatttgctgtggacgttggtggcagccggtacggagctgtgctggtgggtcgatggtgggctacaaaggtagagtacgtgcgagcggcggtgcggctaagcattgagccctacagtttgcggacgtccgcgcagcggtgcagtacctgcctctgcggctctacctagggtgcgggaattgtgtattactttgcatcattcgaccatttcggtaaactgatatagactatcaactgtcctattacctctgttttatagtgttttatatcataagccgctttgatttttttcatagtcaaacttttaagtttgacttagtttattaaaaaaaatatagcaatactttcaatgcaaaacaagcatattatcaaaatatatttaatattgtgtttaataagatatacatgttactaaattttttatatgaacttgtttaaatttaaataaattcaattagaaaaaaattcaactgcgacaatatgaaacagagggagttcagttactgcgagtcgataaccaaacttttttggtctcggtcatttccacgttttggtgtgagtttgtttggttcggttatttttagccagccctatatgtatagagcaatagttaatgaacgcatgcacgtattaaccacaccctaacgttggaaatattaataggcctgatgcatgacaaattgcatgcgcgcacctgtgccggggtcgttgcacgtattctcgcgatcattgccgaacagtcaatgtcaattatatcgacggccggtttgcgttagcgtttgcttaactagtgtactagtactaaatagaagtattgtactactagtatatgtagcgtattcatcgtgaggtaatgatatgatgtcgatcgatcgatcgatctaccgacctgttgatcatcagtgactgaatttaaagctgctttttatttgaaaaccattgctatcttccgtccaagttacgtatgtaccactgccgagcagttattttgcttttttctaagaaaaataaaaaataatatgattttttattgttttagtttctagtaatatgtaaaatttactagctcttctacgtcgtattaaagttgctagtcacattcatagtatgaaaaatttctaaccatgccgatatcattttcaataataaaaagtactttttagaaatttacaaaaatcaccctataagctagaagtttgatgtttcaccccataaattattttgttgaaaatgcctgcccacctacttagttttgtatcaaaaccacctcggtatgcacgtgtttaaccgaatcaacgtgttttcataaattatgagccatcaatgtagtctttaccaaatttaaatacttcaataatatggtcttaatactttttagagattccataaataatgagagcttaaatattgttgaaccaagtttcacaatatgcataaaatagtttaataaaacatgaagaataaatataatgtaagtacttggataagattgactcgattagcatggcgtgtggtatatctatatcaacgataataggctgatttggttaagtacgtgcgtcctaacatgacttttacaccaaaacttagtaaaggtgtgtatttgtaacaaaaataacctatgggatggtttctgtaattttctcttttttctcgaccgttttcatccctgaatacacaggatacagacgatgaaaaatattacgccatcgatcgatctcctgtgtcctgtccaattaaaactcgcgggaagccggcccaatacaggtgttggcagactggcagcacgcggcccacgtacccttcatgcatgaacggaacggctcccacttttgagtcttttgatccaccacaattttaagcacaatatgtcaataaggttgggttcttccttccattttcccaacccacctctctccattttcacgcgcacacttttcaaactggtaaaaagtatgatttatacaaaaactttgtatatgaaagttgttttaaaaaacatattaatctattttttttaaaaaaatagttaatacttaattaatcatgaaataatacgagcttcgttttacgtgccgggggagaaggagttcccaacccatcctcccgaacacaaccttagtccacttgctatacctcaacctcgattctacgtcgagtttgtttgaagccccttatctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaaacgtaaagttgagggacggcaaatggacttttttccattttaagcagcggcggtagggttggtaggtaggaagatccggcgccatgtacaaacgtcgccgtcggtcggtatcgttttccatcttcgacgtacacgttgatgttactaatacgtagtactggtaccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatatatatatatatatatatatatatatatatatatatatatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgataagcttcacgatctcctcctctacttcgcccacacctccagcgacagcagcggcgacaatggtggcggcagcttcctccactcccgacgtgccatcctgaacggccagccgtcatcgtcgcctctttgctggtggtagtcagagagagggagagagagagagagtgaaggggaagagataaaggagaggataagactgaatatgtggttggcgagcgagaggatatttacagtagtagttatcccgtacactgtcccatagtttttctgaaaggcatttgattacttattggttgcatgttcattagtttttctttaggaaactacggcgggtttgaacaccagcctgaactttattcatatggtaaataaactttacaaaggggggaggtacagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttacaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcggcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccatagggggtcggggcgccccagccctcggggccgaaacgggagcggcccgacccctcgggaagacagagggaggggcggccacatcaccctcgggcccgacccccccgagggggtcaggccacgtgggtgactgcagctgctccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataatgagcggcttccttcaagaccactacattacttaagtagcgcgcgaaccgggacgagccggttcgtttcgtctggagatgtgatgacggtgcatcggtcggcgagcgtagttaacgcgcgcacgattagtcccatctcaactgccacggccgcacatccgcctcgtgcgccgcaaacgggcgagcgggattagtggaggcgcgggcgcgagagacgagggggcgaggtagtgggcgcggggatcgaggagccgggcatagcgttggcaagggtactaagacatcaaggaagggacttgtttccttcctctcgtcactcttccctttgcctttgccacttgtgctctgactctccatttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtaggacgactggaagagcgactggttctacacccctctcgccgacgaagcgcgcctccgacttccgagccagcccccggcgcaggcctccagctggcgggcgccggtagatctgggagatggctacgacgccgttcttgaccgcctggcgggtctgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggatttcaagatggtggtccaacgggtgctgaatctcagctccgtggaggcatccctcatcccccaaggtgtcctctccctctgcagcgatccagagcgcgccaacatcctgaccatcatgcaagcggtcggggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatgggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgatctctcgaggaggcagaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcacagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccagggggggcctcgcccagcgcctctcagagatggccgggactctccagcggctccccgaggagctcgaggagacgatcaagtcatcctcgagagacctcgcccggggggtagtggagcttgtactggcaagctaccaggccagggacccggacttctccccgtgggcagcactggacgagttccctcccggaaccgaggacgacgcgcgcgcgtaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatgcacgtgtcgagactagccaggccgggagcgtggtgactgagggttatggggacccgattgtgggcctttgccgattcccccccggagttcaccactccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaaacgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtctgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggtggcggatccccagtccagccaccactctgagtcccgcaaggagtccctcgtactctgccatattgttggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcagcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcagcgtaaagcatcttctgggcctgagggtattgggtcttggcgtcccggagggcctcactaacaaagtagacgggccgctgcaccttttgtcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctctttgtccgagaggccgcgcggggcgcactcggcttctgtgccgacgacctcggggtcagagggcgacaggcgcggccttcccgcagtggccttggggccatcctggggtcgggggcgcctggcaccgtcggacaagcgggcagagggccagttccggtcgttgggggcctcgggccaccgttcggctcgggggcctctcctccctgctctctcccgggtcgagtcgacacagggtggggatgcgcggagcgagggtcgtcctcgtcgcgctccacgaccaacgctgcgctgaccacctgcggagttgccgccaggtagagtagcaacggctcatctggctccgggacgaccaggactgggggagaactgaggtacgccttcaactgagtgagggcccattcagcctcctccgtccagataaacggcccagagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgtgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggtctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcaccacccgcgggcttggatgccgcggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggggaaaccaccatcgcgatctgtcctccccgggcaacgcacggtgggtggtcggtttggtcgaaggtgagggcaacctccgaccaccgcgcccgccgcgtcgcctcatgggtaggggccacggccagaagctctcgcttcatggccttgaggctccggcgagaagcgtgagcacgcgctcccccatcaacggtggcgacagtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctaggagcgccggcctccttctttttgtcgctcgcaggcctcccctttcgggtggcccgcaaagcgccctcgacggcgaggacgtgaccctcgtcgtcggaatgggccgacctcttcttcctcctcctgtcccgtcgccctgaccgagcggcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacttgggcgcggatatgtgccttggaagttcatggtgaactgctggcacaaatcctcccaagagtggaccgacgcgggtggcaagttcattaacccaccccgcgcctgtcctttcagggccatggggaagaaattcgccatgaccctgtcctcacccccgggcggcctgatcccaatcgtgttgatctggaaaaactccgcggggttgacgcttccgtcctatttttcggtgatggtgggccggaacttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagagggacagtggagtacgagctcgacggcgcgggttctgctccccgtcttcaccgctagcgctcggagagagattgtgcgccactgcccgttcggccattgggctgagcgggagaagcttggcgcacacgaaagaggacgagggcttagaaaaacacacgcaccccctacctggcgcgccagatgacggagcgtggggctcctcactgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttccctttctttggtgggcaaggtcctccttttatatctcaagggatactacatgcaccacttctacctacctttcttctgggtggggacctaccctctcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcggcatgctacatgtctgcccttcttcatacaatgacttccttgcaatggttgcgatgaagcctggaatgtatctggccggggctgacatgccaactctaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcctgacccccccgagggggtcaggccacgtgggtgactgcagctgccccaaacctctagtcaagatacccccggtcccatgtcaccgacagatgcgaaagggcctttagcctaatggttacaagaaccacagtggtacctgaggtcctgggttcgactccccataggagcgaattttccaggatttaatggcgtttgtgctttcagtggtaggcgacgtacccgtcgacagcgaggcgcctgtggtgacttcgtcaatctctccagaatttgccgacccagtcttcaaagatgctcataggggtagggtggccagcgaggcgcctgtgggggtagggtttgcatgcttgagttcatagggtacgtcgccagaatttgccgacccagtcttcaaagatgctcataggggtagggtggccagcgaggcgcctgtgggggtagggtttgcatgcttgagttcatagggtacgtcgccagcgaggcgcctgtggtgacttcgtcaatctctccagaatttgccgacccagtcttcgaagatgctcataagggtagggtttatgtgcgtgtgttcataggggtgagtgcgcgtgcgttgtgagtgtttgcgttgtactgtgtaatttaaaaaaaataggtcttagatttttggatgaaaggagtataaaagtagagaataaatatattgaagtataaaatggaaaaaaactatattgagatttgataaaatggaaatattctattatctttttatgctgcattaatatgtgtcatgtgtgatattgaataacgaacttactttaatacggaggagtattttccttgaaccgggatgatgaaatcattgaaaacgcggaggcaagaggacgtgcaacacgtgggatagcgccgacgtcggcgatctgttctaccttctggaaaacaagtctgcaaaaattaatttctgcctgaggcagtgaggctcgcttgtcagtcacccgtatacgtggaaaataaattttctctcgctttctcacgcgggtcgcgaggaactctctctctctctctgtgcacaccccgggaggaggaaccgagggaggaggacaagtcagagcaaggggcctcgacggcggcgaagccctccaactcacaggtgagagaccccccccccctcgcctcctcctcttctctccggcgacagcgacggcgacgagcgagtccgtgtagatctccgaccccgtagatgggttttgggaggggggcggtttaatcggcggcgcggatggcgtccgtaggactccgtaccccgccggggaatccttaggttgctcctctattgctcttggagtacacgccgcagccgctacccgtaggccttagcccgatggacatccatggttgggtggatctgaatggagacggattggagagagcaagtaggatggaagtaatggttatgatgtctagctgatgaatgtactttatacttaactaatagtactaatacgcaaagctttgttacaggaagcccaagattttccccgtgaattcctgtttttctccattgctccatccaaattttgcctattcctatgtctttcaaatgtttgcgataggaggcctcaaagggtctagttagtgtataacactgtactctgtaccgcgaagtagtgcctcaggctgtgaaatgtctgctgttcctttgtcaattgtttggatccctttgaacaatggaaagcatacaatttcatggaaggttattaattacatttccctgttaggttagttctgttatgccatttcagtactaatgaacaaacagtttgtccacctacgtgtcatcacttggcttgatagtgctgcaaccaacctatgtttatgtagaaagctgaggcatatttggattccctttcgtaggtaaaatctgctaaatattgtttgagttttctggcatctgcttcagatatccattcgctaatgactaaccaatttaatcacagaaacaccaatatctaaagcagcttaaattttgaaaccaaaatgcaagttgtattaaaacaattccatgaaaatcttgattatggtaatacatactttctaatttcattttgttggtgcttttgttttcttatgtgacctgtttttgaccaattgttatctcaaaatatatgttccttcctcctggtgaataaacttgaatatatctatctacaggcgccatgtcgatgtcactgttccctgggatggatcttacgaaaatggatgctcctactcttaccctccttggagcagcctgctgtgtaatgctatcgatgcattttacagtacagttggtgtcgcagcatcttttctattggaagaatcccaaggagcagaaggctatacttattatcgttctcatggctcccttatatgctataaattcctttgttggtcttctggatatcaagggaagcaaaacatttttcactttcttggatgctgtcaaagaatgctacgaggcactggtgagtccttttgggttaaccacattcttgcacccaatgccgagattcactaaccttctctctttgtttcactatgtaggctattgctaagtttatggcactgatgtacagctatttgaatatatctattagtaagaacatagttcctgatgagatcaaagggagggtgcttcatcattccttccctgtttcccttttcctggtaatttccttaatccttataccctggttcattctttaaatgtttctataatctgtaattgtgcttgagtgctaagatttctgtttgattacttctttacatagcactatatattgattaagttttgatgacttagcataataccttccctgcttctcttttactggcattttatcccataccatggatcacctttttgtacttgaattttaaatttctatttcattgcttccttatatagcattgtctggaatctggattaattaaaccaagttaccatgagtggtaattttttactataatatcaacagcagttttaatctttctcttaccaaattctcctgtatgcatgcacctaaagcgatgacttaaaaatctgtctgtgcatcacccttctacatttttattattcacctacaatctgcagaggtagtctggagctttcagcacttcagtttatagtttgagtcgatgttgtcctaagaacctgtctttgcatctcccattctcccttttagtgttctatcttgcacatataatctgcacaatctggaagtttattctttcagaacttaagtttgtagttagactttagggtgttctattacttgcttcacttctatctgttcaaaaaggaattaatatatttgtgatgttttgctatggcagccccgcaatgttcgattggagcataaaacactgaagcttctgaagtactggacctggcaatttgttgttgttaggcccatatgcgccattctaatgattactcttcagcttcttggtctgtaccccagttgggtcagctggacattcacaatcatactgaacttttcagtctccatggcattatacgcactggttattttctaccacttgtttgcaaaagagctggcacctcacaaacctcttgcaaaattcttatgcatcaaagggattgtcttcttctctttctggcaggtaatcatctacttttccctaaggaaaatgaaagccgtttcacaatttttcttactttatggaccaaataggttacttcttctttcttgtgtctgaatgctttagtgtaactttggacactgtttaccatgatgcatgcctctgaatgtttgattgaacaatgtcgatgtagactttctaaatagtttagatcttctgttccttctgggtactgtggtgtgacttctcatgacagtcatgaagcttcatcatatttattctctggatttaattaggtgctcaagatacaccaccatttctttttgtacatatagttgtttatgaattgaaaaagttcttctgcaacttaagtttttatgaactgccatttgaaagtcagatttggcaatttcctttatgaagtctcataactgaacaactatatgccttgttaccaattagtttagaaagaaagccagagtaagttgttaaacaagtttaattagataataaatcaatactgagcttttcacctttaaggcacaataagctgctatatcatactgcttaaagagacatccccagtggacaccttctaaagagtgcatgtcttcctcttttgccatgggaaacataaaagctggaatagtttttaatagttctcccattctgttcatttcttatgattagtgattgagctactgaatgccattgtctttttgcagggttttgcattagaggttttagctgccgtagggatcattcagtcccaccatttctggttggacgtggagcacatccaggaggcaatccagaatgtcttggtgatcatcgaaatggtcttcttctccgttctccaacaatatgcttaccatgttgctccatacagcggggctgacagggcgaaattcgagaagaagaatgaatgatccaggttttgtactgagtaataccctccagctcttgtatgatatctctctgtatggactcacagtgttataaactcagtgtttcttatgcacacgagtagagtaagtacattacaatcattagaaagctagaggtgcctgaataagtggtggtttcgtcttgttgtacacaatatcatgttggactgaggatcttgtgtgtacactgtacagtgcagcctttggaggcaagcaaatccattatcaataaagctatgtacttccaagtgccaatcaccaactgtagagccctccctcccccaatgcattgagttggtgaatgcaaagttattcagggacatcattaatccggttaactggatacaccgtatttaactagcccggtctggactctggaccacggtcgtgggtaacttttattgttctttcaatttttccatgtgaaaatttgttccagatagtcattgcctctggtcacaagttgtgactctgcaacaatgtcgatcgagaacatgtgttaccctctctttctgcttctgcctctttcaccagctgggcacggtgaaacaagggcgttgcatccagcatcgccgtggcaggattcttgacgcgagagcagtttgtctgcagcgatttgctccgtcgtatcagcggcgacgagaagaaaaggagaaaaagagtgggggaggaaagagatgagtactccagacgtccagtctgtctgcagtgctgtgtgcagtgtagggtaggttgcctgaaatcagaggcgaagtggggcacgggcactagtagcagcagctgtgcactcctaggccgggcctgtagctgctgtgttgtgtgcgtaagcggtgggggccatatgtgcaactcctgtagattcctagtacggcctggcttgccttcccgtgacctatttttgcatcgctttaagctcggccgacttttaaccagggtcagaactcagaactcagaagtgtctcctcttgccttgtcctcctcctagctagcggctgataatagtgtcacacacatcttggtgtcaacttataaataatgatatgccttctgtttataaaacattactagcactgaagaccgaacggatgagtaaattttattttaggctatgtatttttataaattgttacaaggggtttctgttagcacgtccggtttatctctatccacatcaataatgccgactttagtttcaatccttttctttaaacttctaactttttcatcacatcaaaattggaggtttggttgaaattgaaacgatatgacaaaaaagttagagtttgtgtgtgtaggaaagttttgatgtgattaaaaagttgaaagtttgtgtgtagggccgagtttagatccacagaaacttccaacttttcccatcacatcgttctaatttcaaccaaacttctaattttagcgggctagtatgtttcattatcggcgggaacatggatagccgagaaagcttatcagccagcaacggtggtggcgctttgtttaaggctacggtaagaaatgcattctgatgtaacgattccatttttctttacaaagtataaaaatgacaccttcagttttgaagcgaatgttcacatatcgtacgtcataaactataggtccttgaggtggttgtgattatcatcaaatacatgtcaatggaaaaaaaaacaaccatgttctagtcagtgccaaaagaaattgatctttcggtcgtagagctaaattcgatgaggattagaaaatgcaataattaaacatgagcgcatagttgccaaatgtttttgaggaaaaaaagggtatttttccttgctgttgatcgagaatcttgcctaatgtcatggcaagtccatcttttgcggttgcgcgctgtttagatcccaccccaaaattttacaccctatcacattgaacgtttaaacaccggcataaagtattaaataaaggataaaaaaataactaataaatattacacacattgcgactaatttgcgagacggatcttttaagcctaattgcttcatgatttgacaatatggtgctacagtaaacatttgctaatgatggattaattaggcttaataaattcgtctcgcggtttattgatggattttgtaattagttttttattagtgtctaaacaacccatgcgacaccctatagaatatccgatgtgacacaccaaaattttacacccctaggccgagtttagttccaaattttttcttcaaacttccaacttttctatcacatcaaaacttttctacacacacaaacttccaacttttccgtcacttcgttccaatttcaaccaaactttcaattttggcatgaactaacacacctctagctttaaaaaccccagagttctttgccagcagtacagtgtatgcgcgaaaaggaaaactgcgagctgccataccacatcaccctgggcctagtcatgcatcctgactggagaccttgtcactttgtcagcactcagcacgcacccagccggccgaccaccttcatcaagctaggacccaacccaaaagagttgcaggctgcgaggctcatcactgagcctgactgcctgagaaggctgagagagagaggcccgtgtttgatgagggtgtgtttagttcacgtcaaaattaaaagtttggttgaaattgaaacgatgtgacgaaaaagttgaaagtttgtgtatgtagaaaagttttaatgtgatgtaaaagttggaagtttgaggaaaaagtttggaatcaaaatgctgacttgccgtatcgtcgaccaatttagtaggagtagtagccaagtaagttagctatagatatatattattatgcattaatacctagtcctagcaattccttcacaaactttgatagagcatgtagcattatagcttgctatatatttatggtccgcttctcttctctctttttttttcgctaagtcatctacaaatataagtggtaacacctatagactattatattattttatcatacaagctttgatgagtgttgaaaacattttttttctctctcattaggcagcacagctatagtgtagtactgcactgctatttccatcccaaaatataatctcttaggtctttattccccccgagggagggattggaggggatggatgtgaaattaactccctctaaatcccgcacaatctttttataggtgagattaaccgaataaggccttatggagttttcttatagagattaaatagagagatgaagttgaatgagtaatgattgtgattggttgagatgagtttgtaggtggataaattaaataagagatagttgagataattaaggtagtagattgagagaagttaatttgattgctaaaagtagctatattttaaaactaagaaagcagagtattctttgcattccgcaatataagggattatgctatcttttgtaaaaataaaaaacaaagtagcaaaatgacaagtcatggtataaaagatggtagttgaggaaataaagtactgtatcatcacaattttttttatttttgaacaaactagaagagaaaaattcaaaagaggtaatactatctttttagccttttctcgtagcaagaaaagagctagattttgtacattttagctttttaaaaacttattttacaaatatacctaacaaaaaaaacttatttcaagaatggacttttttttggcgttgaggttcaatgtctcagcaccaattgcttttaacgccaacaccttcatctcctgtgatatctaagtggctcatgtaaagggattgactagccttgaggacatatttataaaatatttttttaaaaatggttaaaatataattttttatagataggtttttggcgtcatcttcttttgatctgaggacctatttgtaagaaaataatatatacattttaacaattttcataaatttattttagtaggtcctcagtgcgagcctcttaattgacgtcgacctctctatatctcggctgctaaagggatgagggcattaccaatatcattgacgacgccaagacgttggactttggtgcctggatcgctgacgacgagaaaagggtctttgaataaataaattttttaaaagagccaaaatgtgaaaaatacaaaagaaaagagggagggagaactcatcagcggagaagtgatccgatgagtgacagaccggcccagcgggataagtggccgagtgactgacagtccggcccttgcctggcctgcatcggatcacgtgcaggcctaaataccaaggggccaagtgctactccttcgtacagcacaattgtacacactgctaggctgagcctctctactgctgatctacatcacttcgtcggatacgctcataacttcacacatttcaatgataattccaagtctaagtccagttcagcctccgaagacagcactaacttcaaacggacctaacgccttcatgccaactctgatttgggtgatcttggacttcgtggaaagcttaactcgctatctttcaaacgcatccggtctcatatctaaattcatctcgagtcaacgggaatcgccaaaaaaagacagtgttgttgctgaaaccgaacttgggccttgggccttgtaatagactaggcccatctcggaagtgtctccctccacctccacgaattagcacttaaccctagctttattttcctctataaatagctttgtacatcctcaaaaatatttgggttttgtttaattgaattttaccaagtgtcattcaccttgtctctagtcctcgcttgattagtcagtgactattgattcagagcccccaatagttgatgtgttgatttgccgggtcaattagatctaccacttcaatcgcaactattcctttgtacttaatcacctattcgcaatatttagattgcatcttatcttgttcttgcagtgttctctcatttgcattgcagggatcatcaaccgtgcgtcacggttggtacaacatcgtttgtggtgtagcgattgcacggcgtcctggacttgttctggttggtatccacgtcgcaaatgttgcactcgatcaaagcgagagttatcccctcaccagaagatcgggccacgagagagagcgtcatcatttggtatcagagctgggcccttgttaaggggttgggaatgatgaggacatccttccgcgaccgtgtgagcctctgaataatcccaccttgcttagcttgggaggaggaagccaccttaaaagggagagccacccttcctctattggactagtcttttagggagattgggcctatccgctagtgggtgtgcttaagaactgttggggtccgggcaaccttaatttgttgggcctcggccaaccccaattgggccggattgttatcaactccctacagctacagcgatcccctcttgctttcccatatgttctacgtgtacactctctatcgaaaaataagtttattttggtattgtgtataaaacactgctatgaaatccatttttcgtggcggccattttgggttttcgctagcagaatttggagccaccacaaagcaaaggccagtgaaaatcaagatcttcgtagcggttatcgaccactagtgataatttatttttgctggtggtcatcttaagctagctgtcaccaaaaatctattttcactggcggttagattaagacggtcaccagcgaaaaaacatttttgctggtgggttacaccgtgccagccgccagtgaaaatgctagccaagttttttaaaaaaatgacggacagagcaacaccgctctgtccgcctccatcaatgctcgaccattcaaaaatttcacagaaatttacccaagcattcaaaaatccacagaaatttacatcaacaatttacagtaaaaaatttccattcacccaagcattcaagcaacacagaaataaacaaaaatttgaagtcgtcgtcgcggcgctgcccccgtcgacgtcggcggcggcgggggatccggtcacttcagtcgtcgcggcggtggatccggcctcccccgttgttgggacggtcggatccggccggtcccgagcccgcggcggtggtggcgacgacagctggcggcggtggaggagggagtgggagaaggagagcccgctgctggacccgtcgcccgcgccgtcgtcgtcaccgagacacaccgccgagcccgccggatccgtcgcccaggccatcatcatcgccgagcccgctggatgcgtcgcccaccaccggatccaaccccaccctgtcgcccgcggcccgagactccccgcgccgctggatccaccgccgcg

SEQ ID NO: 75274 - DNA, 23741 bp, Oryza sativa
gggggggtgcggcggcggcgcccgcggtttctcttttttcttttcgtttttttacgcactttttttttgtttttttcttttcgtatctttttagtctggtttctttttttgcactttttttttctttctgtatttttgtcagtttttcccttttttaatatgcacgtattaaacacgtatataaagtttatatacgtgtatataaagtttatatatgtgtaatttttatattacacatatatacaaacatatataaagttgatatatttcgtatatatacataaacaaattttgtatataaaaaatatatgcatattaaaaaaatataaatatatgcaatatgtatacataatatatactttatatacatacgtatacaaagtttatacgtatatatataaaatatatatgtatgtatacatatagtagagaggagagatgagagggtcaaaaactgaccgtgtcccacgcggggggcacgactgatcgcccattagggcccctggctgacatgtcctgacccgctcgtttaggacgtatcgtgccggtctgactgctctcggtcgtgggcctagtcatgtataggccagaccagaccgggcaacctatctagccatctataccacctggtctccttccagtatctcatagaaaccggatcctctaacgtgaactgctccctgacatgatcactgacaggtaggctcgcgagcattgggacccacgtttcagtcaccacgtctctctgacttcacgtcagatgttccaatctaccccatgcatgcatccttctccccaagaagcagcgcagggcacattaagcattgatttcctttttagcatcagagttggtgggtcccaacgccgccctttcctgcttttttttttggttcaaaacaaagcataaatggtgtgcttctaaatcctaaatgccagtctatcctttcaaaagctttatattctactatattgcttagaacactagttcttttatgtttatttttgaaagctaaattatcatattaatcaaatagatatccattttatgtcagcagcgtatcttaactttcaaacaggacctgcttggaacccttaagtacccgttagtaaacccctgaagcaagatcagtttgagctccacacaaaagcatagagtgtgcacatccatcacaaattccatttattttttattactttgaagagacattcgcacgtacaccgtcacatatacacacatcacaagcatatacacgcaaatgccaatgaaaacaaccagtttttttttttcaaaaaagaaatatagaatgttcagagcgtaaggacgacagtactacttatcactgacgtggcgtttagaacacagaagatacatatatatacacacgagcataagtttttagtgccaagcctattaagtcactgaattaagggcacgctgaaggatcggtcaagctgaacacagttgagcaggaaaacagaaatcaggaataggttcacgacaaatggataagtggctcctcttgattaagatgcaaagcaaaatgataacgaatgtaaacaaagggaacggtaacataaactgaaggtacacctgtgttaagttattaacttgaatattgaatttcttgatgagatcaacaacttcctttcttggcacagtggcgcctgcaggaaataaatattagtgacgcgcctccttcattttcataattctttaaattaacatatatatagctcagcagaatgaaggaccacacaacaagcagtgctaacgggagtacggaaggtgaggcagtgaggaggaggttataccatcgagctgccactcggacttgttcttggtatcgatcttcctcgtgatgcggataatgtgttcgggtgtgttcccgcgagtgaaatcttgacatggccggactcctcccccctcttgacgaacgccccgacgctggccaccctcccgagaacctgcattccgttcacgcacgcatttgttcatacacttagccgtcgtattcgcataagaggggggaaaaaaacagttgccgcgggaaatgtaaggaggcagtaggtgtgtacgtacgccggggtcagcggcgagggcgagggcgatggcgcagacgagggagctcttgccggagccgttggggccgaggacgaggttgaggcgggggcctgggcggcaggcgaggcggtggtaggtcatgaagttggagagctcgatctcgacgatgttccccggcacgtagccgccgtccccgcgccgcagatgcgtcggcgtcggcgtcggcggcggcggggcggcgatcctggcgcgcttggcggcgcgcgcggcggaggtcgccatgggcgggggattgcgcgggtgctgtggactgaaactgttcgacttccgcggaaaaaaagaacggaaatggagaagaaatcgggaaggggatctctgctgctgggccgaacattctactgggcttgtaggactaggagatttgggccttggccttgttggaaggcctttttggatgatgagtccttttctttttggaatacaagtctatttcatctcttactactgtttgaatcgcctacctcaaccacaaaaccgggtataacgtctttcttatcttaaaaacagtgcaaatagactccttcgatggtttgggaagcggtttttactgacgtgtcaggttgaccgtagttgactcgttgatttaggaggtaagaactcacatgtcagggagctacaaccccttgcaaaagtcttgtctgaaccaagtctataggtttctaggagaatgatgagaaaatagtcttaaacaacaccagctcaaaagcagatacaacttatctaggaatcaatcctatgactaaacctctagttaaaactgaagaaaatttgtgtgactgtctctaaattccgaagatatgtgattgatatagaataatatttttaataggactttccatttctatccttagcaattcaaaagcaaaagcaaagttactaaaaacgacaaacaaaaaactaaaattagttctaaaatttaaaattggtatgttgtagctgaaacaaacaggcccttgggcagtggaagctcagtgggattcatggatggatgagcatgcacatatccatagctgataggttatttttttcctttataacattgcattgaacacacacgcatatacaccaccacaaatacacttaacccgcatagtaagtgcatcgcatgactatttctacgtcactgctacgaaaacagccagttttttctttttaaaaaaatccagaatattcagaggtttcagggtcaattacaaagattaaattatcctctacaaaattcaaattacgacatcactactcactatcattgacttggtgcctagcacaccggaggtaaactacaagaacaaagctctctcagtctctcccgtctctatagctgctatcagcgttgttctatattctgtttcatctaaacttcgattggaatgcactcgaatcaaagaagaatgccatcgatgaaatgaaacgatcctgagtattattgatcttcttgctccccggaagttgggtttctgatctttcttatttttctctgcaggtgaaggtagaaaattcagtaacccatataaacattcaagcaaacatttgcttcaacaaaaaaaatttcaagatatataaggggaaggaatggaatatgtggacactaaccgagttcgcccacatcaacccacaagcattgcaaaatgatttggttccattgggagcatggcgcatcatgggtgtggcgtcgctgctttcaccacagttggtgcagctgcatgaattaaaaatagtatacgatcaacaagcagcatccacattgcaataatgcaatgaaggtttcagaaaatcagaagtatatatctgttgaaaagaacttacaaagttatcccctttctgtgtgccaaggaattttcagaggtctgaaccctaggtgcaaatttccctttgctgcgtttcatcctgaatgagcaaattcacaagaaccaaaatttgttaagtactagcaaatgcggaccaaattaacatttcggaatgaagattttgatgcgtaccgcaaagcgacttcctttcgggcactgtaatccgccttcttgatgaacttgatgttcctctttttctccctataccgcgtcagcgcagcaaacctgtcgaagtcctcgggaacagtgatgggtcttacctgatgaaaagttcagagaagttgtaatctgctaggacaactgctgcagagagtgatctgcaatgcagttatttttttcaaatggttgtgaaaaatgcagatgatttaattaccaggttagtgggttgtggcctgatgctctgtggaatcatctcctgtccattcagatggtggaagatattttcaatctgtgtaacagtatcacaatattgtcagtgctgtaatacgatgttatttaactatttaagtggtaaactgtagcaatacataataaatatagtgaagtttttcaatattgcactggaaacaagaatgcagagaagacttgagcgcatgacatggtaggaaaagaatcatggatagcatgcactacttccgagcaaaatcccttgtattttggaatggagttagtaagtactatactcgtgttgagcggctacgcaaaaataaaactacactacaaattttgtcatcgaagaagaacattttaagattgaaattctgcttctatccaataatgatcagagaaaaaaaagatgaaacaagaattagtgcaacgcgttctaaattagctacaagctaagagacaaacattgaattggtcatgccaagctcatgcatacataacaatgcaacaggaggataaccaactcaacatagcaaaagaatccaacagagagccacaaatattaaaaaaagcaaccacaaatgttgctcataagtactgtatctaacagtgtcaatgcaaaagaaaggtagagtgatctcaaaaaaaacaatgcaaaaggggagataataacagtctgatccttttttaagtcaaaagccttcagtgcgtatctactaattttcctaggtgaaatgcaagaagtaagaacagagctccttatttttcaggatcaaaatgaaattaaagccgaaacaaattatccaagagcaaattaaatataccacattatacaagagcaaaaccttctaaccaaattcttgcaaacaaattaaagccgaaactcatcaagtactagctaggatcaaagaatgaagaaacataattatatttccaaggaagagaatgaaaaaaaaaacgtagaaagttaccaagaaacaagcacattgtgcagcaagaccaagagataccttctgcggctgcacggggtcgaagatgtactcctgtccttggtagtacatcaccagccgctcatcgtcgccgtgctccggcgccggcgacggctgctgctctgccgccggctccggcgccggcgacagcggcttctgcccaatcgcagcctgatcgtctacgtaacagccgtcgccggcgtcgagtccgtgcgtgaagtcgaacaagtccaccgggagcaggatatcgtcgaaggtgtgctcctcgtcgaagaaatcagcggccgtcgccggcgacgtcttgcggtgctcgtcggagctggcattggcggcggcggcggcgccgccaccgccggagctcgacgacggcgtcgggttgtccattggtgaggttgggagttgcagtgttaagtggactggagctttgttgagatcgtagtgacgagagaagaatatcgaacgcgtgactccaaattttatacgcgacatgagatataattttttggacaatattgtcaatatataagttgatgcaaaaatttcctgaaatcaagtttatatgcactttaagtgctgtattttttaatatatatttttgcatcttggaaaactccaattttcaaagaacacctagtttatgacattaaagtataaacacgtccacctacaaatttttgtgagcaccaatgaattttttttacatattattagacatgtgagttacttgtggtggaagtggaacttttgtccatccagatttatagtggaacttgcatgttatgtttaggttctacactccatatattcggaacactcaaatcatcctttaagggaatatccacttatttttacatgtcacttaaaaagtcattaaaaaatttgaaaaaaattggtaggatagaccaatatatgatatgttacttcacaaacatgcaaatttaaattcaacttatacaagtaaaaacaaaaataacaaatttgactatgaagtgaatgtgtaattcacagtcaaatttattctttttgttttgaattgtataagtcgaattttaactcgcatgtttgtgaaaagatatatcatatattgatctatcttgacaaaaaaattttaaaaaatttagtaacattttgaacgacatgcacaaaacgaggggacgtccctcgacctctcgagggacaataatccatttatgatatattcacttataacaagatatttgtggtaaagtaatctcaaaatataccgaatataccgacccaatctcagggcacatgtttgacaagcatttatacgatgtttcttaaaaaaaaggaaaaaagaaattgtggtgacgacgaaaatttatacggctgtgtctaccagaagtacggattgacccgctgaatctaaccaattcactgggatgagcatatgtacggcctcatgtagttctccattgacggaaaattgaatacgaaatgtacaaccctacagtcgacagtttgagaacgattttacagagaaatactccgtacgacaataacgggttgagaatgtagtagtgtttaaaactccaattcaaaatctttttcctccaggatagcagatcttagaccaaatctaacactaattgtctaattccacatgtgaaggtaaatcaacgagacaaccatccgaagatcaaaatatactcatttccgaagcagcaggaaaaaagaagtaccacatttcaatgatatttcatatttgtttctcgaaggaaatcgggatatttcatatttctggtgaattacatcatatccacgcttacatcagctattactatcacggaacccagcgccgcactaactgcggcagtaattctggttaattttttctgcgaaaggaagataaaattgagccatacagcaagattggtatgatgttttccattgttacatccacacaaagacaagaagtcgatatgagtcagaactataccctgtatacatatgcccccctaccaaaatcttatgtaccgaaactttgctctaaaaatgaagcaacatctaccctaagggggcattcacacccaacttaaggaaattcaatagcacgcaccattgccccaaagcatggtggaaaatcatgaaaaatttgtcatcatgaacaatgaaatcaagtgcacttctgcatccaaacagcaccggtagaaaggaatagaggccacggcacccaaatggccaaaacttgttgctgcttttccctgttcgagtttaacttctccatactacatctctctgttgctgctttcagatttgacaccaccaaggggccagcacagtcagaagtgatttcaattgtaaattctcactggcttctcataggtgtgacggttctgcacattagttgaagccagaaacaaaaaaggaagaagcaaaatttcgttaagatgaggtccttgcaaccatagcaatatgcatataaaagaaaagagcattggaatgctacagtacagtgcaagtacagtgcagaaaaatgtatgtgaagtgcgaagatgtttgcggggaaacccaaagttaactacaagatctttcttcagtagcagcaaagccatctcaaagttgcgtataaggatactgtaaacacctaaatgcctaaatataaattgctcagcatgtactccctccatcccacaaaaagaccattcctagcatcccaaggtaaaattagtggggagtaaaaatgaccaaaatgcccctcattattggaaaaggtagtaatggtgataggtaggtaaagggtatttaagggataaaacttcttgttttatgtgctgagggtaggtaggatggtagaagttggtttttttgtgacaattcaaactccagaagtttttttgggacggagtcatggagtaataaaattccggattattggtttcatgtataactaagagggattaaaacagaattctctaaaacatcaggcgagcccaaatattttgaaagatcatttgatgaaagtttaaaaagattgcaagaaataccacggtgtaaaccagctgaagtgcaggtagcaagataaacgaagtatagcatagatatgcccaagccgagtgacagaataaaggtaaaagtaacaggcacaagaattcgctatgctcgcttcacaagttcacaaccagacagcagcatacctgattggctgtgtaggccctttttggtgcagtatcagcatgctccaaaccaagatactgctcccaggctccatagacatctctcctctgaagaaatcagaacagaaaactttgtaaatcatagaacacaacaaatttatgggcacaactagagaagcctgtagggaacaaacaataatttacctggaaacgggcagatacaacatctgaatcttggaggtaatctggccggttcatggatatgaaagcgaatttccactgatcatatagcattaaaaagtatattagtttagtgtctgtgtctgcatcacatagtggcacgtaatgaaactcaaggtaaaaggcagagaatgcaacaaagagattctcatcagaatatacatgttagtttatttcttttctttcacccacatagattagatttggctcacgtaacacacatggctaaccattctataagagataatgagcacgacagtgctaagtgtatcataaatggccactgtttttgagaattactgagaaaattttagactgcagtataatatgagaactctcagctccctacagtaaaagaaaccactagactggtatacttcaaaactctgaatctgacttatatatcagcataatcccaaggtggacaaggataaagagcaagccaaaacatgttataattccacgctttcataagaaacttcaacagatggatcaccttgcagaattcctcatcagggacttggagttttttctgtatgcgctcctttacttctgctaaagtctcaccttcacggatagcaagataaaaaggatctccaaagttctgaatctgctgctagtcatcacagcagtattaatggaatgttcagcatattttgtaagtagccaactcccaatacaactcaattagacaagaatgaagatcatatcgaagtgcactacctgattctgaagagggtctttcatgaagtgataaacatgaattaaccgatcatttggaccgagatttttctcctcctctggaatctgtaccaataagcagaagcagatatgaggatagaatgaaggcgcacattttgacacaagcaggaaatgaaatagattgcaactttacagttcacgaaatggagcaccaaatgcaaccaaaaagaacattacatacctcctcagcacgtagtgtccagtactgatcattaatattctctatcttctcatggagtggaaaaatctatggaaaaactataattagtaacagccatgccataaattataaacagatgtttttttaaaaaaaaaaagggaattcatcaggacatatggtattttatttctcttgaaggctgaaagctaatgtacaagtaccttatatatcttgtggtaaaagacctctaacaagcgcaattcagcactgggactggatagttcaacctgatgattagtgacataattagaatttttacataaaaacaaacacatggagagacataacaagccggtttacacagcataacttggtaataccaatgaaaataattgaaacattccatcccatttaagatagatgacaggttagtgagagtacaataagctgacatcaggttattaagtatggccagatttgcttaaccaaccaagactagtacaaaaagcatatggataggaggtttcacagtacttttcacagtaagtatgttgaaacagtcatgcagtcacatggaaattgaatatgcggctcaacaacgagctatatattagtatcaatgcttaacacctagttgtacttatatagagtatttacacgttaacagaacatggattaaatgaaccaagttatatcacttgatactttcattttgcatcacaatttggtaacctggagagtcaactatccctatgcaaaaccactcttaaaaagttagtatccatttctcccttacctctaaaggagattagaagtgcaccctaaaaagaacgcatgtgaatatatccaagtcatgcattggtgtatctcagaccaaatagagtgtaaaactggagagcaagactaaataacttgtaataaagaatgaaaggatagcaaaaaaagaacctttgttttcaaatcattaatcacgtctgcaatggtgctattctttggaagcctgatactgtgaatcacaacctagaaaaaaaggatgtttcatgaatatatgcacttggtagctgaagataaataaagatgtattgtttgcagctaataacctcatcctttgtagcatggtggaatgcaactttcagggttttcaggccctgcaattctggcagtggaatatccaacacctcataatacaatatgtctgatgtctgcaccagatagtataaatccctttgtattttacctatgcagaaaaactatgctaactgacccaaaaaaaaacaaaaagaggtgaaaggttaacctgattataatgaatgagcatgtccaaaagatgctccactccccgatatctgataggttgcggtttaggctgctgcgaatagcagttatgggatgttagacgaattttcgctggatcatccacaccaagctgacgggcaactctctcaacaacatcatcataggtatgaagttttgaccttaaagaatggggaagaaattaacgttacacatacatgctagataattagccaattaaacagtttgaacccaataggttttgtagtcactcacaattccaaagaaaagtcatcatcctttggtttctccaataaccgaaagtgcacaacctgcagtaaacaaaatttacatagataaagcaagtggcatcatcattaaaaaggtagacccactataatattacatgagcatgaaaaaccaaaattaaacaagcatctaacatatgatagcagaagattagaagggggtgaatgaaagcaagagaaatttccttttgaaccacagaatgcaaaggcacatagcattataagcatactactataaaaggagctagaggtgattgagctcatggtcatcccctcacacacaagaacttgtgtgactaatataggcatatgtcgattgaaatatcagttatgacaatatgcatagtgtgcacgtctataggttgttgattgatctaatgtaatcattttaacattttttaagttttgaagttaattattttgtttacatttcaactttatagaagtttgaatagcataatatattactgtatttgttttgacatccattgcaatgtggctgccatgttcatagcacataattaatcttccatttcagtctacaggagatgatgcatttcaagcgtccatagcacatgcttcaatcaatggaaattagtataatggccccatactgtagagcacagccatcttaaccgaggaagctaaaaatatcagaccagactagcctggtaaagtggtatgagataagattactgccatgttcgcagtggatgttgatctagtacataaactctaggactacaccatagaacaattcaggtagtggaatgggctcagaaaaaaattgccattcaaccaggatcaggcagaaccctcttctacaacctaaacacgactctctaggaggacagccccagccttctatttctttcacactgcaactacccttccccactctctctctctctctctctctcttctctctctctctctctctctctctccaccaactgattggcaacagcatgttggcaagcaagggcaacgtgatggtggacagtaaactaacatggtggcatggtcagtgtagtgcaatcactagctgagatcaaccagatctagccaggttgccagtgaggaaagtgcagatctgggctcccagtagccactggacactaaacctgcaccaaattcagcattgcctcacctaactcctccataagacccagattaaccttttttaatggagcacaagagcccagtgtaggtgctggccttgcctccacagaagttctggtatgaagcagtcgcatcacagttccacctagaacattgactaggcctcctagaaaggcacgaggaggggtaggaaggagattcagacagacaaaacaagggacggattcagggcgagaattgaggcagattcaggggaaaagaagagaggcaaatttaccattgcaattgccgtcttctgctcctccaagctccatctagacatctcccagatcgtcactgctggcagacccgttactatgaatctatgtctatcagagggtgagaggggaggcgcggagagcaagagaggagtgaagcagagagaataatagatgaggtggtgtggccttagggggtcatacatcccctctgttagccacaggtgcattggtctgcccgtcacttctttgctttatctctttctttttgttctttcccttttcattttctagttgcactgccacttttccgcatcatagccacatctgccaccatcatcacctcttcttcccttccacatccctgggtttgtttggcaaacaaagaaacccttctaatcgcttcggataggtttggactgatggggatatagatattccctcatatccaaacaaacctaaggatataggctgagatccatccctctctctcgaaacagcaattctctcccaaatgccacccctcatcatcattgtttggataggaagagattagacccaattccttcagatagtgggaactttaattccatttatagcccatccaaaggcattaagcctaagccccaccaattcaaacaagcctttccatcagttaaaatggtaagaagtgggaccaactaaccacccatcgcggcttcctgcacccaccaaccaaccaaccaaccaacatgttttaataacccccagctcgtaaattccaattctcttctaccaatttcctcgagccaaaaaagccaagaaggtgatgtacaagccagagaaaaaaaaggcagacaactagatgacttaatctgggtgaagagaacatagaaccacaaacacaagtacatcaaaaatattaatagaagcaactatagagtagcagcataaatagatagtgtacaattagcttacagacaaaaatataaataacaaagaaataaacgccttgtacctacagtacaaagaattggaatcaagttgggaaatataagcaccatacctgcctattatgaacatactccagatacgaagggacatctggataacgcatttgagtgtcactatcaggtataggtgatttttggaaacagatgatgtccccatcttcaagctacaatatttggagcattttgcaaatcaataagtgtttaattcaaatttggcattccttaaccaaaagaaacatgttataaacctgactagcacggaaagtggcttttttgtcaatatgttcacacatcacatttggctcaaatttaatttcctgcatgtaccaatgaaacacaacataagtacagtcaacttggtaaggcagtcgatataaaacttagcaattgccactccaaagattgacacttaataatttgccactgaacgccagacagatatctggacctactcctagaacacgcctcaatggagtgacatatactagattatcccataaatatagcatcatgaatttagctcttgcctcgtagagctcaatttcttcatttggcacaaatccagccatttcatttagtttggtcaagatttctgagggttttcccaaggcctttacgaagagcctccccacaaaactgcaatcagtgaaagaatgttatgtgtcagccatttgtgaaggaataaggaagaatgataaggtgttaatcaaataaatgtaccagagttcttccttttcgggattatagagtttgaagaacagaagaatatcttccttgctcttctcaggtggagggagaggccgcaaatcctataaatgataaaacagacaacaataagtatcctgcataaccataagtatcaaacagataaacaaagttaagtatcctgcatctagaagccataacagacaacaataagtaaaaaacagaaaaagaaatggtagcagctccagcacatcattaccgggccaagttctacttccaaaaacaacttcagctcagcattgtgtgccttattcgatacctccctcagttgtcccacctgtgcagatacatataaaaatgaactggagatgataagaaagagaacagaagcaataaacacacaatggaaacaagcaagctcattgaaagaaaaaacgtataagctaagtgcatgatcttctgataacatgcataacaaagcactctcagcagagaatctatacaacaaaatactccagaactgcaacctatataaaagaaaattcttaagtggggagtgagagaaagagagacaggggaagatcgtaagaactcaattggacctaaggctgttagatgaaataataaggtaagattaatttccaattgaagtgtgggtttaacagtttgcttccaacaattgaaagtgactagcttacagattgtgtttcttcatgaggactcaatggacgattaggcctgtatgtgtggttctgcctcttagcccacaaccagaagcgctgaaattgtacagggatgccatactcctttgcaacttcctcctattaaacaatttattcaacagaagttaaattaccagttgattttacagaagcatgtgtactcgtatagcagaaatttagcattccaatgctacgaaccaagaacttgtttgcacaccttaccttgaaagtggtaaacagtaactgcttctgaattcggaagctacgaactttttcatggtccaccaggtcaaaatatatatccttgccaatttgctccttcaaattctcatctcgagccacctagatatatttgtccaaacagagcactatgagaaacagattcacagagaggttccagactgagatgaagtgatgaacataatagtagtcagatgctgacctttatgatggtataaagatgagcttcagccttctctttctttttgtgttctttctcttcttgttctttcttcaaccttacctgaaaatccacagtttatcatccaaactgtatcagaagtccatgacattaaaagggagaaaaccaggaaataccatcgtaaagatatgcagattgtaaaatatcaccacatatgagaatgacccatggggcctgggcccacgtgtgttgacacatgcgatggtattttccaatcgtggtatcgaggaaattggcccaaggaggagtgagaatgcaaaacaacacatacccttaaatgctcagcaatgtccttctcatcaacattacacattattttgtccttatcactctcacggatgtagacaagcatgtaggcatttgaatactttgtgaatttaaatggagcgttgttgaaaccaggatttatttgaggcaactgttcagcccaaaagagattaaaattacggaaacaggaaaacaaacatatgtagttcaatatctcatatcattcaatatcaattatcaggtagaacacacctcttcctcacccccgtattgctcttcaagggccttcttagtatcttctttagttacacgctcatcatcaaatttatacctggtagacaggataacattttcaaaaatctataatgaattgggaactgtttgctaggatgtaaaattcaacagcatagttcgacaaaaggcataatcattgtagaattaattataatgcgaggatattgcacttgtttccaggttcttcaacagaaatttgcatgaggtagcactaaacctaagaagatttattggcaactcatttgatgcctaatatatggtattcagctggtctatatgcaagttacctatattgttgcagcgtggttactccctagactggcatccacttacaataaaagtgcataaggcatatgattttcctcctgtaatctcacaccacatacttcttttgataagtgataactgatgaccatcagcttgaaagaagttattgaagtccatgctagtcaggtgcttattagaaccaacacagaatcctataaccaactatattatgaaaaagtaacatgttgaacttgacatgagggccttctgtccagttaagagaacttatgtaaatttgttagtgtgtaaaaacgtcccactaacattggctaactctagttgagatatgatattctcttgtgtagaaacaaacactctaatatttttttggaaatctgcctcggaaatgctgcaatccaatagatacaggtcctaacaagatagtttcagttgtcgaatagagtgccagggagttgtctcggagaacacatctattcagctgtcatcaagtggccatgcataggaacagggtaataatattatctggtaaatggcaaatagttgaataattttgtattgttgtagtactagagacaaaaaaaaagtcaaagaaaaaccaaccattgatctgatagcgttggtcgaatgaaggcatagtagtgaccgccatgtactcctccactatgaacaagaacactgaataaaagcagcagtgaaacatagtgagaaaaagatgtggaaaggaggaaaaaaggcacctattggagcaccactgttacactgaaaatggtacctaagaaaccattacacaaaaataacaaatggtatttgcttgatcccaggtctcaccaaaactgaattttctaagatacataaaaccctgttattccataactctaaaaccaatatggaatacaatgactgctaagagaatggcaagtgatgtggaattctcaggaattgactcagtcattatgcatgaagattcgtgcaggtatatacttgtatagcgcattatatcagcccattttatactatcaaccaattcttcctccaagttttttgtccacagacagacagcagctagtagtctacccccatgctcatacatagcatgtagataaaagaaacaggtattattactaacgaacccactgatactttggtttccctaactaccataatgaactattaggacgtgtgatggagaaattaattgatcttaaagccattaaagtaagttgtgaatgacatactcataaaaaacactacctgtgaagagcataaaggtttcttatacttctatctgcatctggagcaagatattttccatcatctctatccaaatcaagttgcaaagggaattcatagcggtcattaatctgcacagataggcataatagcagaaatcccaagctcagaaccggaacgtaaacctttaaagtatttgaacagcagagatattaaagaggctagtcggctacatgcttctcaattctcaagaagtgatccaaacgtttgatccacttaatgtttcttgaattaatgttgcgttagctgtcttttgaaatcatttatggcagggaaaattgaaggaaatgatggctcagtgttaactgtctaaccaaggaaaagcagatgagacagaagttacagggaaacaaaatggaacataagataatcacctaagatgtctcaccttattattatgaaactaccagtcatgttggaagaaaacatattgcagctctaaagtaactgttaaaattcctaaaccaaaaagcaaaaggaaacttttctttactattcaagcccaaaatattttctcatcccttattgagaattagtatgtgacactggaatagatgtctgccatacaagatgaaaccccacgcgttgctgtgggagttttgtataataatagtagataatatgtggcatagctagacaatataattttataatactttacataattttcatctttgaccgaccattgaagaaaaagctacaaacaatttaagatgacatggtttataacaatttaaattatatatagattaatcatccaacagcaaaactaaggtgatgtggctcaatgaggtaagggagataatatagattaatcattcaaagataaaactagggtgataagacttcgtaagagaagaaaaggaggaacataatttggaccatagatcaatcatctaagagctagaaagaattgaggtgatgtggcttaatgagaggagagaaatagcattaactacacttagtggggataaactttatagatatataggataagggatgcatgtcaaaagtctcaaagtgagagtacaaccatgaattatggtggtcctgtgcacaagcaattatcataaaagatggcccaatcaatttggataataaataagaaacaaaacaggcaagcttttggtgggcaataccaatatgtgacaccatgactctccagatttataacaggagatgcacagcatttggaattggatctcgccaagttaaaaaactatttgcattggtgtacttatgccttttaggaattaagatcatgcatcaagaaagcgaacaactcatcagatccacagagtatctgcatgttgggttgtcaacttgtcatataactttgggatgggcaatctatttgagttttgagagcaaccaacaccaaggtcaagctcaaatcattgtgcacacagccacacactcaaggttggtcaagttaagatcaattaggctcgagagaacatacatatataatactacctccgtcccataatagttgtcgctttaactttttccttgcaacatttgaccattcgttttatttgaaaaaattagtgcaaatataaaaaaggataagtcatacttaaagtacttttgataataaagcaaatcacaaaggaaataaataataattccaaaattttttgaataagacaaatgatcaaacattataaaggaaaactcaaagcgacaagtaatatgggacggaggtagtatagtatagcataatagcatactacgttaaccataaatagttttaaatgaagatgttaagttgttaacatgtttacagcaatcattagtcattttcataatttctaagtatttcatttttttcccaattgcgttgtatgttctccaaatgtaaaaataaaatcaagcctccaagggtgtcattttgcacagcaggtcttgcattcacatgacaacataaataatagaggtaaatggatggagaatataaatggcaaggttatggcagtcccaaccttaaccatggtatctctcatatagtcgtactcaaaacgcttcagttgaagttgcaaaactggggggaaatcaaggaacagaacaccctttttcgcatcctgagacaatatcaaaaaaacatagtcaagaattggcaccaaaaccaataaaaatgggcttcatttataaaatatagatggagcaagctgttatagtatatgggatgcagattccctttatcttcatagatacataaaagtccacaagttatatcaaacctttatgaaacaaccaactctagcttcagtttcaaagcttaaagtgagaactgagaagaacatgtgggtacctgtaaaccatgattctctgcatgatacttattatcaccttcgaggcgctcaacttcaacatatttatcaaacgatgcatacacatcacgacaacctttaacatcaagttgaaggtctgcatggccataatacagcattaacttgacaataaataatgaaacacatctaatgtgaacccacaatctggtaccaggacaaaacctaccataaaaggactccttcctgttggatttatagtcaacatttatacactctatataattgatgtggtgaccttcgaataacttttcaatcgttccctctacgacagttctctaggaagaaagcaaagttaatagcagccaacatgcagcatatatacagctctataccagatttgtcaccttcatcttatcttcaagtttctcacagagaactctgttgagctcttgtacatcatgttgcatgaaggaatcatatgtgtcccatccaaaagatttggtcagctctttggtggctacactattgtcactatactggagcttgtagaaaaggctctgcaatgccaacggaatactcccagatggcatatcattttcggtggttggcatatgatacacagcctgggtaaaataatgaagttagtcaattagttctggaaacaatagtctagaatgctctgaattatgatgcatgatctcacaccttcctgaagtatggtatatggtatagtgtctgtagtagagagttcatgtaacaggtagctccttggttcttcaggccaacgtaacctgtttctttttttgaatcatatgtccaataatcaaccattttgcggacagcaacctcagcctccacaacaacagtatcatcgacaaggtatcctctacttggatcatagagctcactcaaaggcataaaagatgtgaaaccccaatcactctcacgtgcattaaattgatgctgagtatctgccagacagagaatcacaggtccatcagtgatagatttatcccatacaaatcactgaaatccgcagaccaacgtaaagtagatctactcagcatcatttgatcaagtagcagtatgcctccttaactagctaagagaactcaaaataccaaagaaaacaatgaggcctagcatttgcaagcatggggccacacaactccgagatcatctaatgactattataaggaatgaagcaaaagtatatacaggaagtaaaagtggccttataaaacagaaaagcctagaagaagcaaagcacaaatacaaatataacactcttgagtctgagaggagtttcatgttcaagaaatataaagaacctctttttctacactaggggaacctggccttggagaagtgagagctcttgcaaatagaaatgtcaatcatggtcattgccaatctgagcttggataaaagacccaaactgcgaaggagaagagtacagtagaaccttcagctgtctagcgggtccatttaaacaaccatatccttttgtggttcatcatgatataatgatgtgtaagtgtaacagaggaacaatttgattcaaccaaatcattgaacagaaaactatagtgtacccatcaggatattccgtgcaagcatgccaacaagaccaaacaaggtgctcgataacgcaagatcataaaggttgacaagcaaatagaaccattttcaaacatatggcatccatttacttgatgaaagcacgacctctgacctcaagaggagcaagtttttgaatactacgccgtgataacagtttgacaactagtgaaacatagcaaagtatagcatcatcatactctcaagcttatcatgtattgcttttgcattttaagtgtattcacgtaaggagttgtaaacatcatgatggaggaccataacctttgcgtatcgtatacttctgttggatctggttgacaacggccaagctaaactgagcatatcggctccaaccatatgggaggttagcagagtcggcaacatccaagtacatggagaaatggtccacgttgttccccttagggaaaatgagcacacgcctgcatgaaagcccgccaaacattactatcatccaaacattcaaaaagaaaactaactccattaactaccctttttatgagaccaggagctcaccatttgtacccgccaacgacaaacgcatccgagtagtgcttcttcgcattgatccgggtgaagttctcgatcgtccacgtgaaccgcgacgtctgcgggtcctcagctggctggctctccgccgtgctagctgcctccgtttgcgcaaccactgctaccacaaaccacgagcatatattactaccaacccacaaacactcccaacaccacacattacaaaaccacgctgtacaaatcacacggaagcaaaggaaagcagcacagtgaacccccatagagagcaatcaacatggcaccttccatgggctgggcggcgtcagcagcgacgagctcctggtgaggcacgagcatctcgtcctcctccggctgcgcaaagaacatatcgacaaaaagaaaaaaacggaaaggggggtcagatccagcgcggaggcataaaccctagcaaaaaagcggcaccacccgatcggacgcccaccgcacgggccaccggagaacggtgcagccctagcgagggagatcgggcgggtagacaggagaggggagagctctctctctctctctctctatctctctcgcgcgcgcgcggagaggcggttgcttacctcgagcgggggaggcgtcatcatagtcatggagaggggcgcctgcaggtcgtcggcgtcggtgagagcggtggcgtacggcctccgcggcggcggcggcggcggcggcggcggagaggagagcagcgggtggaggtggaagcagcgagtcgggggcggaggagaagggaggggggagtgcgacgaggaatggaggagtttgggagttttggaaggttgggggtggtttggggatttcgtgtgccgcaggctcgcagcgcaggtgagcgagaaagagagagagagagagagagagagagagatcgagggaagcagaaatctcgttccttttccttgccggttgccgttttactctgcccctcgaatttcgatgtgattttatttttttcttaatgatgaaagttttattaagctcagtaaatttaatcgtcaccgtacaattatcgtatttcgcataaccaactcacatatgttctaatgaaaaaacaaaatggattacaatgagaattttggtgagattttatgtttggacaagatgcttttcttagttggttttccttaccttttcctatagcacgtaagctcaaatcgtgagggcaggtttgaaacataggatagtaaaatataaagaaattaaaagtgtcaaagtttttctgatgctataagagtataaaacatagacgagaaggaaaaggaaccacggattgattatgaagatacttttacaaattattgtttttgtttcgggaaaaaatgtgttaatgagtttttgtaggatacacttcaagctcgaaataatctttctaactcccataagagttgaaataaaattgtatagatcatgaatcggaaaaccttaacccataataaaaatgtactaagttctttctttgacttaccgtttaaggtcgtctttgaaagcaaatcacctacatacaatttaaatagccaaactagcatatccatcaagcttgctaaggcattcacagtgcgtcatccctattcgaaaaaccttagagtgccacgta

SEQ ID NO: 75275 - DNA, 43758 bp, Oryza sativa
  unsure (1)..(43758): unsure at all n locations
ggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataatgagcggctttctttaagaccgctacattacttaagtagcgcgcgaaccgggacgagccagttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgtaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctcttcggctgttccggtggttcttcaccgtacagccggtgttgccaccgtcggtagtcggtggctgctactttcagctgcgggggccagtgctgaaccgctacattccctgcgtccttcgcaagaagtgggacgactggaagagcgactggttctacacccctctcgccgacgaagcgcacctccgacttccgagccagcccccggcgcaggcctccagctggcgggcgccggtagatctgggagacggctacgacgccgttcttgaccgcctggcgggtctgcgatcccaggggctcacgggggccatggtgttcggcgactaccttcgtcgccggatcgcgccactccagcggcgcgcccgggacgcctgggagtacactgggtccgaggactacatgaggacccaccaggggggcagatgggactgggcccctgaggacttcaagatggtggtccaacaggtgctgaatctcagctccgtggaggcatccctcatcccccaaggtgtcctccccctctgcagcgatccagagcgcgccaacatcctgactatcatgcaggaggtcagggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccacgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcgcagctgtcgaacacaccatcgccgatctgcagggcgcgctggactcgtccgccggggaggtcgaggccctccgcttggcgggcgaggtagggctcggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggaactcgaggagacgatcaagtcatcctcgagagacctcgcccggggggcagtggagtttgtactggcaagctaccaggccagggacccggacttctccccgtgggcagcactggacgagttccctcccggaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaaagtttttcctttcttcttccgaggccttcgggcccccttcttgtataaactaatttaatctgcaatcaaacaaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatccacgtgtcgagactggccaggccgggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaagactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgcctggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcgtcccggagggcctcactaacaaagtagacgggccgttgcaccttttggcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccttcggacaagcgggcagagggccagctccgatcgtcgggggcctcgggccaccgttcggctcgggggcctctcctccctgctctctcccgggtcgagtcgacacaaggtggggatgcgcggagcgagggtcgtcctcgtcgcgctccacgaccaacgccgcgctgaccatctgcggagttgccgccaggtagagtagcaacggctcctctggctccggggcgaccaggactgggggagaactgaggtacgccttcaactgagtgagggcccgttcagcctcctccgtccagataaacggcccgaagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcaccacccgcgggcttggatgccacggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgtggagggaggtattgtgcacggtgcaccacctgccggtcgggcgctccctactgggagcgccggcctccttctttttgtcgctcgcaggcctcccctttcgggtggcccacgaagcgccctcgacggcgaggacgtgaccctcgtcgtcggaatgggccgacctcttcttcctcctcctgtcccgccaccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccactgcccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaagcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggcttcggctagggacgagtgcctggaggctctcatcattccgacaggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacatgtggcgccaaacccacagggggtcggggcgccccagctctcggggccgaaacgggagcggcccgacccctcggggagacagagggagggacggccacatcaccctcgggcccgacccccccccccccccccgagggggtctggccacgtgggtgactgcagctgccccaaacctctagtcaagatacccccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtattttttacttagactctccttttttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtcccccgtgtcagactgatagatttgacgggccccacgccatagcaaggcatgccagagacttccaaggcaagcaacaagacatgcatttaatgtgattatcctccctgaataggttcggtgggcccatgtggtaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgatgaagcttatcccccatcgtctcactggccgaccttggcccctgttatttttgggtcatatctaattcgttatactcaaaatacacctttggtacaaaattaataatctcacaaggatgaaatatcagtaattttctatttactggttgatcccatcttttacggcatcaattccttttttgaacgtacaaaaatttggggagctcagcgtgtctggaagcacgggagaacgttcttttgctgatattattaccagtattcgatactgggttactcataggaaaatcagcctttccctatatcaggcactaatttatttttaacgtctaattagatcagggagttcttccaattaagaagttaagctcgttgctttttgtttcaccagaattggagccaggctctatccatttattcataaaaggaggtccaggcctacttagggaggggttgagccctttttcacttgaggagttctcctgcccctcattattaacaccttctactccaacaaggagatcttgtaatttctcccacaattagctaagcacaagagtagggtataacgcttctcagcggcccgaacctatataaacccctcttgtctcatcgtccttgaggggcctgacccctatgcactgaactatccaccgagcccttgagtctcacctgctgcccctggccgaaccaacaaggggctctcactatcccctgcttgaggagttcaccctccgacaggattctaacacattctattccgataaggtaattttcttctttatctgtcgtatttcgtaatcaaatgatacattgtcgtatataatcaggtatatggtattgcggtattccatgaatccatgtataggaggtatgtcttatccttgacactgacataattaaataaaaaagacagattcaagggaaatttttctaaagttgtagcttttacgaattttcctccaaaatctatgtagtattttccctagaaaaaagatctctgtagtatcgtccattatattagagtttcaatggaaaggagatgatttaattatttgtttcaaatatgcttttaggaattttttttcatataaatttgaaactccctaatttttctgtcttttttctgttcgagcctgattgatcttgaccatgtcgtgaactactgttctccctgctctcaggatacagagagatgttgtgcagggctcattttgagttttcgactgtatatatatcgagatatatatgtttttcagctgtatttagcagcttaaacttgagcctgcattggttggtgattactacaactcgaatgggactaggagatgttaaatttaagaaaggtactacatgaaattgcccactgggagatgttaaaattaagaaagatacatgataaacagccgctaaaaatatgagctaaccatcacgatttggggttggtatgataattaatgcattttactaccttagaaaagataaagtacttcttggaactccggtcataaatatttgattttgatgttaaaaattagatttgatctctgaccatagataacttctcaagtgcttaatttataaaaaaaataaaaaagtttttttttgcggggaaaaaataaaaaaaataaaaaaatatataagtttgactaaatcttatctaaaatttaatcatttatgactggagtgagtactttttatatgctaataaaaacactccctctcatcatgaaagttgaggacaaagattctatcaaacttttgaaaaatttgaacaactttatattaaacaagttatttaatctactaataagtttgtaatattatgatagcacttttcaagcaactaggaaggaagcccgcgcggatgcgcgggcattttatttattgttttatataatagtgctaaaacaagtcatatctcactatttctacgtcgtgagatagatcgtagacttcaatatacttaaattataagaacgtctcccagaattaaaaacactttgtcccaattacatataaattctatcgtaacaactcattatcactattttaaaagctcgctaactatcaatacatgaaattgcgcataataaaataagcctaatatatcattaatacactacttagctaagtgtttatgtctcacttatttccaaatccacatataaatattcttaaaaatatcactaacgggtgaagccggtcatagccgtagatactttctttctctattaccttaaaagttgggtagctgtgtcccctcaagatcagcccgaagcacatattataatttatctattatatattaataatatattaaatttcctactaacgctcctacgccatcacgtggtactctacaaacgttcctacatcaccacatgacgctataataaattagagaaaatcatagatattcggagaaaaaaataatatgtagtatttatttttacttaaattgatgggcctattattttataccattatattagatcttacttaaaaaaataaaaatgtaatttgtcttcccgtcataatccccatccacgtgcgagagaaaatgcatacgttcgtcatgttcactaggaaaaatgtatgtacataaagttcaccaggtacgtacagttcatcgggaaaaagatacagccgaaagaaaaaaaaaactcaaaacaaacatacctatatatataggatgttggaaaatatacagtacaaatcacatacgtaatggaaaccttagaactaccgttggatctgacaatgaacacatgagatttgtccatgtcacttacatatattccttagtatgattggaaaagaaaattcaaccatctttgaattaggatactccatgttagagaaagctaaaatatattacttccttttttcttataacatttgaccatttatcttattaaaaagttgtataaatatgtaaaattataaattgagattatagattgttgatcataaaacaagtcatggtaaaaaaaatatcatttatattttttaatacaaatggtaagatgtcatatcaaaattcaatggcatcatacagccactcaactcggccatttgtacgccacgttagagggtaaataacgagtccaccaatttaaatgaaaatcgatggtgagattatatagtaccatgtgatggcctaggagcatttgtagcagcgtcatatggtgacttaggaatattcatataaagtttaatgaacgtttagtatataatagtttttcttgctgcgaatagtagtaccgaagctttatttctttttcaatctaacgtacgtttgtatatgtacttatgtttttttcacggttagtatatatatacatctaatctcatggtttaaaataacgggtccgctaatttaaatgaaaatcgacagtgagattatatagtaccacatggcggtttaggagtatttgtaggaacgccaatatgaagacttagtactgttttgtagatcacaaattggatatataatttaaaaataatttgaaaagatgaacatttaaagatggttgatttgatatttatattatagatctagtttaacactgcatctatatatttgtgaagtaatatatttcatctttatatcgttgatagttctattttaaagaccgtcgatttttttgatggtactaagtacttatattttattttggcttatagtaagtacgtgcatatatattttttcttccggcaaacattatgcacatgagaaaggtattacatatttaatagtaaaaaataacaggtccaataatttataaatcgataacatatatggataaaataatggatcgaaaatcgttcaattgtatgtgtatatttgtgggccaatatatctttatattgtagagcgatatttgcttttttgatagtactaagcatgtatgctttattttggttgtcgtatgtacgtacataccttctattcctccggcaaacagtacagagaaagttattatatatatatatagatataatgtattaactgaaaatcgacggcatgtatatatctaatctaacggtataaaataatgggtccaccaatttaaatgaaaatcgacagtgagattagactgtgccacgtggcagcttaagagcgtttgtaggaaatttaatggacttttagtatataatagatagatagatagatagatagatagatagatagatagatagatagatagatagatagatagattctacgcatacccttttttcttaaaaaatagtaagcatttgagaaattatttgtgttcaaagtttcaaaagatacgaccagctcatattctaaacattaaatatctaatgtacatgtccatttcttataaataaaaacgtacaataatattatattggcactgcggccggtagaaaattctcttgggaattactgcccattaattaactgatcattaattgtgcagataagatgagtgagatagagatatggctgcatcaacgacggacaagtatagctttgccgtgcatcgagagcgacacgctgtcgcgtacgagagtacgtagcgcgaatatttaagcagcccggcacaaacacagctaatccaattgctgtcttccacaaaaccaactgattacttagtactgtaacgtcattaatttacaaaaaggaaacgtccaaactacgcacaaaaacagaaattttgtgcacaaaattcgcaaacaagaaccggaattttctttaaaacactgttcaaacgagctcacaacttgcatatatacacacagatagtatactaacccttagaaacgctcaaatatacaccatacccttatatattacatcttcaagagattagatcggtttatcttacgattgataaaatcattataaacgtctcctctcgttatcgacgggtatatcatctatcactaaaaggataattaaccgtaaatacgagctacaaacacctgtgtcaagtttacgatttacccagcataatcatcatcatagagttatgctgacacggcaatttaatcaggtcggcatctttgttctagcctgaaaacgccctacaagcgaaaatctgggtcgaaatggcgtcgagaagtgcagggtcacgatcgagtagtcgttttcaagtgttttcttttcttttgtaataagtaaggagacaatcaaacatgtactactaatattaatcgattccggccggctatgatcttcctcctaatcgtcccaaccgatgacgggatttttgacacgtattggctgccaaccatctcatcacctctgcattttcagaggttttatgaaattattatatatccacaaaataattaaagcttagggagttgggatccaggtactcggtttaatttacatccatgggtgacttagatcaagtttagtatagctaactaatagctctaaaacatatataattaatttaatagttaattcatacaatagttacctgtaaacatatattacactattaatatctggttccacctgttatatacatattatatcttggagtccgtgctatcgctggctataaatatgtagtccactgctcttctctcttaccccctccattccaaaatatagggcacaactaatttttaaagtggtttcataatatagggcgtgtatgcatgcatgtaattaattagcacattctctcctctaaattattattattttaaatcatatactcacaagatccttaattctattagttgcatgtattgtattaattaggtgattcatgacaacaatgagatattaattattttttggtctttgggttaagggtggttgtgtcttatattttggaacggagggagtattttttatctttttaaaatatatttatagttagtttatagtagtttgctattgtatctactcttaggattgccatcagaagaaggcgtggacaaatgttttaattggcgagagatgcttgatggtgtgtgtggatgtgtgtgtatgtccatcatttaaaaaaaaagaataaatgtaatgttatactctcgaatgattgtgcttcacctcattgcatgtatgaaatgctcaccatatataagcaaacaaataatatatattttttatatgtccatgaaatttcagccaatgctttttacaggctcgctccgtcacatatcgtaaattttggttttgatctttctatacccacactaattaatacgcgtagtgtctcaagccatcgttacttaattagttagttaaacagataaggatactttacacatcaataatgcggcaccatgcatgtacgtacatcaccacttgctatttattttgtaggttttaataagaaccaactgcttagttcgaaagaaaattaaattagctaactaatgcatcaaatgatgttagactagtttagattatattagagcgtgggggtcacggttcagattgtagtgtgtcattatgtgcatgagtgtaagtcccacgttctgtcagcgttcaattttgagtcctatcttcttcgtagtattatattacgacaaaagagaattcaaatgacttgaactaactcaatcattcaagcgcggaaatcaggatttaaaacccacctttgtttagttaattcctcattaaaaaagtaaaaagattgagaaagatttattatatatccatcgaggtgtgaaattaattctttttaattcccttcatctcataaggagtaacccagaacaatctcgataacgaattggttaattttgcgtctacgatcaataccagttttttccttcacctgggctaggagtgtagattctccgacaaacaaacgaaattcatgttgaggaatgcaaattttgtcccccactctgatggcctttatcgccattggattctgttctttttctgatcttaaaggtccagccaacttgtagttatgctgtactctagtagcctttcatttgatagagacggtttataatagcaaatccaaatcgcaataaatcaaatagttgatgtagatggcaatctaaccaaaatttagatcaccacgagagggttttgaagcgtcaatagaatccaaacagtttatgcatagctggcaagcatttcctggcatgcgtatcatataattggccacaatgttttacagaattttgaaaaggaaatgaagttaaggacacaactgttgaagacgtcatttcttccagggtttcatttgcctttcactgttacaattgttcaagcacatgatttgacttctttttttaaaaaaagataatagaattcattgtgtcctttatttcatccaatctacaactcgttattactgcctccgtcccaaaataaacgcagccatgagtttttgtgctcaactttgatcgtccgtcttatttgaaatttttttatgattagtatttttattgatattagaatataaaacatgaatagtattttatgcgtgactattttttttagtttttttaaaaaaataataaataagacgaatgattaaagttggaaaaaaaaactcatggctgcacttattttaagacggagggagtaccaagtttgtagtttgaacgaacgcttattacttatcacagcttatggatcataagaaacctaattgaaacaccatcctaaagacatacaaagataacacacctctactttcctaactcacctttctcgtttaccgcgtgcacgcttttcaaactgctaaacggtatttttttaaaaaaaaaaattctatatgaaagttactatctttcaaatttattttaactaatactgaattaatcatggacttaacgcttcttcgtttcacttgctatggagtgagggttgcaacacaccttatatatgtttgtcctcctcaaatacgatacctaaaaacagagacaacactatatgtttgtcgtcctcaaatataaacactactataaaaaccatttttcctaacatagaagatcttattttcgaaggcggacatgaccctcagagccaaatgactatctacaaaaatataaatcggggtgaaatttaatgtccgtctgcgaaaatattttcgcagacggtccacttaagcggcgcaggcggaccacttcacaggcgccgcttaagtggtacgcccgcgaaaatagacttaatataaatagacaggcgggcctaaattttttctaagtcccctcacatcttctcctctcccctcccctgccctcacctctcctcctctcctctcctcccctcctctcccctctccccggccgccggccggaggcggcggcgtgtgctcccggcggaggaggcgaggcggcgcggtggctgtgctcccggcagtggcagcgaggaggcgcagccgaggagggcggtgcggccgaagttcgggcggcggcgtcggctcccctcccccctccctcccagatctggccggaggagggaggggggaggccgccggtggcggcaacggtgtggagcggcagcggcggcggcggtgacggcgctgtccgggcggcggcggcggctcccctccccctccctcccagatctggccggaggagggaggggggaggccggcggcggcggcgacggcgctgtccgggcggcggcggcggcatggagcggcgacggtgcagtccgggcggtggcggcgcgggccgggcggcggcggcggcggcggctcctggcgcgattttcttttgttcgttccttttattttcgcaggcgggccgttgccccaactgcgcagtcgtcgtggtgcaggcggacctctctctcgcctgcaaaaatgagttttggccgcctccaaaaatgccttttctagtagtgaaaaacaaattctcaaaattagagtccaatcattctactgattagaacttacacacatcaccgtctataattgacgtcgaaccaaagcgaaagatatcggaaactgaatttcaaaccagccgctcatgcatgcaaatatagccgcgtaacgcacatggaagccgatggcagccatcaagcggccaccgcatgaacacacaaaacgctggacaacgaaacgcctccgtcgtggttgtgagatgaggcggcggaaagttcgacgagagggacgagacatcgtggctgtgagattaggcatgatttgatcgtttgcctatagaaagttaatttagtacccatccatcttcatacataatgggctcaaaattatttagcagaatttaaggtcaaggtgaaattagtttcatgctattcagaatttacttaaccaaaaatagattactcctagcgatgcaaactatcaatgagcaataaatatactctaaactcaaggtaaaatatagagatccgaaatatccaatctaccatatagttcatattcattatgtgacacatccaactatctaaaaccacccgatgaattacatccgatggcaccggtgctcccacgcagatcgcgcctctcctgcagctccctccgtatcaatccaacggcccacgtcgctcccacctccctcaccccaccgcgccctctcttcgccgtctgacccgtcagccaccatgcgccgtctccgccccccacgaagcttgcggctcgggtccgtctcgccaccgccgccatcgttccgctgctcagggccgggccgacgcaccgctgtcccgtgccgccaccaccgtattcgtcgctcgggtctttctccgccgtctccacccgctcgggaccgccgcgaatcgtcgcccacctcgccgtcccctatctccaccgcaagaacaccgtcggcagcctcggcggtctactctgcgccggtctcctccgcgtcatctcctcgctcgtgccgcctctgccatcccctccgttcagcaccccccctcctccccccgtcttcccttccgtccttccgtccatccagcgcgctggcgatcctccacccagggcctggcgtcccatcgatgatttagggcgtcgcgggtcctccgttcagggcaccaccggccatccgtccagtgcacggtctccccaatccagcatacaggtgctacttcccctcagcgccaggtgagcaaattctgtttaatttggtatcacttggtttggttgtagtgtagcaattgctgcttaaatgatgaagaagtgcaaaccaaatatttctggaaggtactgcagagtttgattgagtgtttgaaaatatagttcgttcagtttgttgtatgtcttgaatcctgataggatcacctctgccaactgagtgcttctgacggagtcaagcatcttgatgcctgcaatgtttctggcttttgacattccttgcatgcttgacactcatccaatcggattgtaaggtggcttttctgaattttgtgatgatgaaaatcaccatggtgtacatgttcactgctagcattgtgtggtttgtattaatgctacaaaatgccttgctgctcatgaactgcttgacaaaatgcctctcaatgttctatctaaaattctgagcatgttaatatgtgtctccccgtaagtttagatggtcataatttgtgctggttaaatatcctaaaagagttcttaaaaactgatatttgatcaaatattttagtgattctatcgtgcatattaattccctgtagaaatattatatacatattagtagagtagattatggagagttgctaaaaattgatcgccaaccgtttgaagctcactttgaagatctactgcgaaagatggcttcatgttaccagaagacaaggcaaggcatcaccacgtaacagaaagaagagtagagaaaaagaatgatatcaaccgccatttcggctgtgtttagtttctaaaattgatgagaagtttggagaaagttggtagtttggaaaaaaagttaggagttcatgtgtgtagaaaaattttggataacactaacgatgtccagcttcttctcattatgacagcaggagggaacacagatgctttttgtgtatttagtcaataactcagcttactggatgcttatattttatattctgcaatgtaaagagtagatagcatacttgagaatcattggtcgtcactgcattataattgtacatcatatatcctaggaaatattggatcaattgcaaggacatgtgtgcagcgtgagcagttggtgtgcatcttatcggggttaaggttagtgtttattgaaaaatacattgaattatgtttcttccttttctttgttatgttattcatctggtactacatgtgaacggcaaatttactttgtaagcattttcagccattgggtttaaaggtagacaacacaaagctctgtgtgctgtattgggttattgggcatatcctatggttttatgccagatatgccaaatttccctcttctgtgcattaatatagttaccaaatatgcatgaattttgaaccactgtttttttctctacatcaggatggagaaaaatggttatataagcaactaagcaatgtatttttggtagtgaagtgtacataatggatacagcatcacttgttatcctgatatatttatttaagatggttttcttgcatgtttggtagtgcaaatggacaccatcaaattgccaatttgccatgatcttggtgcgtgtatggaatcaagtagaatggtagtctcctgcaattgctccacgatgactgaatccacgcggaaggctgtccatttttggcagttcagacttagagagaggttagcattggcctattctttggataggtttaggtcatttatgtgttgagtaaaatttggctaagaagctacggcatatctgttttacgaatggaaaaaatgtagctattttttcatgtgtccttgttgcttgattggtcaggcaagttgccaagttattgctccgtattgcaaattcatcttggtaccatattaactttgacaatctgctttttttggtgtatcaataaatcaagtaaataatgatgcaatgaactcttctgatggacaagcaacagaaaatttacttgataactatattgtttggacgtatgttctggccaataatcttgattccttcttatatcagtccatccttatccttgacgccttatcagtacactgtaatgctcatactgattgtgctggctgagacctaggcgggggccaaggccttcatttaggtcagtacacaccgcctcaggaggtttattccttgtccggtacatatggttgggatgttggatccatttcatttatttctgcaggatgagattgtgaacaatggattatctgttattaggcttgggatgctggtctgatgcaaattactgtagattattcaagtcaaagttactatagtttttttttactgttggagttctgtttcagtgccaaatattcgctgagcatgatgttgtgttgcagtggtgccctaattgcgatttcaatgggatgttctagacagatgtgtggagtggggtggaggagaagcgtagtcgatgatggtgaaacacagcgtgtttgaggaacaaggtgatcgacttgaagggcgttgccagcaaccaggctgcttctttgaacaccttggttaggtaatatattcaagctatgttagatggaaattacttttatggaaataggtgcatttgtgatagcccatatattatttctttatagttattagtgcaattacaattatttagcatgcaagctaatagtacttctaatgaggctacaaatgcatatcatacttatatatgtttgtccataacgtgttgtttagaacagcttaaacaaaccaagcaggaataatttttatttatgtttcctgatcaattaggaagtatatttacaaacgatggcatatgggataagaggatttcctttctttttgtgctatgaatcccatcaaatttctgctatttttagttcacgcaggagaagcaggagaagagtatacaccgtgcttttgctctcagtattgcgaaccagctcacaaatatattccgtgaccgagagaagtgccaatacaatagttttaggaagttgtgttcgatgatcagttctgagcaactgagccccttgtagagttgtccccattgcagtggataaaattaccaagtgcctaacacacattccatcagaagtacaacttgggttttgaaagacaaaaaaattgctatgtaattaacaatgtataaaaaatctatattgttctttttttcaatccatncttgatatatatctcattctcaaacatatatcgttttctattattctgatttgaattatctaatgctgccgtagcgttagcacgtgtatgttactagtatttaaggatggagaaagtacttgttctttgtaacatatggattttgtagtatttttgtgttttaaagagatctatttaaacggaaacaatttgcattgagcattcgacgcgagacgaaacatcgggcggttacgccatgtgggcccgcatcgatttaaccataacggctcgaccttttcatcttccttaatcctaattattctcacattttctcttaccttcctagctattgaacaggttcatcgggatattggcagaaccgccgttgctggtggccacgactgcaacaatggtagcagggtgttcttgatctggtcagacgctagcttccggaaccacacgattgagcacgtattgtcgagggtggcagcgatgaggttgacatttgtaggggaggtggagctggcaccagaacctaccttaggagcactcctcccgatgctagtggctgtcgcccttccactcctcctgtagtcgccaagctgtcgcatccggttctacgccaccttcatccgcatgtcctccttcctcatctccggcaagtcaacaataatctcgtgcgcgtagctagccagcatcgtcggtctgattcgagagttacattttgttttgattcaatgttctgatttgagtgtttcattttgttttgttttcatgtttcatccattgatttcttggtgttgcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgtgctgcgacgcgagatgtatgtatgcatcctccaaagtcttttttcgcggcatgcaatcctgaaaagtaatacctctgtctcacaataaatattcgtgcccaacatttgaccgtccgtcttattagaaaattttgtgaaaaatttgaaaatatttagttacacataaagtactattcatattttatcatctaatagcaataaaaataataattattaaaaaattttaaataagatgaacaatcaaatattaaacgtgaatatataaaactatatttattttgggacggatggagtagtctgttggctcgcgccttgatggcatggcatctttttctctcttgtgctgatgctgaccaagacggcacatgtgctgatgtgcctgcgtgcagtagtttctttggctggctgctggttttggctacatcaggccgtgtaatggcacatcatgcacacgcacgaatctgatggatacagagccgctagtccaagcagtactgctaatagcgggcctatctcccgtgctttcgtagctcctccctcctactactactgtgtaggagtagtgtgtggatggataggatacggatcgatggcactgtgcctgtctgttctgcacgacggaggacaagttgtgggttgcgtttccgcgtcatactccgtctctgccaaaataaatgtagtttttcatatcttacgttttcgtttgaccgtttattttatttgcaatttttttacgattaatatttttattgttatttgatgataaaatataaatagcactttatatgtgactaatttattttaattttctcataaaatttttaaataagacggatggtcaaacgttggatacggattcccataactgcacttattttgaaacagagatagtacgtacctagctagagtaagggcagttaggccttgcagtgagcggacattggttttggttcgttgtcataccggagctaggtcaatttatcatacccattcccccgcgaggctcctcatgccttagcaacaagctaagatagaggcacggtttgcgagccgtgttgggcgaggccatgtctctgtgacatggtctcgcccttcttattatgaagcttataatgatgtcagcttaattcgtcagatctaaaatgatggcgcaatggatgaaatcaggaaaaacggaacatgtatggtggagaagaaagatggacctaccaccacggatatcaccacatgaatgcaaaggagaaagaagatggatctaccaccacaggacactccacaacctccttctccctcctcacccctacccccaccagccggaaaagaagaaatataaaatgtcaggggctgacatgaaaaattaaagctaccacttaaaaccaatttgtcttatattcgctcaataaaaaaaccatttctaggatggagggtttttttaagacggagggagtagaagagatatggtactaacctacgtggtgcacactctcttctcagtggccactcataggagtagcctcgtgtagttatctctagagagatggtatagattgctcccatagtgcaaatatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttggccaccctagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactcctcttaggccatacacagtaaacgctctaatgtttacaggatgtctggatctaagattttctaatttttagagatttttttattttactttcaatgaaaacatcacctatctcatcgtgcacttattcgttcatcggctacatccaaaatttaggttttaaaaattaattttaagctaatttgaagctttctattacaatctatttttcatacttgacttttgaaccgtgaatactatcgatatggaagtcttacatataaattatttttattgcttagttggttttacaaaccgtagtctaatcaaggactcctttaatcaatcatcatagccgaattcgttggttgaagttttcccaatcatccttttatggaacgtttctttttctaaaaattctcacggctccaaatagaggtccttgtagaaaattgaatgtgttgttgcttgttgttggactgggatactatagagctcaaagcctcaaattacgtgcaagacgacgttcctactcctgcgtaccgctcgatgttggttggcctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgctgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaactctagttcactacgaccatgaaaccccttttacactattaacctttttctttttttttgcaccattggattatagagatatgtggacatttttcaaataactgcccgcctatcaatgtattttttgttttggtccaagggctcgtcttcttctctctgtatcatccctctctcgtactgagtaaaaaaaacactcatgcttaacattaggagtatttacttatcacttaaaaccaagagtaaagtttttactctctgtggattttgagagtaaaaatattacaaacggttgaatcttatcagtaaaaaattacaagtggttaaatttaagagtaaacaaaatacacacaaaaaaaagtaggtggcagcaaggtcacaacttggcgaggtagctgcggcacatccacctgcgatctcgatgacagtttggtaagggataaccgagaagacaatgctaagaggtactgtggcgttgcgactagcgggagctagcttccgagccaacttcggtggcacatgggcgagtggatctggggtggcgcagcatgcgacgaggagcaggacaggtggggtgaggaccaggagctctcaattcagtgtccgggatgatgaggtggccgctgcttgcacatcttgccggtcaccggcgctgcattggtcattgctgctgccaccgctcgcatgcctcgctagtggccctaattccttgtgttgcctctcgcatgccttgctgttgtctcggtggcgaaaggaggtgggagagcgagagatgcagcgtgagagggagaatgggtgccagggactaaatgcaaaaaatggtgagaaaggaggatgtcatctggtgcacatatgttagatctaacggtgaagatgggggttgcgtgtttccacccaaatgagaggttgcatctgaaactttccgcaattacaatggatgccaagtataattttgttttggttagtttagttggtaacatataacatatgaagaaatcacaaatcccagtcattgggagtggaggatgcgcggccagtgcccatataccaccatcaccgtcatcacggttgcatttgctgtggacgttggtggcagccggtacggagctgtgctggtgggtcgatggtgggctacaaaggtagagtacgtgcgagcggcggtgcggctaagcattgagccctacagtttgcggacgtccgcgcagcggtgcagtacctgcctctgcggctctacctagggtgcgggaattgtgtattactttgcatcattcgaccatttcggtaaactgatatagactatcaactgtcctattacctctgttttatagtgttttatatcataagccgctttgatttttttcatagtcaaacttttaagtttgacttagtttattaaaaaaaatatagcaatactttcaatgcaaaacaagcatattatcaaaatatatttaatattgtgtttaataagatatacatgttactaaattttttatatgaacttgtttaaatttaaataaattcaattagaaaaaaattcaactgcgacaatatgaaacagagggagttcagttactgcgagtcgataaccaaacttttttggtctcggtcatttccacgttttggtgtgagtttgtttggttcggttatttttagccagccctatatgtatagagcaatagttaatgaacgcatgcacgtattaaccacaccctaacgttggaaatattaataggcctgatgcatgacaaattgcatgcgcgcacctgtgccggggtcgttgcacgtattctcgcgatcattgccgaacagtcaatgtcaattatatcgacggccggtttgcgttagcgtttgcttaactagtgtactagtactaaatagaagtattgtactactagtatatgtagcgtattcatcgtgaggtaatgatatgatgtcgatcgatcgatcgatctaccgacctgttgatcatcagtgactgaatttaaagctgctttttatttgaaaaccattgctatcttccgtccaagttacgtatgtaccactgccgagcagttattttgcttttttctaagaaaaataaaaaataatatgattttttattgttttagtttctagtaatatgtaaaatttactagctcttctacgtcgtattaaagttgctagtcacattcatagtatgaaaaatttctaaccatgccgatatcattttcaataataaaaagtactttttagaaatttacaaaaatcaccctataagctagaagtttgatgtttcaccccataaattattttgttgaaaatgcctgcccacctacttagttttgtatcaaaaccacctcggtatgcacgtgtttaaccgaatcaacgtgttttcataaattatgagccatcaatgtagtctttaccaaatttaaatacttcaataatatggtcttaatactttttagagattccataaataatgagagcttaaatattgttgaaccaagtttcacaatatgcataaaatagtttaataaaacatgaagaataaatataatgtaagtacttggataagattgactcgattagcatggcgtgtggtatatctatatcaacgataataggctgatttggttaagtacgtgcgtcctaacatgacttttacaccaaaacttagtaaaggtgtgtatttgtaacaaaaataacctatgggatggtttctgtaattttctcttttttctcgaccgttttcatccctgaatacacaggatacagacgatgaaaaatattacgccatcgatcgatctcctgtgtcctgtccaattaaaactcgcgggaagccggcccaatacaggtgttggcagactggcagcacgcggcccacgtacccttcatgcatgaacggaacggctcccacttttgagtcttttgatccaccacaattttaagcacaatatgtcaataaggttgggttcttccttccattttcccaacccacctctctccattttcacgcgcacacttttcaaactggtaaaaagtatgatttatacaaaaactttgtatatgaaagttgttttaaaaaacatattaatctattttttttaaaaaaatagttaatacttaattaatcatgaaataatacgagcttcgttttacgtgccgggggagaaggagttcccaacccatcctcccgaacacaaccttagtccacttgctatacctcaacctcgattctacgtcgagtttgtttgaagccccttatctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaaacgtaaagttgagggacggcaaatggacttttttccattttaagcagcggcggtagggttggtaggtaggaagatccggcgccatgtacaaacgtcgccgtcggtcggtatcgttttccatcttcgacgtacacgttgatgttactaatacgtagtactggtaccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgat

SEQ ID NO: 75276 - DNA, 5046 bp, Oryza sativa
tttgctgttattttgtaccttgcactttgtttttgtcatactcaggtcgcggtttcagttgtgacatgaactgcatttttttttcagatcatgagtgtagtaagaaaattaagcccggtttcacaacatgttaagtacttcttgcagatacatgttcactttttttctcaaacaaaataattgtgcattactcgaataaaaatgaggatacaagacattgcaatgatgcaagaggatcatgctcacaaaacaaacttcatgagtttgaacctcaagacagcagtgcatgtactactgctattacatagaagacatgtattctgttgcctcagagaggcctaactaagaatcttaaacaacgacactttaattttgccccaaagaggcctgattaagtagtttaaaaaaactaattcagttccttggtgccctgcaatagcattagcatatcccccaccggaagaaaactctggcagcatatcatagaaccaccaagtgcttgaggaaggctgtaaccatcagcaacttgacctataaatttccatcgatagtgtccaattcagcaagccagtcgatgtcagccaaaaactggtcatcaataggaggagaacacaatggttcagcagtagcaatgccatcatcgctgacatcagccaacaactccaaaaggaaactgtcgctgaaggttggggtatggactgcattgtcattctgaggttgctctacgggagtgcatgcttgcacttcagcgggtggctgatccccaaaacgcatttgccattgcgtcagcaggggaaccgccgatgattgattagtaagtggctgttgcaccaatggagcatgcattggaggaggtgccactgtgttctgcggcggtgatactggtggtaattgttgggatggcactaactctggagaaggaaacagtggtggccgtagcggaaatatctgagaccatggtgagcccggcactggaggcggaggtatcatcggaactcctgatgtccctccaggaagtaatggagtgaatggacggtgtgaggccaagaagcgagaacacgagggctgctgatgtgcccacgcacttgatccaccaatttgcagcttgctgccacgacgtaggggaggcagccgcttcttgaaatcttgctggagcggcaagagtacatctaaaagttcacgcatatcatcgtggctgagatcctctagcctggagaatagatgcttggccatacccatacctaagctctcttcttgggcctccttgaagcgctggattgattcttcagtcttcttgtccttctcttcttcttcattctctagctggaccagctcactttgcattgacgtaagcttggccttcagttgttcatcggcaaatggctctgcctcagatacaaaagcatcgacaacaggtttcaccgatggtgccccaaagaattgtgcctgttgtaaataatgcaataatataaccaaatatttcaaacgaattccatttaacattacaataataataatacaattcaaggtacagcatgatgacatattcataagcatagtgggacaacagtaccttattgctgtcatgtaggcaaattgcgacgcttgcatcagtgagaagggagaggtcatttgcaagcttgaacagcccatcacgcctcttgctgagggtgaggctgcgatctctatcctcttcgatgtacctcacgcctttccttctacccctcctcaccatacttgactagtaaatagagagagaatactgtatagtatacggtgtagcttgctggctacatatatatagcgagaagggcatcctcaaatagaaatcaaattaatacgataccaacaatatctaattatagttttatggtgagagacatttttggatgttgaatggcctaaaaacgaaagcgattaactacataccatgtagctaggttgatttatatggtatgaaatgcatcctccaatggataatgggaactaccgcgtgtaagttgcaaatagttcctacaaatctacagcgagaaagccattttccaatggaggatgggaactactaatcgattatagcttgttggagacctattttgagaaaaccatactccagtggagaatggaaattgctatgtttgcaaatagcttagtggagatgtatgaggggaagacattcgcaagggagaacgagaattgcaattttattgctgcaaatagcttgctaaaatctatgagaaaaccatactccaatgagattggatactactatgtgaatgctatagaaaacttcctatagatcacatttaccaggaaatgtgctccaatgattgaaaaagaagtttcaatccttggaaattgatgcctaaattctgtctcataaatgtcctggaatggagaatgaaatccactaagctataactgcaaatagctttgcagagatctccgtttagcaggtatcctcaacaattggataatagatggactactattagtattaagtgattactgcaaatagttttatagagatctacgtttagcaacaaaggtatcctcagtcggataatagatactattaaatgattactactgcaaatagttttatagagatctgtgtcgagcaaaaatgtctcctttgatcgatagaagtgataggcaccttatatagaaggaagtaagggttgtacatatcaagatgcttacgttttatttgtttggtggataaacactctcataaaagctccacacaatatcactgacaggtggtacatccttcacattggcatggtgagctccattgtaagtaccagttacgaagtctttttgcacacaacactttgtctttagcatggtaacataattccaattcatcgaagtgtccacaaatgcgtaattctaccaatacatgctgatgagagtacaacttttggacattcaaatatttgcagataatccacacatgccaaaggaaagaaaaagaaaagcaacagggaaaaatagggataagttatttgattcataggttgaagagtagcttttatgtattattctaaataaatggattgagattaagtgtctggcattaattaattgaatgtctattggcagtgagtagaataaaacttgtattagatgcaaaaaattccttggggtctctgcctagatcatcccttgatgtatcagcgtgtataaatcgtttgatcattgaataataaattatatggtgtatgtttaagcaacagtgacagaaggtagaagacagattgttgttggaaagataagatttctgccttgatttccttctctggtattcctaaagaaaaaagaacatacttgctcagatccagactaatatagtagaaaatgccaccttgttgcaggaccctattgtgcaaacctaataatgctaggttagtgatccttgatttgaattatgatatatgtttgcttctaattggctgtggaagttggagaattctgatccagactagtatagtaaaaaaatgccaccttgttgctggaccctattgtgcaaacctaataatgctaggttagtgttcgttgatttgaatcttatgatatacgtctgctttctaattggctgtggaagttggagaattctgaaggacctcgacaagagatgataagtatgcaggcaaggtccactccattgatcactgcaaatataaagcttctgattctcgttttatcttgtttggtggctgttaaggatgtgtttttgttcttttgtaaaaaggtaactaaccggtaatgatctgcataggcatttcttggaagcagacaatttccttaacacttaagttaattttgacgggttaactttgggttttttggtgatctgaaaaagcaacagtgctgcttgttttcggaaagcgttgctcactggtctcactgagattgtgttcaaatgtgctattgtattgagttttggcttcccttgcagaaagaagaacgtcgtgtggaacttcaagtgggattacggtgagcgagcgggaagccactcctgggaggcagtctgtgcatttaactggaatggtttttccttttggagttgctgaatgctgattgttgacttctagaaaggtaccaaattggcaaatttggctctccatctctccacagaattccctctccatattccagtgcactccaacagtctctccatatcccaacggctagttcgctctccatattctaacacactccaacagactctccatattccactctccatatcccaacggctagttcgctctccatattccaacacactccaacagactccatattacaacagctagttcccaacagctattttgcaacactatatataggctccttctctacctctctaccaggctaccacaacattcttcttccttgtttgcttcttcacctccacaccacaaatgaatcactttggcttgagcttatccatgcaaattgtgttggagtcgtcgtcttcagatgacgacgatgaattcatggctgcaacaatactcctagtacacgcacactgccaaaccaggagacgacgacgacgacagtgatctgaaggcagaactaggcggaggcgacagagggaggagctggcgctgggtggagccggctatgcgtgggacgaggcggctgagctcaatgaagctcaggaggacacgccaccaagggaagaggcggccctggtaggggtgaggcggcagcagacggaggagccagagctggggggagccggcaatgcgcgggacgaggcagccaagctcaatggagctcaagaaacgcgcctccgaggcggcatgggacctcgagcctcagctcggtgctctgctagaagatggagatgatcatcaggatggagagtcacaggggctgccagatttagccacctgattctctcatttacatttagccagacagatggaatagcaatgcaaaaaaccaatctgttgagcacctgtttttgcatgtttgcttcttcttcttttgttcttttggcatggagaatgagatagcaagtcccttggagatgtt

SEQ ID NO: 75277 - DNA, 3379 bp, Oryza sativa
cggcgaaggaaccaaggttgaaggggcccttcagatccgggagaacgtggtgctcgctggtgatagggttgaagaggccgagaaggtggctggtcgcctctgaccagtcgttggagggggaaagccgcatcaggaggatgccgcggcgcgccgtcaggggctcgccgtcgtagctggaggggatgggggcgaagcggcggcgccggcaggaagccgaatgtcgaggccgagttgcgttgccggtggaagaagaagccgaggaggtcgccggcgcgctggccgccccagaggtcgcggaggaaggcgcgatcggtgaagcggcggcatgttgcggccagcatgaagaggctcttgacgttgcccacgcgggagaggacctggaggaggacgtcctccggcaatgccgccatgatgtcgttgtccgccatgggtgtgtgcacgtacgtacgtgcaaaggcctccgcgattgcatctagtagatgtattgcattgtataggagggtgaaatctggtgattaaaaatcaaaattctcatcttaatctcaccatcaattctctcgtgtaaactcccaatcctcttccctcgagttgcaaaacaagctgtgaaggtcgccgctgcaggccgaaacgcggctggatgttgggcctgtacagctgtactggatatcaactcttggtgatatctatacttctatagtctcggaatattactgcttgagatgtttacaggaaagagtccaacggatgacgtgttcagagattcattagatctgaataagtttaccaaggatgctcttccagacataacttcggagatagcagactcaacaatctggctgcatgtagaaccacgggataacattatacagagcagaatccaggagtgtctcgtttctgtcttcatgttaggcatatcctgcacaaagcaacagcctcaagagcgagcatcaataagagatgtagcagtagagatgcatgcactaagagatgtatacctcatgtttgccaattagcttgcataggtattactagaacagaaggaaaagcctccactgagacaccgaaaacagctacaatagccaagctcattggaaataatcctgaaataactttagtcacatgtagtgtttcagttagcaattgttctcacttctgagagctatatttctttgccagagtatcagaatcatacaatttaatgtaaaattcacctaattgtttccttcgtgcttaatttcattgtttccttcttcctgcttgattgaaatggtagagctcctactgtactggttccttcccaaaattcaccttacattgttagttcaaagtacaaaagcgccaacttccactagtaccaactagcaaacagcaagaatctatccaattcaagcaattgtgtttgtgtccacacataaaacgcatgagtaaaagtgtagaacaccaaacaagccaggagcagcattattcctgaagtgagttgccatgtcctcagttgctacgtatgcataccagaacatcaattttgttccagaaaatttcacagtatcgtagtaatctcaaacagaatgaacaccacaaacaagaaatcgagcaatcacaaaacaggaagcacatagaagtctagaagagcatcgttaatatctcagataaataagcaacagtttaccaaaagcagcgccacaaccgccaactacacactaataagacatccatttctaccactaccagatagtagacagaactaaatactaccaatagatggaatctaagcggaggtgaacttggtcacagccttggtgccctcggagacggcgtgcttggcgagctcgccggggaggacgaggcggacggaggtctggatctcccgtgaggtgatggtgggcttcttgttgtagcgcgcgagcttggcggactccccggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttccgccccgccttcttcccctcgccgctgctcttctcggccttgccggcggggagacgcttctccgccttgggcttcttccccgcgggggccttctcggccttctctgccgcgggctcctcctccgcgggcttcttcgcggccggcttcttctccgccttgggcgccatggatgcttctctcttcttctcggggaggggcaagcgggtccgtgggttttgctttggagcggtgtgtgctgatgtgttgcgagattgcggtgtggaaggaggacacgggtgcggtgagtttatagtgggtaaaagtgggcgctgattggtggagaggcttgtcccgcggatcgatgacgtggatgaatgtgtgacgtccggtgccttttcggttagacggctgcgatgcgtttccgtgcggatcgctgacgttgcaaagaaaaatgtgcagtgggccccgtttttggagcgctgtggtggtgggctgttctttctttgggttcaggttttgggctttttgccatggagtctgtaaccataaacagcatgtaaataagaagaaaataataattaaaaacagggtaaactctatatattttgattaataggtcagtttttcctgtttagacaaatcgaattttgagatgacactaagaattcagcaaacatttattgtcgtacaagataaatctctctgctagagaaaaatccaagaacatttcctctcacattctttctccttcctctttcatggttcagactgcaaacaaacacaacacaaaacaatggagagcgcagaaaaatcttgctcaaagattgaagcacctggtggtatttccagacaccttgttcaatcgttaaactcaataactatcttaccagacctgtaactgtgatcaccaacaaactcaatttccatatgtatcctgcagtcagaaacgcaacatttagttacagctgtgttctatcaatatattggccatagttttatatctagagattaaaaagtagggatacaccaaaataagtcatagtggacaacatacaaggaacttgatgataacctttggcaacggcgtgatcataactagtcttctgttatgcatctttgtgttacacatactcttcaggacatcactgagcacgcaaactctcacatttttttctgcaactagttatgtggagcccaaatgtcatttggtggtggcggcgccaccagaaacgtttaaaggagtaaagaaatacaaaaaatgccatacaccttggaacaaattagaccaatcctggcaattagtaagtttctacaatcttcacaaggaaatcccattttca

SEQ ID NO: 75278 - DNA, 4695 bp, Oryza sativa
cccctacaccattcatcatgtactcccataattaattaattgagacctatttaagctaatggtattattaattatatatttgattagtacattggagtacgtagaattctactgttgcaaaccacgccgatgcgtgctatcgataggagtaaaatactgtccgcgaagtctgaaacttgcacagtctttgacgcatgcttgcaggtcttcagaaaccacaagttcagaagaacccatcatccggccggccattattttaatctgccaatattccgtacgctgtcaaaagaagaagaaagaacagtcgaacaatgttgtacagctcgatccgcagaatcgatcagagtttagtacttactactataattgtttagcatgtagaattgattagaagtaagcactaaaagttcagaggaagtcaaggaagttcagaggaatcaattaacttgcagattaattcaacaaagctaccagctgatatatgctcctaatgatgatgattgccatgatcataaactttagattcttccatgctccatggtgaagtcttaagctagtttggctgtttatattagggcctacacataggtcctgattggatccggagggctatttaatagttcggaggatccaaacaggccatagttaaagttcagaaaaatgattgtccttttatctgaagaagtatgtactactactgttgcatgcaatgaacacgtacatgagagagtagatggatctgatcgatactgctactgatcatccagccttgcaaattatccaaggacaggacagggagacagaaaccaatcaatcagacgagaagatttgcgactcgacgaacggccggccgccatataggcaggattccaaacaaggccgcggtgataccgttgggttctcaaaaccgcgcttttaatttgattcatctgctcgccaattaatcttccaatctttgatctgtactgctccaatccactgttcgtatagtattaatttttagtaatttttagctcgccttggctacccatcttagtagagaagtaaagagagagaagaatggtactcttctcctatcataaatactaattgatttagcataaatttagatcatttttactggtactttgatacgtcatccctgtttcagtcgatttctaagtccgttctcttttagaaataagaagaagtcgtataaaaaatctctttaaaaaactcgtatgctaacttgagacgattggacttttaattgcagcttacaattttataaaaaaaatccaagcgaacaacagtaataatattaaaatagcccttcacccactgcaacacacgggcatttttttctagttatgataaatataaaaggttttgttactatggcaatgccttcttaaggtgaatctctgtagtgtaacattttgattttatcacaagtcaaacctctctgactttaatcttgtttatagaaaaaaacatcaacatcaacacatactaaattagattttatcaaaaccatcatgaaatatgtcttgacattgtatttatctgttagtgcatttttctataattcagtcaaagttagagaatctcactaaagacaaaaagaataattttcaatatgaaacagatgtggtgtatatttgataaactattgatcaaatgccaaaatatttataaccacagtaacagaatagcagtaaggcaaagccatacgatacgacgacagtcagcatctatcgtttgacccgtatataaatgcatggtacgaacgctaaaaaaccagcgttactacttgatgaaattattgatcagattggcagtagctaggcatgctttcatttgatgggtttttttttttactggcataggattcgccggagttgaggtgaaacttgtgttctttgtacggcgtgtccggccaacaaaagatgggcagcgttgagagccaatgcaaggcaaaagggttgagtttttatcggcagatatggaggccggaatggcgcagggcggtcggtcggccggccggattcgcgcgtcggagcatgggtcactactcactactgtagtcccttttttccctctgcaaaatccagccctgcaacctgcatcattcctgctctcatgttctatggcttcttgctgattcgttcaaaaaaaaatgcattgtactacatttgtagcatgagtctagctctgttttgaaaacgcgggattgaaaaaacagatgaatagaatttttttttaagattttgctaggaatacaagtgcaaaatataaagttccgaaaacggaatgatcgtttggttaggagaaaacgtaggaatcggatagtaaaagatatagactcaaagggaattttccaagaggttagagctcttgctaaccttttctccaaaatctctctctctctctctctctctctctctctatatatatatatatatatatatatatatatatatatatatatatatagtaaatttgtttggtgctccatggtgcccgggcaccattgttgaaattgagtatatacccaattcaaatgagtatgaaacttttttaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaaattttgaaaaatttgagtgattttgtgcattagataccatggtgtccgggcaccatggtgccccatatgagtgtcctatatatatgtcattccataggaacttcaaaggaaaggaaatgattcaacccttataaaggatttcataggaatttttcatataagattgaaatcctccaaatttactatgtttttttttttacaagtcaaaggggtctagtagttagaataccttatagctaaaaaaaacagaagaggatattaagttacatgcccagatagttcacatgaaggtttaaactgaagcataagctgagaagaaaagatagacaatttacttgtatttcaatagaggacgatacattgagatggatagcttaacatattacatatctgacaataaaaaatggccttccagaactgttgttgatacaaaccagaagatacaaatcaaatttcaaatactgagatggctgaatatggcggcccttgttctacaagttgggtcatctcagatgttgaggtaaaagatatcagtgattccattagacaaaatggggtattgcatcagcttcacagagcaaactacaagcctatacatctgctaaaaaaatatggttacatcattttgttttggcgtcacaggattgtgtacatactatcttctaccaccatctttcttcgaaaatatgcgcaagtttgcagtctgccggcgccattcatttatagggacctaaattcagtgggcacagcaaacatttgtgagtgaaggaaaaagttaaacatgtaatgtcatagctataaaatgaaaggcttactgctggaaacccgccatagtcaccgggtttctgaatatcctttgtcaccgaactatttgctgcaagccgaacctgtaaatggattgaggaaaaaaaaattgaatggttaaagggcctttagagttggtcaaggcttaaaagaatagattgagcaatgtagttaaatttgtaatacagataaacacaaaactgaatagagactgaagtagtattaaatcatgttagcaggaagctatgaaaaaagaacagagatgggaaaacagcacctttgaagcaatggagacgtgatcccgaattgccaccctaccacccaaggttacatagtcccccaatctgttgatacatgccaatgacacaagttactaaatctcaaaaagcaggcaaaataaacatttagtcaatgagatgaaggaatgcatacgttgcagaaccagcaattcctgcttgtccacaaatcatgcaacactttccaattactacattgtgaccaatctgcaagaggaactgtcaatttggacaacaagggcggcggaagtccaatcacattaagcagaatatccaatacctgaacaagattgtcaattttggtttcatctccaattactgtatctctccaactgcacttagtaaataatgatgaaaatttccgctcgcgggttaggttcaaccaaacatatattcacaaagaaagagctgatattacaaaatgtttggtatatttaaatcaaccatggagtggccaaaggaacatttgccatttcaaggctgacaaattacctccctctgtcaatacatgtatttgcacctatctccacatgatttccaatttttacatgcaacatctggagaagcataaagcttttcaacatatagccatatgatgtttcaattgaatccaaaacaaaacatctaaatacagtctatgagagtgatagtcatcaaacatttgtatcagaagtacttctcccatgtcactggcattttctcagtttcttttttctgtatctctgataccaggtaagcacattgggtgaacgtgacaaatgaaggactgagcatttccttatccttttaatacaaaatgaacc

SEQ ID NO: 75279 - DNA, 19388 bp, Oryza sativa
ggtgagtgtgtgcacgtaaggatagtatggggtgagtagtatgggttagatgagcttatggtgagtgtgtgcacgttgtgagcaaaaaaaagggatagtatgggggtgagtagtatgggttagatgagcttatggtgagtgtgtgcacgtaaggatagtatgggggtgagtagtatgggttagatgagcttatagtgagtgtgtgcacgttgtaagcgtctacgtttgtactgtgtttctcaaaaaaaatgagaaaaaaagatagtatgggttggatgagcttatgaggtgcatgaaaaacgaagcaacttttataggaataaattgaatattatatagtctttttataggaataaattgaatattatatagtcttttataggaataaattgaatattatatagtctctccatccaaaatgtagctattcctggctacaaagtattggccttataaagctaacaaatagtttaaaaataaaatctagatatgttgatgaagaaaaattttagaagaaagtattgctttagaaacgtaataggtgtcatctggatgatactttttgccctttacgtttctcatgcacaatatacgatacatgtctgcacagactaactccctaattctattaaaaatagcctgaaaaatacttggggataactactgaactaaacagtacaacgatcgaccatgcatgccgttatcagaggctaacaaagaacagtatcaccatgcataatgcgccgctagcctcatggtcctcctcccatttgtgcttggtcagcagcgccgccgatcggaacgtgaacaccaggaaggacacccctttccctagctcggcgacgtcgcgcaccacgttattgttcgccatgaggcgctggtagtcgccgccggcgccgacgagctggtactggccggtgaacccgtcgtcgttgtatccgcacctgaagtcgtagcgccgcccctcctcgtcgaacaccggcacctccagcccgtcgtcgccgtcgtagccgtcgtcgagcaccccgtccagctcgtcgtcggtgaagctctccgcgatgtggcgggcggcggcgccgccggagagggagaggcggccgagcgagaggtcggcctgggcattcgtgacgtcgccgtagtagacgcacgccggctccgacgcgccgagctcccgcaggcgcgacagcacggcggcgctctcgtcgcagacgtccccgatcttgatgtagctgtagtcggccggcggcaagccagctcggccgggcgcccgcagcttctccctccacctcgccagggccttcgcgaggttctcctccggcgtctggccggccgggtagctgacgcccagtgcctccacctgcgccgcgttcgccggcgtctggccggccgggtagctgatgccggcaagtgtctccacctgcgccgagttcgccggcgtctggccggcgcagtagctgtagctgatgcccagtctgtccccctgcgccgagttcgcttgacccatttctgaaagacagagggtggcgacgagcttcttcttctggattatcgtcgatctaatctcttttcttgatctgcgcttttctgtttttttttgtgcaagtatgcttcctatttatagcttagcaagcggctaagacgtactcggattcggataacccgcgagtcagtttcggaatataataagctagcgattcgtgcgttgcatggagtagtagttggtttcggaaacgggttatatatctgacactttctagtccggtaccgatactatttttaaggccttaacttgtccggcatgccaaaaatagcatgcgtctcttttcctatgcgctttttttaaaaaaaaacaaaaaaaaatctcaacgcagcgaatgtagtcctataaacctacctatgcaagtgatctccatttaatatagttattaccaattttctgttctatcgttgatccacatcattcagttcgattagatctcaacgatttgtcgattttccatgtcgcctgcatcaagttgatcggtagccgtttgatcagctctcaaaacgatcctgcgcgccacctcaatgtgtccacacccacgtcgaccggtggaaaagcccaataacagcccagcatttcccgaatctataaggaaaaagtacaccgaaggtccctcaacttgtcatcggataaaaaaaacgtcctcgaactgcaaaaccagatatgcggggtcccttaactgtacaaaaccggtcatctgagatccttcggcggttttgaccccggttttggtctacgtggcggctaagtcagcatgggacccacgtgggccccacatgtcaggatgccacctcatcaccactctcttatttccctctcttctccctttctctctttcacttttctcaggccggcgacgggcggcgctgtggggaggaggccgccggagggaggggagaggaggaggtccggcagccggtgtcgcgccggcggaggaaatgccgttgtccgcatccaacgagcacaccggccgctgccacaccttcctcctcccccacacgccggccgccgccacaccttcctcctcccctcagcctcgccgccgcccggaacaacgtcagctggggcacccggcgcccatggtggacgcgttcggatccggcaagggcacgccgacgggagtagtgccaacccccgcaaggagtcgaaggtcgtcgagatggccatgggcgaacggtgggcaacgtcaagcaggtcgcgggtgacggtggccggcggcggtggtggaggatgcggatccgtgctcggatctgaccgtcccgtggccggatccgaagctcccgcgttgaatcttgctgatggcgacgtggtaataatagtgtcggcggctggacggcggggaggcaactggcggcggggctgagtggtggtggcggcggagcccgagccctggtggtggtggtgatggtagcggccgccgccgacatcgccgatggcggagaggctacggcgaatccgaggcggcggcgccatgctcgtgctcatcctcctcgccgtcgtggcgtcggcgcagcaggagtacgaggtcacctcctcctcgtcctcctcgccgtcgcggcgcggcgcgggcgagggccatcggccgccgccttgggcgcagcaggagtacgacgtcacctccgccgccaccacgggtcctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcccagtcgcttgaagcatgtgtggtggagagaagaggggaaacacacgcgcgcgctcgctcgcctcgcctggcctggcctagcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacagcgtggagtccggataagttacgcgcgacttatccggttcggttacgcgcagtagagatcgtgcgggcgccctgatcaagcgacccttctctatataaaccgatccgccgtcttcacgcaatatatacgcaaaatcaatctagggtttgcctcatactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgatggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcgttatatgtctataatctcaacaatccaaaaaccttattataggcactgtgattttactatggctggttttgccgatgcactgaggccggataaattcaccggtgtgcattttaagagatggcagatcagggtcactctgtggctgacaactatgaaatgcttctgggtgagtactggcaaatctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatgaagcagtttcatgactacaaaatggcagacaaccgttctgtagtcgaacaggctcatgagatacaaaccatggctaaggaactcgaactccttaagtgtgtcttacccgacaaatttgtggccgggtgcattattgtaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttaccaactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttttgagtgcggaggcctgttccgcttttccctttctgatttctgcaataagtctgtgaaccatatttgtggcagtgtggatgatgaggttaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaatagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaataaactataggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtacctgataagactttgagtgaaacttccttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcccagtcgcttgaagcatgtgtggtggagagaagaggggaaacacacgcgcgcgctctctcgcctcgcctggcctggcctggcctggcagggcagggcagggcaggcggcgcgcgtacacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacagcgtggagtccggataagttacgcgcgacttatccggttcggttacgcgcagtagagatcgtgcgggcgccctgatcaagcgacccttctctatataaaccgatccgccgtcttcacgcaatatatacgcaaaatcaatctagggtttgcctcatactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcgttatatgtctataatctcaacaggtccctgcgacgcctactgtcacgcccagaaattcccgaatagaattccaagcagaatgtgcattaaaatccccgtccaggaccagccggggtacacaaacgacaatgttgacattcagatccacgtcttacaaacatcataaagtcttacataaatgcagcggaagaaaagaaaaacaacaggagctaagccttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaataggggtatgatgcagggaatcatcaaagaagagctaaagtggttcatttgcataaagcgagcatttataaacagagattgaaagatttaaacagttgtaataattaattaatattaatcatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacatatcggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattatcattagaaccaacagtctaaacattaatatgattttccccattgtgaactagttgaactaagcatggctaagcaattcctagtccaaactctaatcatgttataaccccaagctaacaaaggagcatgatatccaaaaacatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcaaagtacaccgagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaatatattccagggctgacgtcagcacggaggggggggtgcggcgccgacaagcggggcccgcatgtcagcgacgcacgggtggccggtctaccgtggaccgggaccacgcgggtgatccaccgccggtccacgggatcgacggcccggatcggcccggggccgatcggacggtgcggcggcgaccaggctaggctcggctcggcacaaagccggccgaccggtcacggcgacggcgcgcgcacgcgcacgcgcgttgccgacgacggcaaccgccggcggagacggcggcgcaaggcggcgccgaagggcggtgatgctaaagcgacgactaacgggcggcggcgctaaagcggcggctaggggggagagggaggggaaaagaaaagggaggggtgcctcaccgagggtggccggcgcggaagaagatgatggcgaacggcgacggcaagccacgggaggacgacgtcggcgggcggacgagcttcggggtgccctaaggaaggagaagagagggattagagagagggagatggaccacggcgaccggaaaccatggccgaaggcggcggtggaggtggtgctcacccgagtgcgagggaacgaaggctccggcgacgaacttcgacggaggaggggtggacggggtggatctcggccacgcgaacccgacggcggcgacggcgcggcctggcggcgaccctaacagcggctagcggcggccggagcagcggaaaaggcggcggcaaggggttgcacggcgcgggagcgatgggaggctcgagagagtgcggcgaaatggggaaaaagtgagaggggacgacggcgatgcttaaatagggggagagggaaccggacgtggccgggagaggcgggaatcgccggccgacgtggggagtgtgggaggagagagaggcgggattcgaaaatcgaatcccggccatctcgggcgcgggcgcgagcgggagagagagaggagtgggcgcgggagacgcggcgcacgcgcgggcgtggtcgacgtggctcggaggaggcggagacgagggcgcggcggcggttgcgggcgcggcggcgcgagcgagatcggcgggaggtgggggaaggacccgacaggtgggccccacctatcggtgaccccgagagaggaggcggcggggcggcctgactgggcctcggcctgcggccggcccagcaaggaagagggggaaggaaggagggaatgggccggcggcccatccgaaaaaaaagaggaaaaagagaggaaaaagaaaaagaaaaaggaaaaaggattttccctggaattgaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcctgatttcacctgcattttcttggggtcgttttacaaattaaattttaggcttgggaggagaacttcggggtgtgacacctacctcgtgttccgctcctccccaccgctctatgcctccgccgtctccatctccaacctcctcaacgtcaccgccaccgccgtcaccgaatccaacgccgtcgacctgatcacccctgtcgctgccgaccccctcgtcctcgcgcccattgtcggcgacctcatccccacctaccggctagcctacccgagaggagagaaataagtgagggagagagagaggaggaagggaaaggaggggaaagagatagagggtgatgacgtggcatcctgacatgtggtgcccacgtgggtcccacgctgactcagccaccacgtgggataaaaccggggtcatatctgtttttgcggttagaggacgattttgtaactcgatgacaagttgagggaccttcggtgtactttttccaatctataatagatactattatgggacctaaaaattgacgattttgtattaggggtgaaaaattctggtattggaaattagggatgtcatacaaactccacgtaaagttgggggatggttggtgaacttattccaccatattatatacctcggtatctagcctggtccaactcaaacatgtattatattatgtgaggccaatgtcatgaggcaacacgcgtggaagaggggtaaaccacgttctcacacatagcacgctacgaagcggaaaagctaatacgtgcgccgccggcgcatgtctcgggcccagaaggcccagcgctgctgcgccagcgcgagcgtctcctctactttttttttctttttttttctgttttttttccctttttccactttttttttatctttagcatgttttgagtttgaaagtttttaatttttgagttaaaaattttcaaatctgaacttgaaagttttcgaatctcgagttgaaagttttcaaatctcaaattgaaagttttcaaaattttcaaatctaaatttgaaagttttcgaatctcgattctcgagttgaaagttttcaaatctcaagctgaaagttttcaaatctgagttaaaagtttttaaaatttgactttaaaatttaaaacttaaatcgaaagtttacaaatctaacttaaaaaattttcaatctgttagtaaaaaaatctccagaatttttcctaattactattattagtgtgaagtatattaaataatatagttagttaggactaaagggggagggggagttctcgctgctggcgcgcatgcgccagctagtagtcccccgctacgaaggtggatatacgagtacctatgcatcatttttatgattatatcacatagatttttaatctttaggttaaaattcaatagatacaataaaaggcaaaaatcaactaagaaacaccacaatggatactaaattactatatctttaagaaaaagaccaaatccaatataaatttcaaaacttacaagtgaagattcaaaaattacactgtaacttataaaagttacaatgtatgtttcataaattacaagaaaatacactgtaaatttaaatgagaaaattaagtgagagataagaaaaaaaaactttcgagtgagatatagcaaaattgatcgaagaaagggcacatatatgagaagcaaaaggctagcgtggatctatgcatgaggagcacccggagagtggattgacaatcgcgctctatgggtggattatccagtgacccgactacccgagtccaaaatctataccggtaaatcgatggtataacatcatgtgactatctacataggttctgagtacgtactataagcaagcaaaagaaaaggtaataaataaaatttcaaaatacttcgcacctacattataaatatggcctccaacatttgaacaatattgatggtgtacattaatttcacaagcatgcctactagttcctgctaaaggacaaccatgtgtctataaatatggcttccaacatttgaacaatattgatggagtcatgcgccatatatgagtcctatggttgtagtgtcatactaagacctttttaatgtatatatttttttaaccattcttgtagctgaatgatttggcattgttttcattacgaatattttggtgccgtctctgacaaaggtggtgtttgaatctcctgaagatttttatgaagataaagattaagtatttcacgcaaaacgaggtgataataacgtgtgattaattgagttttgattattaccaacttgagaaatggattaatctggtattttacagcaactttcatatagaaagttttcggacgaaatacaccgtttaatagtttgaaaaccggccacgagtatccagaatttcatccaactcttatcagataaacgaacgcagccaaagcataaagaaaatatcattcgaattgtacaactcaaacaacaagcattggacatatttgctcaaaataaacaattaagctttgaaaaattcgtgttcttctgttctcttcattctatagaaccaaccaagtagctgaaataagaaccgcgatatgtacagacagctctataactaaatatcattaacggggcactaggccactaggcactgtatatattacataactatggttgtacttctcttaccttctattcatggcttatgaactatggatacaaagggtatttgttcacgggtcacctcaaaagctaggaagaaggaaacccatagacgtgcaggatgttatcacccacctgaaatatgcaaaaggtttcagttaagcagaaaagaggaatgcaaacatgtcctataactaccgtgctgtttttcataaaattaacaattagttcgttcaaaaggaataaaactaacaattttacaaaaggatgtgccagtaaaatcactgtgactgcgagtgcaaagcatatgcaaagtggatcttcctgggtagctatagtaaattaagaatttgacacccacatgtcagtgttactgatattttaacggagggaaagctgaaagcactgtccacgcgtgggcacacgcacataaacaatgttgatttatcatgtctcaaatactcgatgcaccacttacacaacataatcccatattttcatcattataaaaatatttatgcacacataaatatctcacaacagtatttttgtttggtttaattgattagatttaaactgtctcagttcattttcattgtgttctttcaacggagtgtcatattgtcaggtatattcttttcttttcaagactggcacctgtcaatcaagggaaaataaatccttagatatttgtaagttagacataaacatatttccattgcttgcatgttcttatttgaatgcaaatctggacatctcgtgatgcattgagttcttcaagcagataatttaggcgatacacagaaagaaaatatatgaaaaaatgtaaaatttactatgcctacagtctctacttaccaagccaaaaagcaaatcctgcatgcactttggtaagctcgtacggtcactcttgaccatggaatggatcacttgaactcacctcattctttgcaaactgtcacaaatcagcatcaaattaagcacaagaagaaaaattgaaaatatgttacagatttaattcaaattgtcaagtagagccaaagaggaacaaaccgttgttgttgctattgttgccatcgtgacaggttgacttgctggcaggatgaagttggtccagaaaagagggtccgcagaaggatcagcagggttccaggtatttttcatttgtgcagtaacagagggcaatgtgtatggagctctttgcacaagcaacccattcacgttcatgttaactgcagttgtgtcatgtccagttgcaggtactggggtaactgtctttccttcatccatttctttgctaaaagtacattcttcagatagttttgtagatttttctgagaagcttttgaaggcatcagactgagataagatatcacatgctgataggaccacggaagagggctttgagttagaatggaggccaagggaaggaaacttataaggctcagtccgttgcattgaactttcaatagcacggatttcatcagtaacctcttccattttagatgtatctgactgccgtgtcttttttgggagccaccaccttatgtaatttgtcagatcaattttcctctctaagccaaaggttcctgcaaatttcccatccagcgtgatgtccttccctgtaatttaaatagaaagactggttacaaaaccacatagaatttgtctttctcctctgtagtttgttaaccagaaacagcagtgtagaagtttttatggagacaccacaacctaggctcatgtagtcattgccaagcaagtgtcccaaagaagcatcccatctggaattatggagctgcctgcatgataatgtcacaacagttgcagttataaaatttatatcaatgtgactgtacgtgtccagcagtgtagtgcactgtaatgattagtcgaagactgacatctggtgaataattaagtaaaacagaattacgtacaccctccgtactcgtaaaggaagtcgtttaggacagcgagatggtcttcaaaacacaactttgacttcttgtttctataaaaatatttattgaaaagtgatatatgtatacttttatgaaagtatttttcaaggcaaatatattcatataatttttgcattgtcaaactcaacaacttaagagttattaatgatttatattcccaaggtttgacttaaacattgtcctaaacgacttcctttatgagtatggagggagtatagttttactttatatgtccaaataataaactttcctaaactaatttctagtggtcctcaggacactattaagtcgggatcctatcctagaaggaaatttcaagtatgtcgatctcttcaaaatctcagctacaagtaatcactctcctctgaaaggatattctgttgagaatattatgttttggttggttgagatcccacagaaagcaggatagctgtaaccatacaaagaacgaaggcactgaatgccgaatttccattgacaacagtaatcagtgaggaaacacagaatttcgatgacgcacattcagcatcacaagtacagttgagggactgtggctgtgcaatcgagtgattattggaaagaattaatgttcagcaaaacttgaaggtttgcatctttgctaaatgacactttattttaaaattctctaaatgaagaccaatgacacacgaataagagctagtagtttagtatctaagctatctacctccaaaaatctgctgagcttactaatttaattcatagcagaaatacatgaagttgctgaaaataatttctaatgtaatataccacagggcatcatctttacatactactacttggtttgccataaatatttgtagcaagatggaaaatgttaccgaaataaacaaaacatggacaatgatagtttgtgcacaatagaaaagaaaattggacatgagacttgttactgaattagcatcacaaacatgcatgcaaatataataactgaacatagagttaacttccaaatatatttctcattgctaataagtacctaggaaggccgcgatattttggtaaacccctggaaaaggcactgctctttctgcagtgcatgtgtcttacagttagtacttaagaaccaaagtaatatgcacgtattataaattcacaaatatcctccgaagagacacaagataatcctccttggagatcatctgcatttcctcaagatctcttgcataatcagagacctaaataagcaaatacataatgaacataagcctgaaaaagattaccacaaatcaaattaactagtgcaaaatatagaatggaaaaaacatagtacaataattcataagcaacatcgcaattattttccatcgagatgtataggcatatagataccaaactgaagagatggcatgtatgcatatgtttgttttgccaatattcttctgagacaatgatttttcaatgtcgcttatatgctcagagatgaattttctgaaaacaagagattttttttgtcaaggacacaaacatccatctccgaatcgtcaagtgtaaactgaataaatccctaacctttgcatacaaaagaacataatataatagtcaagagtattcagatttttcaaacatcacacaatagttgcataggatatgtttggactagtatgatccaaagtttggtacaacactctctaagatatcttttggttttcaatttgcatcttaagagaatcagtcttcgaaattgagctcaggtgatgcaaaatataaatgattaaatttaaccaaatgaaggtcttgaagaaaaggcagtgtgtggttaataattgtagaagaactaaatggaagctaagaaaccaattataattagcaagtatagatgactcacaggaaagtttatttgtgtcccagctccccagtatttcaatgcagcaaggtcataagctcttgctgcagcctcttcatcatcatatgcacctgtgtatttgcgcattgaattgatgtggataaagaagtttatacaattgcacattttacagttaacaccaaagatttcttacctaaatatactgcacttgcagggccattttgggtgataatttcccatgcaaaagagacaattccattaaatcagattaattatagctagatttttaaggaaatgacgtgcatggattatctatgaaatacaattaaaattcacctagcttccaacgtcccttggtcaacttttcaaaacatgtaaaatatagctgctaatttgcattgggtatacagaccttgtttcccttttttgttctgattctgattccatgtgcttttatcccagaggtgagcttcatatcggcctgtccacctatgcctatagatgatacaaaacaagtgtcaaatcaaattcatacataataacagctgaaagttaaaatcttgcttacaaattacaacaaaattaagaaagaagtagcatatggtggtacaagaacagttgaataacaatatagaacaaatactacttttggatcagattaaacaccaaataaaagatttaagtatgtaaatacacatatagtttgaaaattcatcttttagttgagccccacacttgtctggaccgaaaagggtccaaaacttgcttcttacccagattagagctaaaccctgtcaacccagtttgacacaacttaaatcaagcatgatgttggatgtactggtcaagtgaaaatcattcattagcttttatatttatttagatcaagcgaagctcctaattatttcagatcgtccccttggagacacaacaggtaatccgatgaatacagctaatccgtatataaccaagtaaacaaaaagaaaaatctagatcccgaatcgacggtaccattttgagcatacaaggagacctgacgaacggatttagcgccacagatcaatccaagcagagaacgattgcatatcccctaataagcatccaagtaaaacttctccgcgactcgagacacggaggagggagagggcaaaggggggaggagccgtaccgggtgacgccgcggtagatggagctgcgcttcccggcggcgcagggcggcatgcggctgatacgctccttggccgtgcacaccctctccttccgcgccgccacgggcctcctcggcggcggcgccacctgctccgcccccgcccccac

SEQ ID NO: 75280 - DNA, 11263 bp, Oryza sativa
atgctagaaagttttacattgtaaaacggagggagtagctactaatattattattactggttaccactggttaattgcgttgtatatatataattaagttaattcgttggaggatatctctatacacaaatattaattgcttgcacgctatctacaatttatatatgcatatattcatcgatggtaacatcgatcgaataaagttggagcacgatagctaagttgttgatcgatgtgtaaacacatttgtttttgtcgtcaactgtttgtcgtaccaaatgctagcctcttggggcaatcttgtggctgtcgtgagccagaatgaatagcagagattacgctagcttagctagccctttttgcaaaagctgatatatgcgaattgaaaacgaagggagaattgtgcaagaacagtgtacactggatcatctgatcatgtagctagctagctagcacatggttgcatgtaagtgtgtgaccccagctgaagagaagactcgagtgttgacgaggagacaacacctagttcgtacatgcggatgtcgatcgttgttataaactttaaactcttcagcagttaggcccagttatattcttcaattccaaacttcttttttctcgttttccgttagcacatttttcaaacggttaaattgtattttttaaaaagtcaatatataaaatttgttttaaaaaacaaataaatctatttttaaaatttataatagttaataattaattaatcatgtactaatgagctttctcgttctgcgtgcaacaaaaatctccctcccaagcaggagatcgaacgaggccttagagaagcacatagccaatgcacatctcattagttccataattccacacaaccactagtctgaaaacacccacaaatttcagtcacttttaattagataacaaactcattaaccttagtaccctttcctccccatatgcgtctttcctgcaacacatacacctgcgctcatctcctctgataccatcatctccaattccaaccactccccgtagcctcgtcaataccagaagacgccaacaacggtattagggcccgctagaccagactagcttcttcatcgtgcccaaaggggattgctaggttgaaaggtgaccgaaattccttgcaatttcaattagcaatccccctatgttaatagttaacacttgaattgcttgaaaatcatgcatccattacatatatatgcacatagagaaatcctgttaacatgtactagtattatcggacaaggttattagcttaggtgacctggagcatagctagctaggtagcagctgcaggaggcaagtgctagcaacaaaagaagaggaggaagaagaaacatgtcgatgtactagggatgatttgcagtgcgtcgtcaaagcaaacccaataattgtttggttcagatgcttgatagaccataaagaatggacggcagataacaggtatttttcaagaaaagagagaagctccaatcttgtcaattaatgcctcctcaaaattaactttattctaattttctcccccctgtcatttcattgttggtatagtccgtagtatatattgttagcccattccattcttattccagctatataggtaacactatattctagttagctagtgtgatagtgagatggggttcccctcgtttcttacgtacatccacatttataattattattatttatttataatttatagaagtaaaacttaaatttgtatgtttatgaagtggtatataatacattaatgaataaatttcataaaactatatatactttcatcaaattatcacaaaactacatatttaaggtgatgtaccacaaaattacagatttaaggtagagtatcacaaaactataaatttagtaacaaagttaccacaacactacagattttggagtttaaatgcttagcactagtgttatatttgagttataaacatgtaagttttgtgattaaattttcactaaacatgtagttttgtgataattttattactaaatctatagtttggtgatactccaccttaaacatgtagttctatgagaaatttaatgttaattaaactagaaaaaatacccgtgcgttgcaacgggtgaagtctattttaatcttattattgttatatggtttaggtaagatgacattattcgctgtgggagtttgcttcgatatatatgtatatatatatatatatatatatatatatatatatatatatatatagagagagagagagagagagagagaaaatcatgagctgtagttaggagtccgatcgtctcaagttagcatgtgagtttttttaaacatatttcttatatgattccttctgtattaccaaaagtgaacgatcttaaaacccgactcaaatatgaatatgtatttccaaaaacaaacgaacttaaaaactaactcatacacggatgatgtaccaaaataccggcaaaaacatcttcaatttttatattagtagagaagagatagagatagagaagatatatagattaaacaaaaacataaaattaaaaccgactcaaatacggatgacgaaccgcggaaacatcttcaatttttataaccgactcaaacacgaatgacggactacgaaaacaactccaatttttataatagtagagatttagttatctttcccggtatagatgcacaagacaagagacaagaagagagaagaaaaaaaaagaagcaaagaaaagacacaagaaacgccgcacagatcgcctttttgagcgtagaaaatccaccgctcgtcgtcgtcctcctcgcgaaacccaacccgcacacgctctctcctctcccctccgcttacaaaagggcctcctcctcctcttcctcctcccccatcgccattaacccattaccacctccacctcgcgcactcagtctgtactacctgtacgtacgtggccgccgctagctaagctaggaattgaaatggggatggagaggccgcaagagaaggtggccaccaccaccaccgccgccttcaacctcgccgagtccggctacgccgaccgccccgacctcgacgacgacggccgcgagaagcgcacaggtgggtgtatgtccggtgtccatggatgaggtagctagagctaagctaattaagcaagctaatgggttggtaataacaatggcggcggccggacgaacacttggatgcatatatgcagggacgctggtgacggcgagcgcgcacataataacggcggtgatcggctccggcgtgctgtcgctggcgtgggcgatagcgcagctggggtgggtgatcgggccggccgtgctggtggcgttctcggtcataacctggttctgctccagcctcctcgccgactgctaccgatctcccgaccccgtccatggcaagcgcaactacacctacggccaagccgtcagggccaacctaggtaaatttaattaatcactacaattactgctaattaatactgtaataattactgtacttagcttgttactaatatggagatggagatattttgtgggtgcaggtgtggccaagtacaggctctgctcggtggcacagtacgtcaatctcgtcggcgtcaccattggctacaccatcactacggccatcagcatggggtacctactgtctactatgactaattactctagtaaatttgggcagtaagcttttagctatgaatcagtataacttatgtactcttgattgtggtttagactgtgtacaccttctgaggtgtagaggccgggttaatataatccattatctaaaaagtataagtagcagagtctgtttaaatttatatgcgttattgttattgtattttaggatggagagagctagcacgtacatagtagagtgtggagtaagcttaatccttgattaggacacttcactaacccattcttcacgttactgctactgagagctgtagactgtagagtgagtagcagtagatgagaaaattcagtcaatttaattagccgtgcaagcatgcatgatgatgcatgtgtacaagtacatgtcctccatcatatatctctgcatgcagcctgcccctctgttaatttgtttgtttgtaactatatatctaggtggtaggataatgttttgcatgtcccaaattccgtttagctttcgtcagcttcttaatttagtttctggagcgcaaatatatatctcatttccataattccacgtgcctttacttacaggcggcacgcccgcggcccgaccacctcaaaaagaaaaaaaaaatactccctccgtattttaatgtataacgtcgttgacttttcgaccaacgtttgatcattcattttattcaaaagttttgtgtaaatatgaaaatatttatgtcatgcttaaagaacatttgatgattcatcaagtcacaataaaataaataataattacataaattttttgaataagatgaatggtcaaacgttggacaaaaagtcaacggcgtcatacattaggaggtagtatatgttttggccatttgcaaaaattgttgtcatagtgaatgcgtcgccatgtttaattaggtttgacagtatgattaggacaacataggtaagaggctactcataattctcaaaagcaaagcaaattgtaattaaagcattcattcattctctgaaatgtcgcatggctgctatgacagtcaaattaattaggttgagtacgttaggtggtcttcttgaggatccaacaaaggcaaaaaaaagcagagtatatagtgggagagaaaaagttggggaagataacattactggacagttcaaaagtagttggaaaatattcagattctagtgagtatccaaaactttttccactgaaaaagaaacagcgagctaaaaaggagtggttcttgctctgctctgcatattggcatggctatggagaagaatcttattcgtgataagcatctactagactactaccactaatgattgataaacaaaaaaatcagacacttttaccttgattcctacctttcatttcattttcagtacactcctttttctttctgatatgattttcgtcagtgttactctgaatttctctgaatactaacatatggttaatttacaaatctgttgatgatatgcagtgcgatcaaacggtccaactggttccatcgcaacggccacgacgcagcctgcttggcatctgacacgaccaacatgatcatatttgctggcatccaaatcctcctctcgcagctgccgaattttcacaaaatttggtggctctccattgtcgctgctgtcatgtcactggcctactcaaccattggccttggcctctccattgcaaaaattgcaggtaaatatataccatctgatatatatggatgacaaaaacaaatttgtgtggctatcttattcttaggattgcaagaaatatttttttctggttctcgccgcacatagaactgaaactggttcctgtgaaaatccgacaaaattcttgtaaaaccgctactttccaaaggagagacccaagtcctcctcggtccaaaaatggagaccaagtctttaatttacttcatctattctgttcccgtgtacacatcatgcaattaattcacaagggaaatggacaaaacaaagaagatatgatgctgatattataaatatacatttttggtagggcagaaacaaaattgaggcgtgcaaaaatgtatatacatagcctgggacacttgacatgttggtttttgtttgtatcatccatgttgggggggggggggggccatgatgcagtgcatttgtatgattgaattcatgtggttctctgcaggtggggcccaccccgaggcaaccctcacaggggtgactgttggagtggatgtgtctgcaagtgagaaaatctggagaacttttcagtcacttggtgacattgcctttgcatactcctactccaatgtcctcatagaaattcaggtaaattaattttaattaacctttgcttatatttctcttgatacaaacatgagcgataagctatctttttcagtgaaacaaatttagacaagtataaaatgagaaaagtaaattgatgtagtactctctccgtctaaaagaaaaaaattaaactctaaggatgaatctatgtgtccaaatttatccctaatatttaattctttttaggagggaggaaatagtacattaggaaaagtgagagaaaaaaataggaggaaaattttggggatgttccgtatgcccgtgatcttttgagctctgtcaaagaggacagatttctgaaagatagcagtatgggtgaaccctacaagaggacagattttgcagtttcctgcacatgaaaaatactctgaaaaatacagatatattccttttcagaatcttggtcatactggtcaacatagagtctctgttcttcattgaaaccactggttttgccatgaaatttgcaagtagatagcgatatatcccttattatacttaacctgtcggccatcaaatttcagatcatgaatcggcagtcagaaattcagagttcacatgcaagaacatttctgaaaatgactacctaatctaattactaataccatttctgaaaatgactgcctaacctaattactaagagcaagtttaatggtatagcatagtactagctccaaattttctatagccaatggaatagccaattcatacaataattacttgctatactagtaatacctggtcccacctgtcacacacattacgtcttggagtccgtgctgcagctggctacagatctgtagcccgctgcttttctctctcttcttttatctctttaaaatatgtttatagctagcttatagcctgttattgtacctgctctaatactatatgagcttcaaatcttgaaatgtctttgtcctcaatcaaaatactgtcctttcctttggcgttttgatggatgacaaaaatgagacaagtctcgaggcaatacatttcactgcatttattgcacatttacgtctcacgcaaatctcaacgcaactctagtggtacttctcctagctaggtcaatattgcaatcaaacacaaatttttacactaatttgtatgaagtagtgagaaaataatttgatgcgttttgagagcatctcatgattgggtaattttatcatccgataccgataggtgagttaccgataggtgagtatcttcaagtaatatgcatgtatctagagatattaaaatatactattattttataaaatttagatatctcgagttaatgtactgtaattttttttctatccttaaaaatatcgggaagtataaaacttggtatcttctgatactatgtattctgatataccaaaatttttagtctaaatctcgaactaccttttcatttcaagaaccgtaaaatctttcctatcctttttcttaaaaagatatcgggaagtataaaacttaatatctcctgatactatgtattttatgtattttgagataccaaaatttttagtctaaatctcaatgtactttaatttttcaagaactgtaaaatttctcgaaatgacaaaaatgtgtgcgtaaacgtgcaggacacgctgcggtcgagcccggcggagaacgaggtgatgaagaaggcgtcgttcatcggagtctcgacgacgacgacgttctacatgctgtgcggcgtgctcggctacgcggcgttcggcaaccgcgcgccggggaacttcctcaccggcttcggcttctacgagcccttctggctcgtcgacgtcggcaacgtctgcatcgtcgtccacctcgtcggcgcctaccaggtcttctgccagcccatctaccagttcgccgaggcctgggcgcgctcgcggtggccggacagcgccttcgtcaacggcgagcgcgtgctccggctgccgctcggcgccggcgacttccccgtcagcgcgctccgcctcgtctggcgcacggcctacgtcgtgctcaccgccgtcgccgccatggcgttccccttcttcaacgacttcctcggcctcatcggcgccgtctccttctggccgctcaccgtctacttccccgtccagatgtacatgtctcaggccaaggtccggcgattctcgccgacgtggacgtggatgaacgtgctcagcctcgcctgcctcgtcgtctccctcctcgccgccgccggctccatccagggcctcatcaaatccgtcgcacattacaagccattcagcgtctcctcatgatcaaattaataattatttgttaatactgatgatgatgatgatatgatccatcgatcgatgaagaacaaatatatatatatagcgagatcgatcgatcgatcaagatcgtgaatgatatatataatacatagttaatcaatcagatgttaattaagtcgtgttcgtgcgtgtctttcagagttcagatcgacaggttgatttgagatgagtgctcaagtgtttcgtcagatgtaattaactatgtaagtggtaaatttagcctgatgatgatgatgatcagtctgaatggatgtcatgtaagtggtaaatttgacatgaatgtaacaaagtagtagcttagttgcagaatttcagtagcctaaatggatgatatatcagtctgaacttcaataacaagttaacagctagatttccgttgacaaaatcgccatatatatgcttgaatgtaaggtgaagattattactgttcaggtggtctagtttattgtagttaacctcaatggtcatactgtcacaaccatatgagtgtcaaagtctgaccatgtaaatgacgtaccagttattattaattgtgccatgattgtcagtatcaactgtcattgttgaatcctgcctctgtaaggattcaaaaagttaaaaagttttcagttgactatatttccctgattaaggtggaaaatgagacatatatatgcttgaaagtaaggtgaagactataattcttcaggtggtgtagtttattttagttaacctcaattttgtcagactgtcacaacaatatgaatgtcaaagtctgaccacgtaaataaacgtatcatttattattgcgccatgattatcagtcgatctcaattgtcattgttgagttctgattcctgcatctgtaaggagtcaaaagctaaaaaccaaggttactgtcagtcatgttgaagcagggtacagaacagaatcaccatatgatcttcttcatcttctagtaatttacttgtattctccttcactcaaccgaacaaaatatcccaactggttagacttatgaaaaagcaaaagaaagaaagggagaggatatcaagacttgcaacatctgaaaaaagtatacaccatgacttgcatcatggtattactcattagtcagaatcagcaggggatgaagtttcaagcaaagtgttgaccaacaactactactcgccaaactctccaaatcttttacagcattcaactctactgaaagacttaaaagtccaaaagggaattggtttttcacccaaatgatcagaaagttcatgctgatgatagcctgaatattactcctatgtcacaaaggcatgcagagaaattattttcaatttacagctgcacacaggatgatgcattggatgttgccgctgaatcttgtgtgaggtaggcatagtctgatagtcatagcggcgcagtcctaggcagagcagaatactcctattcctatacatatatatagcagatagatagagtagaagcgagtgcaaagtcaaggatgcagccaatgcttacgacgacgttggatttggatatattggtgtgaggtccaaggattgagtcattattgagactgcgtttgatgatgatttgatcatctttcttacacaaagattggcaccttgctagcatgcatatgcatgcatgtcatctacagactgctagaggcttatcctgcatgctgattcctgaacccattgacctttagaatggctctatctgcattcagattaaagtggcagatatgatatgagatactccctccgattgtaaatatgtgttgttctaataaccttaattttgaggtctatacaccaatgaaattcctacgatctggtagagcccttatcctgcaattttgaggccgttttcacaattttagccatctttgcattaactgatataattacgtaagtccaaggcatattaaaggatgagtctggcataggatcttcaaaaatcatattaatttattttttaagtttttcgttaatacttaattaatcatatgttaataaaccgctccgtttcgttgcttggagggaaggttcccaaccttagctaacacagccttagagcaaatacaatagcatatgctatagattagttacaagcacatatagaggagagagagaagaaaaacgggctgcttgtttgtagtcagctacagcataagctatatagcgtgtgtatgaaaggtaggccaaatattaatgttgcaatatgtatttatataaaactattgtatgcataggctattagattgggtgtaaaaaatgtgtcaatttttaaagctagcagctggttatattattaaacttgctcttagaggctaatctcttacaattggctataccatataataaaattttctttttatgaatggtaagagtcgatattaagccaacgtcattaagtttaacatggatgtttctgtctcctttccacttatttgccatgttagcaaatttatcatgttggtagccctaagagcgctattaattgttgttttttacacgtgtagaacgaccaccatttcaaaataaaggggttagatatgaaaacagtaacaatgcatcatgatacatgcatgcacaagctctagctgtctgtgtcatcccttgtttttcattcatggttactgaactttttagagcaattgttttttcataactttttctgaagtctactacctaaatccacgattccaacaagccattactggacctactatattgggccgtacttatgggccttacggttcatgcaaagcaaccgagtgcaagtccggcccggcccggcccatattctctctaggttgccttggttaccctagccgtgccgctcattccccctccgccgccgccaccgccgccgccgccggaattgctaggatccaccaccgccggaattgctaggatccaccaccgccggcgatctccagcattatattcgccggtgttctcaacgacgtggagca

SEQ ID NO: 75281 - DNA, 51815 bp, Oryza sativa
agagtcgatctcaacaaacccgtcgcagagagatgcacaaagtgaatatggaagactagagagttctacagaagatgtaagaccttttttagatatgctatttgtctaattgttagtgttgtttctaactaatggttatcttccagaatgaccaatctataagtgggtctggaactgttgtactgcgctcgccaagagcatctcaggtgtaccctgcagctactaaccacagttccaaggtgtgttttagattcctaatatgaatgtcatagttttcccccaaaacaagacagataagtatgtcctcccaatccgattctgaatataggtcattttagccttcacaattcttttctaaatgtatgttgttttggtacttttaagcactttttcatcttttactagcctagaggccatgcgttgcaacagaaaacaaattgagtttctagcttattaaatcaattataagcacttatttagtccaagtactactattatttttcttattgaacaagtaggattttgaaacataggggaagctaatagtgaaatgggggaggacttgttgtagtgctcagatgttagtggtaggggtggtgtgggaatggacaccacaactactaacattttcagttatatagattctttatttacagatgctaaataaatggtactcacaaataaatgactagtcttttcaatgtaatgtaaatgaagggcaataatgtcatctgtgctgtttccttcattcttggcataagtctaaaactacttaatattggaatcagagggagtaagcaacagcgtctgatacattttatttattagcctcccagtagattctcctcgtatgaagacacgtctatcagtgggacagtcgttcggaatcaaattgaagaaccagaaactccacgatcttcaaggtcgagactgggaatccaagaaaagtcaccaaatgcttcactggaggacagtgcaactaaccttgcagaggtgatgcacatgaatgttgttggcaaatttctcaattgtggttaatggttgatacttattcatatatttgggtaattaatgcaggcaaaggctgctctccaggctgcgtttaaaaagggtaatgctcgtgaaagacatgttatcagcaaacatgaaaaggaatcacatgaacccagaatttcggcagtaaacagtcatgatgccccaaggtattgcaagtttggttttagttttgttttgtactcgggaaacttttctgtccatttcttgtaacgcttcttaacagattcttttttttttatcctagtgagaatgctgacatggaaaaaggtcgcaaaccacgccagatacatgatggacaatcagctcctcaagcttctggttctgtatcttcacctgcactctcgtcattgataattccttctctaaaagaggtacagtatatttaactcattcccttttcaatctactgtgtttgctattagttgctacattgacactactcattatacatttgtttcttgaaaattctttataagccccaaaacacatttatttacgctcttaacatttttttataagaattaggttgaatttgaaggacatttgtgcttagctactcagctgcatgtaaaacgagataaaccattagcacatgattaattgagcattaattatttcaaacttgaaagatggattaatatgatttttttaaagaaacttctatatacttcatttagcaatttgagaagcatgcgcacagtgaacgggggaaagtttcagccaacattctgaaacgaatgaagccttaaccttaatattggataatccaatctcgaatgagttgtgtcatcaccacattttatcagtttgatctttgtacaactcgagacatgccaaactcttcactgtattgatgacatgctgcaggctactggtgacaagtttaacggaccagttgttcatacattccttgattccttgatgcatctcgaaaaagagctacctggatcttgtgaggtgctgattggcagaatgctccatcggctagggaggtctgagtttcacttgtgttctctcttatgcgctcctctgcttaccttacccctgtgctctcctctgcttaccttacctctgtgctcagcttgtagctcatgatacctccttgtttgcagctcgaaggagtcctcgctgcaaagtcttcaagagacggcgacatcagttttcgcaaagaaatctgaacctccctctgaacctccaagtaacaagaaaatggctaatacaccttccttggctgcccctaccgtaagccctttggcgaggttccttcttacaaggtttgtttagagaaattgtttcccttttcttattattgctttcccacaacaaagagtgagttgatgccattggtgcaggtggcaaaaccaagtttcccaagatcttaactccgtctgaagacaatacaaaaaaaaaaaaacccgtcatgattcaatgtataattaattttgagtgtacataacgctatggttagaaatctctttgttgctagctgttctcagcagcttgtgctgctaccggttgtttcatttgtttgtgttcgcggtgaataacacattttctacccattttataatgtaactttgcacccactgtacctgtatatcacctgaggaacattaataacacatcaatttttttccattttctgatgcccgagaatttatgaattaatctggcctcctatatctgttcggccctgtttaataggcaacaggctggcaagaaccggaatatttgtgtcacgctttgaaaactattattcctccaaaaagaaattatttaaactttttccaatttaacttgttactccctctcctaaaatataaggcatgtaagatttttattctccaatgtaaaacttttatcatatagaagagatagaaagatgaatctaatgtatttttgtacaattaagtagatatatggcacattcgttgtctttgaatgtcacatttatgttaggccgcacttatattaggacgaagaggagataatttatttaaacagaccaaacttaagattcttcttctcagctataagaataatatttgatttgattgagaatgtttttaccgaaatgagaatgtgagctgactccagtttgagataatgtagaacatgacaggtaggagtagtaattagtaagactcgcctctcccccacagtggcactaatctccctgggcctagcatgtcagtcacaccccacaaaaatagccgttgcgaccccgcgccggctccgagccgccgacccgttcacacacaagcgccgcacacctccctttgttaaaccgtttaaaactctcccgaccgttagagcctcctccccctctatccccccaacgttcgtctcctcttcccccgatccaaccaccaccaccttcttctcctcctcttccgctcgacgccatcaccacgcacttgagagagagagagagagagagagagagagaaaccctaagcctcgcccgctatccagccaagcaccgatggcgacggacgcgaacccggaggcggcggcgccgccgccgcagttactggtggacgagggctacgagttctgcgcgcccaagttcttcgacttcgtctgcgacgagacggaggaggaaatccgcgccgccgagcgctggttcgaggcctccgccagccacgccccttcccgtacgctccccaatccccaccccgccgcctcgatcatccccccctctcccgtgttttgctttttttgcgctgattagggctcttcttcttttacctgcttgcagcgttcgctccgaggatcaaggagtcgagggcggaggtcaagatcgagagcctctgcgacttcaccgacgcggagccgattccgaaggtacgaagcagaaagctgcgggaataaccccccaattttgccctaatttctgtaaatctccccccttcttattgtccgttggcctctgcgttcgtcatgataggaggtagcagtggaggaggcagcaggaagcgccgccaatccctcgcagaattctgatgggtaagagttggagaactaaagaaattgtttatgatgattcgttgtgatctgatgaagttaatcgatttctcgtgtgtttttcatcttcacttttggatgttcaggaatgtgcaacagaataaggacggctccatcaaacttgtacgtgatttcttgatgttttcatgttttctatgttctcagtttcagtaagtactagtgttgggtttctagcagctcacatcctgaattcttcaggtccatgaagcaaatcccagtgaaaattgtgtcactgacggcgatcataagcaccaagaaaggtgcatttcaagacctcaatttgttggttcattccgtttcttgctggttttggcatgtgaatgactaattggttgttttgggcagtgatgcaatgttggagtcgccaccagcagaggaggatgagaaggaatcgccaaaatccttcgagtttgtcccttccaatgcaaaatgtaagttgctagttatatatgagcaatggcagtggggaagaactctgatccctggattttgatatcaatgttgcatggctttagcagcagatgttgcttctagcacaccgaagattcagaggcctccacccgtcaaagctgtcactacggtgcctacctgtcccaagctgacagtgaagacagaagccttcactccgaaggtgcaggcaacgaactcctccagaggtcttgcacccttgactggctcaagggcacatccatctgctttgaagcagtcgatgagcgtcaagaggagtgtgatcaagtaagagtcatgctcactcataaaaaaatatattaatctggagattattttcttactaatgtctgaattgttggtttttcagatgccctcgtgagttgctggctgggaaggccgctactgctgcgaatgaaatcgcacaagaaaatcaagctgtcaagagacagaagcttgatgatgggaggacaagacaggtaatactgggatgagattaaagatggcacttcaaatacatgtgtttgcgttgcgcgagatttctgagaaacattgtgtttgccgtcgtggttagatactgaacgtgaagacaaggaccctgcctcacaaggggagaggaggtggtctagcaggaagcaccgagatgagcctgtcggccatgaggaagcaccgtgacgattcacactctctcaaggtagctcccaagttgctcttctgactcttaaatgatagacttaattgtaatgtttcttgtgagaatgcaagtataatgtgattttgttattgtgagcttggcacttagcaacttttgtttctgccatgtgcaggaagtgactcactatatatcggcagcagagatggtaaagaagttcgagtctgggactagagagttggccatccctcacaacagatcgctttctcatgttagcactcatgtgccctttattattaattttaaattgtgtgcatttctccaattttattaatatacatgtcttctcagtcttgttgtgggtatttggttccatacaaagaccgatgtcctttttgtgatactgatatctgcatatcaaatattgcacagttattacatctgaaccgttgacgacgaaatcattattggtactaagaattttgacatattgcaatttgtgcacaatgcaggaggatgcagcaaccgcattacaaagaagaacaaagctgatgctaacaaggccaaaggaacctgagttccagacctcccacagggtccgtgctgtcagagtgaaaagctctgctgagctagaggaggagatgctagccaaaattccgaagttcagagcacggccgtttaacaaaaaagtgagaaatttgtttgctttggttttgattatactaactactcaatccaggatctgaagactaactatttgtttgcttctcctttcagattgcggaggccccttcatttcctcctcttccaaggaaagctccacagcttcctgaatttaatgtacgtcttgtttggctgattcagaaatttatgagctccacagctttgtttggctgattcagttattcctttccaacacctacaggagtttcatcttaaaacgatggagagagctacacgacatgcagacacctgttccgaagcttcttccgtggggactatcagggtaagctcccttcacttaacctggttgctaatatcagtatgtaaattcttcttcttattagtctcctaaaaattaaaattcttggcattactgaaagtttaatcaaatcttgcagagtcagagcagtaagccactgaccttgacagcgccaaaaccaccccaacttgagacagcattacgagctagaccaccaaggtttccctttgccacttgcatcattcagaaaacaagccattttatgttattgattattttcgattactctaacatcatctttctgcagggtgaaaagttctcaggaattggaactagaagaattagaaaaggctcccaagttcaaggcaaagccactgaacaaaaaggtctccttatcttcttgaagcttgtacatttgatacattgattgcattgtgcttcaaaacatccagtctgaacatcatttcttgcagattctcgagagcaagggtgatattggtgtgtttccacatctaaaggctcaaccaacagcccccaaggaattccatttctctaccgatgatcgcttgggtcctcctgcagttgtggatctatttgataaggtgagggttctaagtcatgctagtaagctcattattttttttccagaaacctttcttctaagtccttttctattttgtagctctctctttgctcagaatcttcatatcatagcaagaaagatgtgcccagattgacaataccaaaccccttcaatttacatacagatgtaagcagtatgaaagttatttgttttcccaacacattgcatttacctatctgttgcaggcaaataactttgttatccatgttacaggaaagagggcatgagaaagagaggcagctagctgcacaactgctgcaaaagcaattacaggaagagaaagccaggattccgaaggctaatccttatccctacacaactgactatccagtggtacgtgcaaagtaacataccgaatattacatgtcctggttgctgaccatctcatattctgctagccttaacattttctctctcttcagataccaccgaagcctgaaccaaaaccatgcacgaggccagaaggctttcagttagagagtttggtgaggcatgagatggagcaacagaggataatggaagaaagagagaggatggagagggaagaggcccagaggagagtagtgaaggcacaccccataatgaaagagtaagccttcacattacggtttctcttgtcccaacagttcctggtttcccttataagatgcatattaatactgttaattttgttgcagggatcccattcctcttccagagaaagagaggaagcctctcactgaagttcaaccacttaagttacatgttgatgaaagggcggtccaaagatcagaatttgacaatatggtcagcaaagcaagcttgttctattatctggtttggaggagcctgccaaattggctgaatttactgagcaattcgttgtcgtgcaggtgaaggaaaaggaaataacttacaagagattgcgagaggaaaatgaattcgcacaaaaggttattattttcttatgccttcttctcaaaatccctacattgttggatgcattttcatctgttctggcaactaacttgctgtgatcttttcatgtgaagattgaggaagagaaagcgttgaagcagctcaggaggaccttggtgccacaagcacggcctctcccgaagtttgacagaccatttcgtccccagaggtaagagcagaaacggccaagatttttgcctacaatgtcatcgacctttccgtttcatctcacaaacgtgaactcgttgtttcgcacacagatcaaccaagcaggtgacgaggccgaagtccccacagcttcaggtcgaccaaagaggggcaagaaggcacgccttcatcagatgatccaactctccggctcatcttgttgtcgtctatcggttacccactggctgctgctgttttctcttctgttcttgacgtcaagatcatccccaattctcgcagcgattctttctgaccaatacataaataggccgatccaatcctgttatatagtcagtcaacacagctgacggcgtgtgtatgctcctttagggttctgctgatgcttgactgcattattgtaaattcagtttgtgtgctgtgtgtgtgtgctgttcgatgaacgacaataggatgacaccctgtcagtgtcctcctcgtctgtttcgacgaatgcaagttgtattcattatttgtttatcatctctgaactatcctggagttctgtcgatgttgaataatctaattcatatctcggcacttggaaaactctcgtgagaaacatatgtaccaagaaaaactgattcatgtcaacaacctagcattctactccatcatccgtttcgaaatgtttaacgccgttgacttttttagcacatgtttgaccgttcgtcttattcaaaaaatttaagtaattattaattcttttcctatcatttgattcattgttaaatatatttttatgtaggcatataattttacatatttcacaaaagtttttgaataagacgaacggtcatatatgtgcttaaaagtcaacagtgtcaaacatttcgaaacggagggagtatcaatgttttactcatttggacatatggaagttgtactcattttgtttatcatttcagatttctatcaacgttgaacaatatgtaaggagttaaggacggcggctggaagcagaaatctgggcatttgaaaaactctcccgagaaaatagacgaatcctgtgaaaacctgtccaccaaattcacatccttctcatgaatcatgtaaaaatgaccggtcaaaaacttagatgcatgatcacacatgcccgtatttcatctaaattttctcccagaataccgttcgcgattctgttcgttgatagtacgtcaatcacattgtcacatgctttcccccaactactgctgacgggcgacgagccgacgactcttgacttgcgcaaaaccattgggggatttcgcttacgaaatcaatccactcagcagcgtagactcgttccaaagatactacgatttggataggccggtggtctggatctggacacaaatcccatccgtgtaattctagtatttctctccatttccaagattgatcgatgcatgtgtagcagaaaataatgatactataatccctagcatttgacatgttctttggattgaaaatataggtgaatccgctcatgcgcttgagctttctatgcgaaaagttcgctttgtttttgtcaaacttttctttcgaaaagccacatgctttcggacaaaatatatccctttacgttttgtgccaaacatttctttttgtcctcttactatcagacggaggtgatagcacttcgtccaaaccgcgtttggttcaacgttaagccttaaggcagtccgggtaattaaccttaatgtttcttttgttttaacatggtaccttaatatttcttttgcagggatgattaaacttaaatctagttgggttaattatagcttgggaagcaccgttgattcatgtgaacttggttcaatttttcttaaacaacacatataggtatagtgcgatatttcgtatggatagaacaataaaaaaaaacaagaatatagccttgggaggctatagcctggaaaaaaaagcaaccacaccacacgtttacaatcagacctcactactaatgaactactaatgagatagtaatacgacatctcgaaggaaaaggattttccaaacgacgacttcaagaacgatatgacactgagatgccagcaccgtccatcctaggttcaagacatttcacctagaggaatccatcagggggcaaaagagatcactcaataataccctaaggggaaaagtggcgctcgcaagcgtcgcccttgctagctcaaagaggctaggctttcgtttgtaatcttcctacttcctcgtgtcaagatcttctgctggtcatagagaacaccaccaaccacactccttcgacgcacagccaccgcgccagcatcttgctgccagctgaccatcgagtagaagctcgacatccgacgcattccaaatccatccacacggttaggttggagggcgagagagaagaatggatctcctctccgcactaatctgccaacgaggccttcttatggtgtcgtcgccacaagtggccttcttatggtaggcctgcaacgcacacctcacaaggccaccgttgtcactgccacagctagactgctagcgtcatctcaggccgcccatccgcatcactgccaccttgtcctcgccatgcaccgtaccagctcagtttgccgctggccggcctgcgcctcgctgctctcaacctcgtcaccgtgccggcctcctgccaccgccggacacaccaagcttgcgtcacataggcctttgctgaccgcaacttgcttctatcaccaaccacgtcacgtcagcctcctactccaaatgtcgtcatctacccgctgtagtcggctgcgtcaacctccttctcatccgctgtcgtagcttccagcaccggcctcttacttccgccaacgcaggcgtcccgcggccgccgacgctgtcggcccgtagccgtcggccttctactgaggccaacgccgcccatgccgaagttcactgacaactttctgagctttgcgtcgcttcccccgcgctgtagatggagtgtcgtcgggttttggccccgccaccgccatccttgcttgtcgcccggttttccaggcggtgagctccggtggcagcgaggcatcgaggagggtgggagggacggcggcgggtggctaggatttcgcttcgagccgtctgtgcgtgggtgacacggatatctttcttccttttcggttcaaattctgatccccacaattaagaacacatgggaccatgagttcactttgtgtagaagtttcaatggggttcacgaatttatccatggccccctccatccatctaatgcgttaaaaaaacacacatttacggatatatgtaattgttatatacatgtgtgttgatgtgcttgtgtgcatttcccattaatataaagtagctcgaccagaatctcgtgtgtggcaactaaccttagctatcatggttgtcgtcggcttctatttaagatgtaaattgcccatcatttcattaacttatggacgttttgcatgcctagccaccttttaacaagaataaaaatgggttctatgggaaaagtaggcgtagtggtgaccggtgaagctgtcacccatgggtgcaagacttaatactatctgcgctttcaatagtaatttaacgagggcaaatatttgctactgacactacttagaaaaaaatgttttttcaggcggtcaaaacatgttctcacaggcggcaaaaccttccgtctatatctaaacgacggtaaaaatccctaatttttacaggtggaccaaagcactgcctgcaaaaatcagggggcagtttgaatctttccagacgctgtaggtgctacagtagtcccgcttgtaaaaataccctcagcgccaaaattttttttctcgccaaccccacccgtccctaggggcttcaaatcacaaaccacaaattctcacaaatctcatccaagaaacaaaatccaatcacaaacattgtaaagttgcaacacaaaatcattggattcaaatctacagcaagttaacaacaatgaacatgtaaacttaaaaaaaaacacgtcgtcatcgccggcgaactcctttgttgtatggggtggccgccgccgcctccctcccccctccagctggatctgggaagggagggttggggcagcgagctagcgacgcagccggcgctagtcatcgtcattgcgcagtagggccgtcgtcgtcctgcggtagtactcgtgtgtatagtagtgggatagaaaaaaacaggttatgaggaaatgctttgtgcacgtgtttttctctttaaaatccacaatataatagtatgtactcgatgtactaaatagttaatacatatagaagtttctgatacatgagaactaggagcgagaactagttcttatatgagaaatcatccaagaaagtaattttaagagggcttaaaaaagaaaataatgaaacaacccatgatcaattataaattaagttctacaactcaaattcgaaaagactggtaaggcaacgagcaaacaatgaaaaagttcgacggttcatatttttttttactatagatttgtatcattagatttatcatcgaactgctttaataacatacggtcataaatattcgacactttagtcaaacttttgaaatttcaaaataagtttttacaaaatctaataaatttatgaataatattttaggtaaatttaagtgcacttttttactttctaaaattaagtgtttcaaatggttgagatttaaaaatttgcccaataatcaaatataatgactagagatcggagagagagagtataaagatctgaaataagaaaatagacaatagtagctatagatatatatatgtctagattcatttagatcaatatgaatgtaggaaatgctagaatgacttacattgtgaaacggatgaagtaattcaattactctagatttatttagttattctcatgaaacctcaaatttcagatggaaaagaattatgatattatggtaatatttttgaggtaatttaagtgcacctcttttaattttgaaaattaagcgtttcagatggttgagatttaaaaaattatccaaatcttacatgaacatcaagtataatgaccagagagcgggggagagagtataaaaactcgaaacaagaaaaatagactgattgtttgtttgtagctaatgcactaaagccataccaagagaaccgatcccaatggtaccacattatcgccgatgtgcaaagtacaaaggagttgctagcagaggtgaaatatcgtcatgtcgaaagaggttgcaatagggtactcatgagttagcgcagctgactagtagaacgaagcattgtgcactatggtgggagcatattcccacctgcattcaaggccttgttctcaacgattgaaataactttgttctcatcagtaaagctttctctttctgaaaaaaaagaaataagaaaataggcaatactagctattaaaacataattcaattactctggattttagttattctcatgaaacttcaaattttcagatggaaaatttcacagggtcatctgtcagttctgtcgcatctctgtccacagttgatatatgaaaagaaaaatccatcctgaatagaaaaagaaaaacagaaaaaaaaaccttttgtttttccttttttctcacttgtccctacttgaccagtccttgtccctatctcccctttctcaggtcaaccgattctatccaagatccagtccccctttctccttccttccttcctcgagcctcatttcccccccaatcttcttcccaaaagcagctccatccaaacccaatcaagccccactccccaccaacccccttccctcaattataagcctacaactactgctgattgcttcagactgatccaagaaagggaagtttggttgtggtgcagagaggtgcagaagggggagggagggctctgaattttcaagaaagggaccatctttctgctgctgctgctgtccgggttggtgcttgttgaatttgaggctaaagaagtcggaattggaggttttgtaagagggaaacaatggctggcaaggaaatctaccacaagatgaaggacaaggtactgagtaatggaggactggaggatggggattcttgtttgttcttcctttggcctccatttccctttcatgtttattgtttttttttatttttttgctattcctgtgctatttttggggtaatatttaggtgcaccgttgtgtcgaatcttttccttttcatattagcttgaggggatcttgaaatggcgaaggctagaagtctgaacatgtcttaaaaatcttggaatgatgctaggctatggtgtctatttatttattttgggccaaatctgttgcttaattacgacaatccaatggtttgtggttctataaacataatgagtcccgatgccatgaaactccgtgttgacgttagattcttggagttatcatgtttctcgttcctactagcagaagcaggaaacatgtatcagtggagaaaataactactgaggaaacaaaacataactcgtctagaccagtagagagacaagcatttcaatatgttggttatgggaatctggtccatttcaccataaaacttcaagaacacgatctccggcttttgccggttaagcatgaattttattttatgcttagatttttttggatattcttttttatgaaagcttttggaactcaagaactcgtttgattgacgttgttccttgggagttttagagtttgcagcctggaaactagaagttatcttgaaatgttatactctactcaatgtagaatacacacatcactaaatccagactaaattcattttggtagactaccttatgcaccttctttgtgtttattcttgctgtgatgcaaccaatgtcaaaaaagcgaaaactgtttttttgctccattgtgctggatgttttccgcaagcttatatatttgctttgcttagtgttgtactattagcaacttaacatgcttgacgaacgattatgttttgtttaacaggtgaaagatgcttttagttcgtcaggaccagaaacagggaaaggaaaaacaaaattgtcaggcaagcgtgtcaagcatggttaccatcttgtgaagggaaaatcaaatcatccgatggaggactatctagtggcagagtacaggcaagaaggagagcatgatctggggctgtttgcaatatttgatgggcatttgggccacactgttccagacttcctgcgctcacatctctttgataatatcttaaagcaggtaatatttcaaattcaatgtcctgttaataggcttagcctcaatacttgctgcattgcctacatgctcagatagtaagattgttttgtcatcatgcgtcaattgttccaatattgtatttttactagctacatgtcctttgatttactatggataaaaatgaaccatccaagttctaatgctgttcacaataaatagttgtgtcattcattttttttgtcgttttaaggagcatctgacagtgtctgtacttacagtaaaaataacccattcgctatgtacttttatgtgttaaattctgagtttagaaggtttaaaaaaatggaattagaatatatggaatgaagattgcataatattaaagaaatgtaggaagcattttgagaaaagaaaaacaaggcggagttagtggggtggcgatttaccaccagcatcactactctttttcttttaggtattatacttatcctcaaaaacacagaaagagcaagtcaatctataatgcatatggtaaactataaacagggtaagaagagttgtacttctgttacgcttacaagtgttatctgtgcttgttctacaatctacttgcaagaaccatgctaggaataactatggagtgacctaaatatatagataatgtctatgcaattgaagatagtcaactgaattcacaactgtgctgattatttattgactccttcaacctcagccagaattcttgagcaacccacaagctgcaattcgaaatgcatatcaacttacggatgcaaaaatattggaaagcgcagctgagttgggcagaggaggctccactgctgttactgccatattaataagcagtgaaaattctgtgaacctagtagttgcaaatgttggagattcacgagcagttattagcaagagtggtgtagcaaaacagctttcggttgatcatgaaccaaacaaggagcggcattcaatcgagaaaaaaggtggctttgtttcaaacttaccaggtaaatgaccatttcttgtcaactctttttcctttttttttttttttgggggggggtttagtcattgtaattaacagtttaaagttatagatgttttttactgaggtttttttgtttgctaatctagtgtatctaatgtttagttccacactgctttcttatttggatttatgtccttgtatgactatatactagccatgtggccctcaatactgcccatctatttgagcccgtttcattggttgacattgcatcagatcctaggtccaggatacaccctaacactaagcatacctatgccaatattgcattagtaattaccagcagtggcgtacacagaccctactcttaactgcttctatgctgttactgtcacaacatatgagatgcaatctatcgagcttcaattccaaaaattttttacttgcaggagatgtaccgcgtgttgatggtcagcttgcggttgcaagggcatttggagaccggagcctaaagaagcacctcagctcagagccagatgtggtggaggaacctatagacgagaatactgattttctaattcttgcaagtgatggattatggaaggtgatgcctataaagctcataccaaccatccatgatagattacacctaaatttattgttttgcattctatatgcatacctaacctaagctcaacaaactggagaccatgtcctaccttatttaattctatatacacaccaaatctcagaatatgcatacatgcatgcactacattatttaattttgaacatgaggtactggaggttgagttttgtctaacaggtgaaagtgcttattcctacatttcagctacttcctccgtcccaaaatataagcatttttagatatctacacggtcttcgagatgctactttgaccaacaatgtctataaaagtaatatgttttaaataaaaagagttgcatattatgatagtttgtttaatgataaatctagcaatatcaaatttacatgattgatctttttcattattttgctattaatagtcaacatttaaaaagtttgatttggcactattctaaaaatgcttatattttgggatgaatgaagtatgtaatttggcatgcataagcacatcctgactcatgagttgcgaaccttgatttttctattttcttaagctgcatctatgactattgcatgattgtttttttttttgttttagttgagttctttactctttttatgctagttttcccaactcacctcgctcgttttccacgtgcatgcttttcaaactgctaaacggtgtgtttttttgtaaaaaatttctatacgaaagttgttttaaaaaattatattaatccatttttcaaaaaaaaagttaatacataattaattgtgcaatagtacgtgctccgttttgcgtgccggggaggaggggttcccagccttaatgagctgctaagttgcattagcgacgttcttttatcatatgcaacgattataatttcaagatcatacatatccaggtgatgtccaaccaagaggcggtggatgaaatcaaggacttcaaggatgctcaggcagctgcgaagcatctgacggagcaggccgtgaaccggaaaagcaaagacgacatctcctgcatcgttgtaaaattcctctgctagcagaaacagagtctcatacaagtgtacaattgctaccatctgatggtttcagtgttgttacttttgttgaatattctggttagtcttgtcgaacattgccgattgttgaatgccccaatgggacatgttcatatattatccctacaattccagtggatggttcattaattccttttgccctatcactttttctttatcaaaattctctcaacgcgaaaaaaaaataaattgctgaatttttttatctcaattctgaaacaaatgcataacacaaacatgcaacaaaaattgaatggcctgaagaaaaaaaaaatgctcgcatggggaactagctaaggattaccagctgagtctaaatgtaagcacaacgtttggcttaaaacagcaaacaaaaaatattttatgaataggacttatatatgcttttagcaatttaaaagtaaacggtgaaaaataaactataatgaaaaaactaaaaaattcaaatttagagtggctttaaaggctgagttcagcaagggagttagaatccttccccttcaacatataaaacggaactgtgaattagcgcataattaattaattatatgcttaaaatttttcaaaataaattaatatgatttttcaagcaacatttctatagaaaactttttcataaagcacatgtttaataattgaaaaagttaaatcaagagcgctctcggtttcctcctatcgcgcgacgcatcttatagccgtctatccgtgtcttcgtgctgttggagagacacgattgcttcatcaaagtgaggaatctgtatagcgtccagtattgctacaaaggacaccaccaatcatcaaaactaaagattggctacactagcattgttattttagtttagtttgtaccattatgctgtactcaaaatatacgataaaacgagtctaacattgaatatatccaaacattttaaataattacttcctccgtttcatattataagtcttataatatgaaacggaggaagtacttgaatcgtagaagtaacttagctctgcaatagtaactacgagataccctttttggaaagaggcgcgccttcgtacatatgctaattaggagaagagtgagttgcgtgtttaggcaacgaagcgacttcgtgctacgtagtcgcgtccccatttaataatttaggaagcatatgcgtgaaaaaaaagagagtgttgaacccacggtcccacactagtcactagcgtggaaaaaaagggagtatagaagtaggaaaaagtgtaccggaggtccctgaacttgtcaccgagatacgaaaatgtcctccaaccgcaataccagatatggggggtcccctaagtatgcaataccggtcacccgaggtcccagggcaggatttctccccgatttgtctgacgtggcagcggttttgtccaccgtggcgctttgacctcggtcgtcgtcgctgacttagcagcccggtagttaggacaacccgtggcgcactgaaggggcattcacttcacttctccctcctctggaaaccctagatcggcgagggcgacgcagctagcgatgaaggcgattcggagcaggctgcggcggacgggcggagtgtcgtgcaggcgaggcggtgaccggcgtgcctctaccgtcgactacctcgagctcgaggtggatctgggggcggcttaggcgcggcgaccagcagccaccttgggcgacctcgaggttgcatcggcgagtacccctccaattgggaatccgaatctggcaggtattacctttcgtagttaactgtgtgtgcttgcatggtaccagtgggatttgggaagtgaaattttttatattgtgagatgccttttttatctgggatttgatgtaagttgggagttttttatttaggtatgtagttgattagaggttatttaggcttacctctgtgcaaaagtttcgatttggacatggtatgcatgtgtaggtcaattataatataccctaaatcagttttatatgttgtttagcatgaaggggatggacgtgttggacactctcgtggttaggtttcatatgaatggggtttttctgttagatgggagtgagaagaagtattgcggtggatctgaggctttgtcatatgtagatagggataagatttccttgtcggagttatttggacacctgaaggagcattgcaatatgttgtcagggacaatgctccactggttgtttcctggtagggatttgcaaacaggtctaagggctctttgtgatgataaggcttgcaaattgatgtgtgattgtactggagaattggaggtggcagatatgtatgttgaagagcccaaaattgtggatttgtgtgataagtctgatgatgagagtgatttatgaggtagagatggaattggaagttgagagtgaagaagatggggaaaaaggggatgtacatgtagatgcatctaaagggaaagaagttgacaagggtaaagcaatagcagaggaggaaactgataggaggatagttttgtaccaatctgaatcagcacctctagttagccatcaaccttttagcagtgctcccaaagctagccatgaaccttcagacagttcacccattccaaatcagccaacatatgacactgaacccatagctaacgatccaccttctgatagtgatgaagatagtgactatattccaggggatgaagctcagtcagatgatgatgaagaggctgctgagatagagaaacattacaagaaggtcaagaggaaggtgaaggcaggacagctagagaacctggatgacttctttctagagaggggacaaccaagtgtgcatggtggtgttgaagatgcagggaatgaaaccccttatgcaaacagcgatgaggaggactcagtagatgagattggtagtgatggggaggtgaggactaagagaagtaaggaaccaaggtacaagaagagtgaaggtgtgcctaagtttgaactagggatgaagttcaactgtaagaagcaattcaagaaggctattacaaaatatgctcttgcagagaagaaagtgattaactttattaaggatgatgggcaaagggtaagggccaagtgtgattggcataactgtccctgggtatgtttgctatccaaaaattctaggtccaacagttggcaaatagtaacatttgaaaatttgcatgcttgtccacctaggagggatagtaggctagttacctctgttagaatagcagagaagtatggaaacttcatagctgctaatccttcttggctacttgctcacatgaaagctattgtacaagaggaaatgtttgcagatgcttctgtggctaagttgaagagagcaaaatggcttgtgcaaaagaaaaagtttgaggctactaaggggcaataccagcagttgtataggtatcaactagagcttcttagaagcaaccctggtagcactgtggttatcaacagagagattggcatggttccaccagtctttaagagaatctacatatgcttggatgcattgaagaaaggtttcatagctggctgtaggaaagttgtgggactggatggatgttttttcaagagggcaaccaatggagagctgctgtgtgcaatgggcagagatgctaacaaccaaatgtaccctattgcttgggcagtggttgccaaagaaaacaatgaggaatgagattggtttcttgatttgctttgtggggacttgaaagtggggacaggggcaagctgggtattcatttcagatcagcagaagataatatcattacaaactgcttttttcacttgtaaatttccatcacatgtcactgaacctttattttttgtatttccatacagggtatcctaaatgctgttgagaagtgggcactggaggctaggggtggaaacgagccgagccaagccttagctcggctcggcttgcaatggctcgcaacaagctaggcttggcttggctcctctcggttagggaaacgagctaaaacatgagctcggcttggctcgtttcttggctcgagccagctcgagctagcttgcaagccttccgttgaagctatataatttgtaatcattaagaaaagcaataacaaatcatcaacatgtaaaattaaaataactttatatattcaattcatcaagatctagacgataaattacatattaacaaataataactccactacaaaataaaatcatccatataaatatatgatggcctaggctcacgagccagctcgggcttggcttgttttagaaacgagctgaaaaggaggcttgggcttggctcgtttggcattcaagccgagccgagctaagcgagctcgagccaagcctgagctgagctcacgagcccgagctttttttccacccctacctgaggctgagcacaggaactgtgctaggcacatttatgccaattggaagaggcattttcctgacaagcaattccagaaaaagttctggaggtgtgcaaaggctccctgcaggatgttattcaatcttgctagggcaaaacttgctcaggtgactcaagctggagctcaagccatactgaacacacaccctgagcattggagtagagcctggttcaggttaggttctaactgtgactcagtaaacaataacatgtgtgaatctttcaacaaatggattttagaatctagattctatccaatcatcacaatgcttgagactattaggagaaaggtcatggttaggattagtgatcagaaatcaaatggtgcaaagtggacaaatgttgtatgccagggattgagaaaaaactaaatgtttacatagctgagtcagccttttgccatgcaatttgcaatggaggtgataattttgaggttaatcaccatgaccataggtttacaatacatttggacaaaaaggaatgctcttgtaggtattggcagctgtcaggactaccatgccctcatgcaatatcttgcatttactatagaaccaacaagctagatgagtacatagcaccttgttactatgtggatgatttcagaagcacacatgtgcactgccttcagccagtagagggaatgagtgcttggccggaggatgatagagaagcactcaatgctcctggatacataaagatgccaggaaggccaagaactaaaaggaggagggagatgcatgaaccacccaagcctaccaaaatgtccaagtatggtactgtcattagatgcactagctgcaagcaaattgggcacaacaaatctacctgtgcaaagcatcatggtgcaagttctagcaacctaggcagttctgagtagcttccatcaccaagtcaacagatggtgttatcaaacacaccaggcagttctgctcaaagcaggaagaggaaagctgtcagccttactacaacaagcaccacagaacattccaagagcaaccaatcaaagagcaaggtaaatggcaacaatttttcactattttcactttcgctaactttacctaattgccatactttcccactacaggcagcaatggatagccaggaagtggtcagggttgctgcaaaggccaaggtttcaacagctcagggtggatctgctagagtagatcttcaagcaatagttccccattcaaacagctctactactgcgtctgtgaggctcacatctggcaaggcaactgtcactgtctcagctcaagagcctacaaaaaacaagccaaagaagagagctggaggattacttattcttctgccctgggaagcaaagaagctttgaatgtgccattgtcagtaatgttagtgcaatatttgaacttcttttgtgatgtaatggcagactatttagccaagtaatctgtgatgccaaaatgtttggctatgtgatctctatgatgccatgctatttggctctcttatcagtgatgtaagacaaattatttatgttgtcatgccagactgttaggctagctatgtcacttattatgtgtatttgaatgtcagacaatgaatgtttgcttatctgttactgctggaagccaaatatggagtcacattttgcattgtcatgaggtttgctgcagaaattggcaggtttcatacactgtttgtatttgtttcatttcctgctgacatggacatttgctgcagaaattgacatgtttcattcactacacaaatggatttttcatacaccgcttgattttgtttccctgaacaaacaccaaaatttgcacaacctgatacacattgcatgctgattttctttcagattccatattgctcttaacacccactcattcacaaatttaattccaactggatagcacaagtgcacaactgatacatacatattttgacacatcaaaggaaagacttgatcacaccattcagtccacatagcatatagacaacacacatctaacaccacacatcagtccacacatcaacatgtctcattccttcccaactaacaccacaaacagcataaaaatacgtgacagcatacagattacaaggatttttttctccttctctaacttttgattcctagccttcaagcttctaattttttcctttttcacagcaaccatagccctcacatcatctatttctctcctctctcgctcccccttagcccgactgtcttcaacttccttatgcaacaattccttctccctcctcaacgaattcaccatgtcccgcaagtcattcaatagctcactgatgaaactggaagtcgggtcgtcacaccatgcccagaaatcacaccccccaacctgaaaccacaaccctacattcaaatcccaaaccgtccaaatccaaattcaacaacagaacaaccaaaagccctcacttaccctagcatgttaacacttgtagtatcggcgcccagggttgtccgtgctccatgagatccacctcgccgctttcgccgggcatcggcatcggcacatcaccgcgggttggtaatccagaggaccaacccggtaaggcacgggagaaggcttccactgatgggaagacgacgagccgtcgctcatcgagctcgacatctccgtaccgccactcgccaagtcgccgccgctctacaaatcgctgccgccgccgccgcccgctcgctagggtttcggtgtttgggggagaagcaaaccgcgccaaacatttccctcgttatatcctaactaccgggctgctgagtcaacaacgacgaccgaggtcaaagcgccacgatggacaaaaccgctgccacgtcggacaaatcggggagaaatcctgccctgggacctcgggtgaccggtattgcatacttaggagaccccccatatctggtattgcggttggaggacgttttagtatcttggtgacaagttcaggacctccggtacactttttccatagagaagaagtatataatacaattttatttttttgaaaaagccatcgattctgtcgatgccgcagtagagcccattgggccaaacctggcccaggactagaatacgcgcgggccaagaaacagggcgccgtgtcgcacgtcgaaaaccctaaaaaaaccaccgccctttctccactcctcccgacgttgccgcctccgcctcctccccctccatcgccggcggccgcttctagccggagagaagaaggcatgccgcggacgagcgtggtcgagagccccggctgcccgccgctccgggccctcaccaccgacatcctcggcctcatcaaaggtagcccgtccccacccttcccgccgccgccgccgccgcggcggcggcgtgctggtttgcctcctccggtgagagggctgatcatgttttgtggtattcatcctcaaccgcgcagtcgtggaggcccgcacgaagccggcgggcgtcgccaaggtcgtcgagacgtggggcgcgcccgacgcgccccgcgccgtcctcgccgcctcgctcgccgaccgcgccgtcgaccccgtgagtgttcgcgacctcccgttattcctccccgcggtaattggtcagagtatgatcctcactgcgttcctcgcttcttctcttcttctacaggttttggccgtggcgcggaagaacggcgtggtgagcaacgcgtttgcatttggagagctgaagcactcgttgagcatttttgtgctggttgtttattgctgtgggttttgtgtgtaggttgagctgctgaatccactgaatggggagactctcgcaggcgtcaacgctgctgctgggcgggcggcaccggctgatagttctgcagaagaggaccccttagccacgctgcatctcttcagaagacatgcgctggactcatccatgtaattttcatttgatgctctttggcaatttattgtgcacactcaatttgccatgtagatatgggttatgaatccacctgcatttgtggtctccatgctttagtgttctttcattttgtagataatggcatacttatgatgtattcattgcatatgtcaggttaggcacatttcttgcttgtacagagaaggggaaagcatatgtcaagtctgtcgcaaaggaaaatgcatcctcggacatggctgttgggccatcaagctcatgggatgtgagcaattcgggtacagtgcaattttcttcagtggatgctggtgaaagctacgcgatgttcggagggtgggtttacaataatctttatattcattatgtagcatctaagtgtactataaaaaaatattgcttctgattactaactactcaattggaaacatgagtagcttttatgaaggttgaggcgctaataataatatttcattttaggaaaggaatagaagtcaatttgtgggatatcacatcttgtagtaagatatggtctgccaagtctgtaagcactcactgactcacaccttttatcctttttctgggtctacttgcacttttatctgatgttatagcagactgccacgcattaactacttcattcttttttttacctgaagcctcgaggcaacagtcttcagatattcactgcaccttggttcactgctggaacttttttgtgcaaggatgaccatcgtaaaattgtagcctgcacaaataatcatcaggtattgctgatatgctaacaaaaaagatccattttcaactagtttggtcaaactgctctgtttctgtattgttgtctcattgaaactgatccaactttataatggcaaagcagaatgattgcaattgattagttttttcatgccagttagttgtcatgctgtatagtttcctcgtataataaatcatgaaaccgatactggattatgctaaataggatgttctcatacatcagttttcatctttcaaaataacactgcattgatgaggttttctcaatatttgtacctgtggtgcttcttctgattgttaggttcgcttatatgacactgcttcccaaagaaggcctgtaatttcagttgattttagggagtcaccaatcaaggcagttgctgaggacccaaatggacatgctgtctacattggtacaggaagaggggaccttgcttcctttgacatgagaacaggtattatatgatagtagctggtgtgtgataattcttgctgatggcacttggaagtcaaaatacattctgaattatattttcagagttgtagcttagtttgaattttgtatctagtatactatagttcaaataaaaatctcttttcattttcgtactctaaagttcactctggcatgtgtatttcattgtactattttttggctaccatgctctgatgcttacataggtggtacaacattggttgtttatttattttcctgatcgattcatagttagttcatcatgtgctatatggatacatttaactgcctggagaagttttatttaaatttaacttaatattctgcaatgagcttatgcatcatgcacttttttggaggaacagagaaaacaaatatgcatctctgtgggtttccaggaacatcaactgtgaatcaaaaccttcggttgaatattcttgctaaaaatgcacctcctcaattgattcctgtgtacatccctcaactatagcatgaataaagttgtgctgttatggttcttgtactaacctgagcaaatatgccaacaaattttcaggggatttgagactactaaactatctgtgagtgatattgaaataccagataaattggtttcaattcaggcgttagaaagatatcttgttcatgtcccttatcagatatcaaaagatgtttgattattgtatgcttacaacattctagattatattctatgtaaattccttacactttgcaatcggtattcactttttagttctttttaatgtatctatttacagaattaactttagcttgcacccttttcccaggaaaactacttggttgctttgctggtaaatgcagtggaagtattagatctatagttagacatccagagctacctttgatagcatcttgtggtaaggctgcatattttgaaaaaatatttttccaattatttcatattcatttattttgagcgcaaatttattggttacatgtatttgtcttgcacacctttactagtctaggttattctgtttgcattaactcaggaaaccaatttactattgtaggactggacagttacttacgcatctgggacacaaatacaaggcagctgctctctgcggtacgtttaacagttaatttcatagtattcaaatactatattttccatgcaattaacagatactgtttcagttctgcttttatttgccattgcttcattttggacataccatataagtgaattattgtggtcatgaagacatcatgggctagtcaaacattttagacttaaccttggggtactcttttactggttggcatgcgcaagtgtattggtattggtattggtattgatttttcttctggccacccttttgctgtctagttaattgccttttggtggttgttttgctagtttgctgcattctatttaaaattaagatatatctcccttcggaaattacgtgcttcacagtgaagttataatgtaccatgattcttgtgcaacttgaaactgtgtccaggtttaaacattttatccttgtagttgcacgatctaatgctcttcactgtcctgtttcgtaacaggtcttcctcaagcagcacctgacagctgtggttattgattcacatttctccactgaaggtaccattccatttattactgttctttgtttaccaatgtaattccagcacacatcaccttaaataatagtgagacttaatagagcagtgcttctattatcttgaatagaagggctagttaagatagtaatctacatctttcagccctaggaccccaaagcccaagatgtagtgctactcttcaaactttttgaaacgaagttcattgccatatcgaattgattcatgaagaattccacgtgttcatctacttacgctcttgttggatgttcagaactcgaggagactaaatccaagcagccagatccagttggggcagaagttagaaaggaaagaaaggaaaagaagaatagaacgagtgaaatggatgaagacgaaactagaatgctcgaccatgatgacagtgattctgaaatgcacacctcaaagagaaaaaaatctggtgaaaaaagcaaaggaatgaaaaagaaaagcaagaagcagcaagtcgcatagataggacacacaacactggagtcagtgttgaccagttttgactttttgactaaggtgctttgcccttcactcgattttgtacaatgaatatcatttgtattagagtttattcgaactcgaacaatagcacttatctggattctcaattcttcaaatacttgccgggccaattaagtattttactatgccttctgagcaatataaaagaaatggcgtattatcaccccttttttgtgtgctagtccgtcctttcttatcaagctgaagagtttagttttgatcatagtgtttccttactctatataaattgataagagaagtgcacattttgtccaattttggtccatcaactataaaaccgttcattatagttccttgactcttggaacagtccacatttcatcctacatctaaactgggggtacggtaacatggcgcttgagttgggtccacatgagcaaatagtaacggtatgaatatagcaaccataatgaacgacagtgaaacaaaaacttgaacaaatactaaaaccttgcctccttttcctttcccatatctcaaattttttctttttgaacaaatactaaaaccttgcctccttttcctttcccatatctcaaattatttctttttgaaagaagctatatattatttaagaaatttctaattaagattgtcatgtcacacggagccacatcaccaaaagctacgaaagatgaggtggtttgaaagagatcaataatgacgaccctctaaaactcagtattaagaaaacatagagtagaaaaaaaagtaagaatagaatgtcatactcattgaattcctataagattctgaagcataggaaagtttcaaattgtctttgattagcacatagaaaaaacccaaaaattctacatgaaaaggaaagcatgtggtgagacctcatgtttatttttatctaaaattgctctaggatgatccattccataaaaatttcaaaggaatggataggaaacaattttgttttaaagggtttgataggataaaatcagtattactatggtttttcctttgtttcaaattcatgtggttttttctttgtttcaaagatggtctgaagccttgaacgaattcatagtgaaggactaaatttggaccgagcggtcaagggattaaatatggagcttttccaatcgataatggcatggaagtagttagtggagtgaaatgagcttagctgaactggttaagttccttgcggtggaactacccacctaagtatcctatatttgatacgtgtgctcgtatttacggctaattattttttcagtggtagataatgtaattgttgatagcgagacacctctctttcgttgtaaagttgttagtggaaatctgatgcacgccagtttcctactattaatgccaggaaaagaaaattgcccatttccatgagtggtacaaggggaacaaaattaatctttacatagttcccttcaaggcttgaataactttattaacatcgtttccgtatgaacattttgcttatctataaactattaacttatctccatatatatatagcatcttcagaaggatcctggcaatctcctcatcacaacaaccatgtgatcatatgacagccagaacaaaaaacaatggcagtcttctcgcaacaacagcaatcatttgaccgccaaacatcccaattgtgctggataatttgcagagttcaacagtttcagaccattttcctcccagccttcagctattacgctgtcgttctcgaatccggggacaaactcatcaaaatctgctaacgatttaagttgcctgttcagtgaagctattgtcttctggcagtctgccagtttccctgctgcacgagctagctctttctcctgcagaaagtggtgacatctcattagtagcatacaaactaaaagttttagtgtttgtcacaaggcttgattttgcaatatatatgataaatcactgaataaatgtacaattagtactatgaaattcacctttttaatgtgaagttctttacttgccataggtttcattggttggctaagagctctgctggtaaattgctctttcaaattctgacattgcactccaagttcagaagattgtgctttctctttgtgaatttcctcctcgagcaaacggatcttcctgcgcaattcctccacttccgcctctttgagctcaaaccgactggcgaatttgttcttctgggcttcagaagcatccaatgcagtaatgtaggcagatgacaagttcttctggctttccagcttcttctccaacgaactgacatgatccttcaggcgcatggcttcagcctgtgccaacctgagctgggactccaatcctgcagtcaatggcttgtgcttctcttcagcctcttcaagcatcttaaccttctcattcaggccagcgatttctgagtttgcagattggagctgagatctgagctcatttgtctgcacacccagtgcctctagatcacaagaccgtgtcgcgagtttctcagacagtgccctctcctcctggattttcagttccaagatgctaactttcttctgcagagatgcaatttcctctcgtgccgactccaactcatgctctgtacccttcttcttctcttccagagcttcgattccatggcacctcactgcgagccgggttgaaaacgccttctcctcctccagcttcttctctagaagagtgatcttatcaccgagatttttggcttcagattgtgatgcttccaggtgaccacgcagctctctcctctctgcctctagtgcatccatctgctgatacttagcagccagctccagcgtcagcgccttttcggactcgagacgttcctccagaatgcggcccttgtcgagcaagctcgtgatctcgccatgggcgagctcaattctcccctccagttcattcctcctgttctccatggcttccatttcggtttccatggaatgtttcactcccttgacaaggttcagttgcctctgcaattcgaccgatttctcctctgccaccatcgcccgatgccgggtgttcctgagctctcgctgagcttcgtgcagcgccttctccctgtccgccttctccattgccagcctcttgatcttctcctcgagcttcaccagctggacgctagcggcgtcctcggcctcgctcttggatgggctattcgccgacgcgatcttctccatctccaggaagtcatccatcatgccgatgtctgcagccgcgaggctcgcactcctcgtgatgctcttgtcgttcttgaattgatcgagctcggtgatcagaatcgaggcccatgagtccgagcagtctgactggcaatcggtgactgactcggcgtagaccgagcttggtgcacgcttgagttctctccgtgcattggcctgccaaaaattctcacagatgttagtgttagagagagttattagcggactcatgggccttgagttggtacgtgaaactaatgaaaatgaagattaagtaagggcacggaaaacaagaaatctcttagcgcatggttagatttatttgacattttagggtaacttctatatacaaagttttcgtgcaaaatatatcctacttcctccgtttcataatgtaagtcattctagcattgcccacgttcatatagatgttaatgaatctagacatatatgtgtagctagattcattagcatctatatgaatgcaatgctagaatgacttacattatgaaacagaggaagtattatttagcagtttgaaaagcatgctaacggaaaccaaggtagaatctacgtactaatcagaagagatttgcttcggtcctggtgcatggttcctcgcggtactaaatcattttcgatcgttaaatctagctaggtagggtggacattgttagatccaacgatcgaaaacgatttagtaccatgaggtactttttattgaactggagcgaatttctgatcagaaaagaacgggaactgtccaaaatgcagagctgttgggggaaaaaagaggaaatggcattacctgcagccttctgcattcggcttcgagcttggctatcttcttgatgctctcaagctgctgcttgctggccgtctctgctgccctcctgttcagctccttctcgatggtcctgagctccacctcctccgacatggccagcagctgaaccttgagagcagagttctccttctccaaggaggccagccttgagctcgcatcagtttcagcgttcaccgagaactcggacttcgcctccagcttcgccttcagctcgactactcgcagctcgaggtcggccttctccgactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgcatatgcagtatatccaggtccaaacagagtcatttcttaaattttttggcccagcgaaaaacaataatttgtttgaatttttgcttcatgtactgaaactgtacgattcagtcatgtttaacatcatacctagaacagcttcctccgcaacttttgaatgctgcttcacaagatcatcttttgcacgtatgtccaaaactgcagatgacagtctctcgctcaacaccttcaccttcacattgtcatcctgcgcttccttcgacgagatctccggtgattgaactgagcttggagaactctttggagtatcctaaccaagaacaaacaggatcaaacattgtcctgactagaaagtgcaaaattaggaggctattcatgcaaaatttcttgtgaacttcagctattagtcatgcaacagtattgcagaacaaagggagtggctgaagtaacaataagaaacctctattggatgcatctgaaaatttggaagaatcaattatcaaagtattaaatactgttttttttctggacaaaagcaaatgagcacgtgaagtacgacatggtactttctgagatcatgttcttgcatgattcccaacattatgctcagagaagcacaatgattaaggggattcttaggactttgagcaccattactccataatcatcatcatattaacttctatacaataggacacccctaattaaatgcacaactccatcagaattccagacatttctttggaggtacaggtagagctgatggtcaaagatcaggaattcacaagtaaatgttgcacatgaacagaggtgagagagagagagagagagagagagagagaggcatcttgattgctctgtgccagcagacacattatgaggcatttgggttgggccaaagggtgatgctgcagcacatggagatggatggagtggccaccaaagaaaatgcatcttgccctcatgcaagccataattcctgcagagaaaagctagtcccaactaacatcacatccttgttgtccatggataggtaaggcttgtcctataatcccttcccggtatagaaacaaacaggacccctctctctcattctctccttcagtttacaggcctacccaaaaactgtgacatatgatcatggactaattgccagtgtcacctaccaaacaaaggaagggaaactgaatctatcttacagtcccctcattttgtcatgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtagggctcacaaagtcaattgacaatcatcaattcgtttgagcatgcttgcacaacactcctagacactagacaggtattatcattcttcaacatttgagcctcttttactgttacccagttactttttcctgctccttggacccattggtagtttgagaaatgtgagataaacatgcggaaatgaccgcgatttcggaaaaaaaatatgaactttattttccgagaacacgcagaagagctgcgtgtctttggattggtaggaaaagattactgcccaattatcgtgatattctaatattgcaagtagtacctactgtttgactttaaattgtgcaaatatgtataaacttctgaaatgtgaatgcagtatacagggagaagaagaaagagagtgacttgttttttttttctcacctgttcatcagacagcctctcggatggagaagaaaccgagctctcggtctcggccgggctcttctccgtcgatctccgccgccatagccagctccggcgatccatccctggagctctctacaccattcggctcaatgccgatgcttctgcgcctcaatctctctgcttatctcactgtcttcctattcagcaatccaaattcgatgagttcatttttttttctgaagaaaaaggaaagaaattttgcctcttatattaataaagcaggaattcgatgagttcatggtcgcacaagaaaccaaacacacagaaaggaaaaaaaggagttgcagcttttgtatttttgtccgtccaagaacacaatcaaaaagccttcaaaaagtcaacttgatacagtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagagaagaaacaaaaacagaaagaaaaaaaaaagaaagaaaccatcctacctgccatccatggagaatgaacagaaaacaaccatcagatggattagctcgtactgggccaatccaagaacaagcattgcatatcgttttcacctcaaaaaccacccaaatcaacccgaaagatttcatcaagaaaaccaaaaatcccagaacacgctcccctccactacaaattaatcaccaagaaatgggagaagcgaaggcagagtccacacgaacaggacatgaatccaagcagagaagaagagcagtggagcagcagcacacgcacctcccggaggaggccgagaagcgtgacgagccgcggccggaaggaagcgaggcggcgcgatacacgagacccgacccgctggattcctcctcctactcttcctcctttacctcgcctatttaaaaccgcgaggtcggagagtacaaaaggagtgtgaaaaataaatacttgaaaaaaaagagagaggaagaaaggtgtggcgtctcaatagggagaagaaagaaatggaggcttcgatgtggcattttcacgcgagataagggtttgatgaaaaaaaactgagaaataggaaaaaaatacagtattttaacaatgataagggcccctttgaatcaaaggaattataaaggaattttatagggttgaaatactataggaaatttttccacgtagccctttgattcaaaggattgaaattttccaaatcctacaaaattcctatggaatggcttgttgcatataggttttagaggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttagcttgcaccttcgcctggaagttaaatcacaacttgtccttgagtgaggctcagcgccgtcactcgcctgacaccggggatctccctgttactcccttattaatgggcggagatttgccatggctgctttccaaatgaccatccgacgagatgggtcatacctacctccactccaccggaagcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccataggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataatgagcggctttctttaagaccgctacattacttaagtagcgcgcgaaccgggacgagccagttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccatttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgtaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctcttcggctgttccggtggttcttcaccgtacagccggtgttgccaccgtcggtagtcggtggctgctactttcagctgcgggggccagtgctgaaccgctacattccctgcgtccttcgcaagaagtgggacgactggaagagcgactggttctacacccctctcgccgacgaagcgcacctccgacttccgagccagcccccggcgcaggcctccagctggcgggcgccggtagatctgggagatggctacgacgccgttcttgaccgcctggcgggtctgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggatttcaagatggtggtccaacgggtgctgaatctcagctccgtggaggcatccctcatcccccaaggtgtcctctccctctgcagcgatccagagcgcgccaacatcctgaccatcatgcaagcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggggaccgaaccatgccggggaaacctcatctcccccccaaggtggtcgtttagccgacctcctcgcaggttcgtccccgcgcccactgcggccgtattcattctcccaaggcgagttttcacttacccgtttctttttgtcttctggtttttcttccgctttcagcgagattccgtcgcgtccccctcgccattccatgtccggccggtctgaggccgaggagacagcgaccgcggaggcccggaggcgggaagctgtccggcgagaagccgcggaccgcctccgagaagctgaggaggctgcccaggaagccgtccgggttcgccaggctgaggaggccactcgggaggaggccagactccaccgggccgggaagtcagcccgggaggcagaggcgacgcgcgcacgccaggcggcctgccaagcccccgacccgactccgcccgaggcgacgacgacttccgaggccacccacgacgaggccgcgggcgcaccgctcggacccgacccttcgggcgacgttcgggacgagccagcctcgggggacgcccctgagtccggcacgtcaattggcgggccgagccgcacagcgcccacaccgaggcggctctcccctctgccttccgccgctccactgaacacagagcccctcctgcaggccctggctgccgcgaacacgacggtgctggacgggttaggtgcctagatggaggtcctgcaagcagagcgggcggagctcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccacgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcacagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccagggggggcctcgcccagcgcctctcagagatggccgggactctccagcggctccccgaggagctcgaggagacgatcaagtcatcctcgagagacctcgcccggggggtagtggagcttgtactggcaagctaccaggccagggacccggacttctccccgtgggcagcgctggacgagttccctcccggaaccgaggacgacgcgcgcgcgtaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatgcacgtgtcgagactagccaggccgggagcgtggtgactgagggttatggggacccgattgtgggcctttgccgattcccccccggagttcaccactccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgagggggtgcggggttggcccgagcccgagacctgacacccgacccccactaggggtagaaacgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtctacacagagtgatcgggcccggacgtgacgctgatggtagcgccgtaggctctgctggtagcgcgcggctcgaagggccgcgcgccgccttcgttcttccaagtagtcaaggtcatctctgcgaagctgatcttgatcagcctcgcagtacatggtggcccgaggggacctcagggtgagctcagatgggagaaccgcctccgcgccgtagacgaggaagaaaggcgtttccccggttgctcggcttggcgtggtttggttcgcccagagcaccgctggcagctcctcgatccacgagtcgccgtgcttcttgaggatgttgaaggtcttggttttgaggcccttgaggatttctgcgttggcacgctccacttggccattgcttctggggtgggcgggagaggcgaagcaaagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgtgtctgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcagcgtaaagcatcttctgggcctgagggtattgggtcttggcgtcccggagggcctcactaacaaagtagacgggccgctgcaccttttgtcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctctttgtccgagaggccgcgcggggcgcactcggcttctgtgccgacgacctcggggtcagagggcgacaggcgcggccttcccgcagtggccttggggccatcctggggtcgggggcgcctggcacgtcggacaagcgggcagagggccagttccggtcgttgggggcctcgggccaccgttcggctcgggggcctctcctccctgctctctcccgggtcgagtcgacacagggtggggatgcgcggagcgagggtcgtcctcgtcgcgctccacgaccaacgctgcgctgaccacctgcggagttgccgccaggtagagtagcaacggctcctctggctccggggcgaccaggactgggggagaactgaggtacgccttcaactgagtgagggcccgttcagcctcctccgtccagataaacggcccgaagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggtctccagaagtcgcgccacctcctcgcggatgaaggcttgacgttcctgggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgtggagggaggtattgtgcacggtgcaccacctgccggtcgggcgctccctactgggagcgccggcctccttctttttgtcgctcgcaggcctcccctttcgggtggcccacgaagcgccctcgacggcgaggacgtgaccctcgtcgtcggaatgggccgacctcttcttcctcctcctgtcccgccaccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacatggggggctggcccccgtgcccggaccgaagtggcgctccggacgaggaagcgccctccgatgcgtgggcagcacggcgatcattgcgccggcgctcgatattgaagcaggcatctggccccctacgcacatcttcttgggttggaggcgttgacgagggaatggcggacgaacggcgggtagcggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgtcgggttggagtctctggatcagggatgacgggtgggtgacgcaggagtgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccactgcccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcccgacccccccgaggggtcaggccacgtgggtgactgcagctgctccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataatgagcggcttccttcaagaccactacattacttaagtagcgcgcgaaccgggacgagccggttcgtttcgtctggagatgtgatgacggtgcatcggtcggcgagcgtagttaacgcgcgcacgattagtcccatctcaactgccacggccgcacatccgcctcgtgcgccgcaaacgggcgagcgggattagtggaggcgcgggcgcgagagacgagggggcgaggtagtgggcgcggggatcgagagccgggcatagcgttggcaagggta

SEQ ID NO: 75282 - DNA, 2404 bp, Oryza sativa
taatgaatatacgtatcataaagttccatctctccaacctgaaacttcaatgggcagatccgcagaagggattgtagttaaatttagaccttattggataatgatgatttagaaattgcacactaaaacacacaaaaaaggctaccatttcttttagaacctttcttactgctgatcatttcaaacgtatgtttgacaaggataataaatgaagtatttaattacctttagtcacaatcatggccttcctacgaagacccaaaaatggtccaaaagacaaatcattgcattgtggtgcaaccttggtagggtagagcttatagtgacgatggcatatcatatgtttctcatgtgatgacattggatcatcggccatcagttttggctcagctgcaattcaaaacaacaaacaaaatcaacaacatatggagccagaccagcaccaaactttttttttctaccaactcacagaaagagagcctgcggtaaaaaggaaaagaaaagaaactgatccttgccaaatatgcacacaagcaaagcaacaaatgtccgcgacaagaatgaaaactgcaggggctataaaattattctccagttctcctacaaaacctaaaagagttagcaaatgaagcatggaaggatcactaaagcttttccggtgtaacaattgtgcaccatatgccagtaacgcattgcttctacctagagcataacatggatactttctagcttgacgaaatatcgtgagttcttaagtatacgaaaaatcttgtagtaaatagcttacaagtaggtgtaaaatcaacaatatgaatccctgaaaacaagagcaaaagaacaagccttagctcatacaaaaaccaacacaacagactgcagcttccactaagcccctttttttttctttgggtaagaacaaacaaatctcttagcaagacgcccgaccaaattaactgaaacgtctgagccccgctcctctcccaaattccccaattcatgtcacagctagcagaagcaagctatccaatattgcaaattagtttacagaaaccaccgtaatctagtgttggtttctaacaagtcatcaggaggcaaccagtaaaatcaacataagctgcaactgctgcaaaccccttgtttaaggaaactataacatagggtagtggacaatcaaagcaaggagggaaataagcaagcaaagatgagatctatacctgaaatttccttagctttcgccgagcatccttgctcagaagagccttcgtgcaccaccttgtctcctcctcctccccgacctgtatacatacagcgcacgcaaaggcatcgccgtaaaaacccaagaactcgaaaccatcaatatcccaaagaaatcccgagcaaagaaccacactcactggcgttctccacggccaagccacgccgccgcttgtgcacagccacgccagcctcctcggccaccacgggcatcttcatctttcggcggcagttcttgctgtgggatcggcggagcctagggttggggttggcgttggggtactcgtacccgcactcagggcagagctgacccccgccggcgccaagcgcctcctccttccccctccgcaccctgtcgcccttcatggcagctgctgctcgactcgccaccggccagtggcccgcgctgctcaccaaaacgagagagatgcgttaatgcgcgtcgggatttggttttttttttttttactttctacatccacacaaaatcttatactactattatgagaagaagagtatatgctacttgtatacatagggttagggatgtagaaaggcagaaataaaaatggcataaaaaaatcataaacgggactgtacggcgtaagcactcaaatactgataattaaggtaaaaaacactggactgtaaagtgttacatttaattttgcataataactatataatgtgacaaaatagattcaagattacactatataactgtaaattgtttccattcaaaccaagtggttgacaactcaaattagagattttgttgaggaattggtgggactctaaactatgagtcaaataaagaaacaaatagaaacgcggtaaatactactccatatgtcccataatataagggattttgactttttgctcgtacggttcgaccactcgtcttatttagaaaatttgtgcaaatataaaaaatgaaaagttgtgcttaaagtactttggataatagtaagtcacaaataaaataaatgataattccaaaaaaattttaataacatgaatggtcaaacaaaacaagcaaaaaatcaaaatcccttatattcaaaatcccttatattatgggacagagggagtatactataaaagaggtaatttgcataagaatacaacaaaatttggaaacggacgg

SEQ ID NO: 75283 - DNA, 12069 bp, Oryza sativa
caaaataatgatatctctccattagaatcagattttctttatgtttctgccacacctgaaaagaaaaaaaccatttaggccggatacacgatgtgcatcaatgtaaatgatgaattaattcagcccttcaacatttaaacaatacaggatgaatgtttctactgctgtgtagaagcaaacatagaacagtcagagaccaaaacaaactttcagtggccaaagtaaacattaactagttctaacaaactacagacggtaattactggcagtattatcatataaaatgtttatcaaccatgttcactggattatttgcacttacatactcagtgtcatcaagaatcactgcaacactttcatctccaagaaccacatcaagacctttctggtgtcgctgagtgcaatcagagttcgaaatcacctttgagccaaaatatacattatcagggtcaagaagttttgctatttcaattgcataagccttgtcacccatagtgtatatatacatctcaaacatatcacttgcttcttttaaaaatctacggacaaatggtctcaactttgtaagcatctgcattgtctccaatgtgaacaagcttctgtccggaacaactgcatttaagcatgtttctggttaagtaaaattgtagatgactaattcatggttaggcaacagatttaggaaggatcaaaccacaataaggtaatatggaagaatgcaacctcaccattaattagaatttagtgctaagtaataatgccataacttctatcataatagaagcaactagaattgatgttagttttacttttcagtgtctgcaagaagcaaccttcaccacaaattctaaatgtcataaaaatcacatttacagtgaaagaatatgacaaatagctatgacatttccgcagaattttcatatttcaatgtacattacaggccaacttttcccttttttttaaaatggactccaaacatacaaaaggaacatctagttttggactgaaggtagtatctctgtgctcatgtttacaaaatatcaaagtttgtaaatcaatagctaaaaacttacaaattctccaatttaaatacaaagacgtacacattaccttctttagcagcagattgaattcccaattcgttttcagcagcagaaagatcaaagagtttggttgagttgatcagtgtatgatccaagtccaaaatgagtactagttttctttctcgcaataaattctttaaatcagctccacgcagtctgtcaatttctgttgtacctagcctcaaaccctgcgttgaaataattctgttaaattcagataggacaattggaaataaaaatgtaactgggaaagataagaatatatcaagagatgcaatgcttgcataatactacgtactggaaagagtgtgattttgggaaaggtaaatgcaataaataagcattacaacacttgtattatagtaaggactgatttaagtcaaaggagccttaaaaattcaaagatattttccgcttcctgtttgaccgtaccttatggatgtaaccaaaagcaactcctggaacatcttcctcatcttgtcttttcccacatctatagcaaagtccaccaaaaaacccaggatgtggtgggcattcatcaattttaacatctttagaagaacctgcaacagtgtaccatctgctcatggaaataaaggaagtcttgacagaaggcaactgggactccatctaaaagtagaactgtagaagaaactgaagccaaatgtgaaaaactgatgttcctctctaaagtccagacacagcatggaacctcaacaattaaatgattaaaagcaataacatacacccccccccccaaaaaaaaaaaaaaaaaaaaactcctacgacacacacacaagaatggggacagtaaatctgtaaccacatcaactaaatagtatataaaaagtaaataaatttttgaacgcatttagtagataatcaactaatcaagtgccccccctccccctcctctatgaagccaaatgttagtgggttggaagtgaaacaaattagcataccaacggtatcctcatctgacttcattactactgcttgatgacggtgttggtcctccactctacgccgtttggtactgcatattgcatgccgttgacagcagtcagatccaaaatacaaaatccagaaaacagctcactattagtattttctaaacaaaaggacatggattgcatgttcagccaagctttagcatatccaataaatgaaaggaaaattttctatcataccatcaaataaccatttagttctatactatcggaattaaatttttacagtatgtattaatgacactcaaatagcaccccatttcatttaaacacaaccatcaaaagtgctcttttctgtcatgttgaccattttgccctcatccgcaaaaagaaaatttccctgcattcccacagctggttcttccctccccaactcatttcagtgccaagtcacttcaaactcaccaatgcacccccaagactgtcaatgtttacccaacgaatgtcaaaggcacggaccgcacagaagataagaagccatctccaacccctaatgggtgatagggaaccaagagcagcattgaaatggcaacttaggcatattatgattatattgtagtgtaccacaaaattccagtggtataaaacaagatcagtgatattttggtggtatacaaccaatttttccttaaaactatagcgcatttagttcaccaacatataggattcttacttctgcgtaagcatatttggatggccagcttattataggatcaacatatgctaatacgtattgcctgccttcagcatataaagccataggtaggcaattaagctaccacaaatgagaaaattttcataccataccagaactaaggaagttgtggtatctattcaaatcgtagaaagcaatctcatgggatctactatttggatggactgtcattcacaatttcacaattgcagataagcaaatcacttgtaggtataatgaaatgaagtgcaggctacatgaacagtacggacttcaataaaccctagaaaaaatcccccgcgatgatgatcaaattcgttgccatcagcattcgcacaactgaatccagcaaccatcgcaattcaagcggaacaggagcgaagaccctcgagcacccatctaaccggcccaatcaaacagtaaaaccctaacaggttcgaatggggaccaaatctgctcgccgtcaccgaccgtccaacaccgaaagcgcgaggagcacagagcccccgagcgcctcaagccgccgccatacccaactcgaccggctcctcgcccctcgggacgaggtgagagtacggagaggcgcgtacctgctctgctctacgatggcgtcctcttgttccacgaccaccaccacatcctcctcctcctcgtcaccaccttcgtcgtcgtcgtcggtggcggcggaggggtctccggcggaggccgagtcggcggcggaggtcagctcgagctccgcgtcgaggagcgccgcgaagtcgtcgctgccgctcgacgacgacggggaggacggcgacggcgactcggcggcgaggctcatgaccgagggcaaaggggcgagctttggtcggttggggtgggtggatgcgcaagtgttgtgtaataaatcatagggggaagaaaagctggcccgccagaagaaggcctccgtttgggcctcgtttgggccatcatctcaggtgaaacggcccatgatgccgcgagatctcccggcggcgggataagttcaatttgtctctcttaaccagtggccgaatcttatttgtatccttaaatcacaataccaaatatgtagaccctgaactattaaaaccggtgcaatttgactctctcgacggttttggagggtggtttcgttgactacgtggcggtgttaccttttctacgttctacgtgacgttgaccggatgaggcaacgcgcggggcgccgactccaacgcgaggcttcggcttgtgacttcgcggctcccgagcccagacgcgacgcttgcaccggttcctctgcaagctcactgacagcctgcgagaccacccaaactcgtgccagctcggctcggttccgatgtggagttttgagaccacagtccagggtcacgcgttttacatgacctaagttcgaaagcttgctggttcccacgcgattgacgatggattaattaaaaacttactcaaacacggatgacgtatcaaaatcttagcaaaaacatcttaaatttttataatagtagagatttactaataaaaataggaaacatatcctatgcacacaagatttccgtgcacaccaactggcaaatatcacgaaaaattctaaaaaaaatttggacatttactcataatagtactacacatatctgcaaaatctcatatttaaattcattatattttagccgtagcaaaaaagtgaaaaatctgacagatttaaggataaaaatttgtcagaattttatctttttttgttacggttaaaatataatgaatttgaagataagatttcacatgtaggtgtaaaactattggaagtatgtgtccaattttctagaattttctgtgatatttactagttggtgtacacgaagtgtccacgggaagcttgtatgcataggatatgttcccaataaaatatttttacaaaaatttggttttaaagtttttatccttgctaaaattacacccctaacgttatatgggaggctttttatgccgtggcacatatcctttggtatgctgtaataattgagcgattgataggtggtccccttgcagctcttaggagggtggcaaacgagttgcctgtaaaatagcgacatacgatattttgcaaggtcctggctataaatggccaaccctggtcattttataggtggtctctgtaaccctttgggagagcggcaaggagttgcttgcaaaatgaccggttatccttcatcactcgatgtgaccgttacaatgtgtcaatggacgtgtgccacgtcataaaaaatgcattttggaagggagaggagttagggatatagaattgtaaaacttgaaaaccagtttgttttaaaatattttaataagagtaaattgcattggagatacataaacttgttagatgggtacaatttaatgcataaacttgtgaaatgctcgtttcagtacacaaacttgtctagttagtgcgaacgaggaccaaaataacttggcaatattaattttacaaagctgatgttgattaagaattgtgacgtgcatacgtgtagtgagtatgcataaaaaaagcaatatttataaatttggtctctactttatccttcatcatcgaaatgatgaattccatatatcctgattggatttttttatcactgttggatttttttaatctttttctactattactatatcctattcttttttttattgaagatgtgtatgtctagtagcaaccttctctgatatatgtctacatagcatcctaatcaacttctaaatcaataagattagccatgcagtgtccttttcgtcttcccccgcatgcaccagacaagttcatgcaccaaaataaacattttacaagtttgtgcactaaattgcacccacctgacaagttcgtgtaccagcaatgcaatttactcttttaataagtaaaattaaaaattaaaaagggaaatccgagatctcccgacggcggcgcgtgtttcgcctgcgccgatggcggcagttggcgcggacgcccgacacgagatcgccgacgcgatcgcgcattcgcgccgcgcccaccagcagagcagaagtgcaggggagaccgagtggaggagccggttgggcatggagaccagggaggaatcccacgatgccagcgtcagacgagagctttgtcaacgacaacgacaaacgccgacgcgacgcgcgatatccccccagccttaacttaagatcgacgtcacgtcgtcgtcgccgtggagaaaacaatccccagagttggaaggcgtggagttgacctgacgcgggaggttgtgagaaactgagaaccaaccaaccaaccgctgagctgcacgcgtggttgccggagattttgctgctcgattcctgcactaccgctgctgcttccttttcgcgtgcgtcggcagctagcgcgcgcagcagcgagcttgtgctgaatacggcagtattgctcgctgtcgcgtggcgcgcgcactcgcgtagtacaccgtcgcgagcacgcacgcacgcgcattgcctcgatcgatcgagccctctcgacgggagttttctttttgtcgccggtgtgtctctccttttgtttactccctcgtgggctcctgtcaatcgtcatgtgcaaagccggtcagatagatagatagatattcagatgtttcgtcttttctcaggccgggagaggaagacaggaagagacgtcgaattgcacgtgttgtgtgcagccatgcaggtgtcaatacatgtgtgatgtgtctactaccaatcgcatgacctggtcgctcctttcctcgtttgttcaagtttaaccagtaaccacaccgacaccacgcgaggtccaattaagttcaatttcgctttggttttatatcattgatatgtatgcatggctgattgtttcgctttggttttattgagtttatgattaaacaaattaccaacttcaagcagtaccagagctagaggcactatcgaccctaggcgactaatatcgctcctaggtggctaggtgtccgatcacttcttgttgatatcgatggcaccctgcacccgatagagcaatctgcagtggagatgtaatgcgcaaattaagctagcttgggtggccgtccaactatggcctagctacgatacttcaagatttatcagattttgaggggaaaacattaaaattgtggtggttaagtatcatagtatatctattaagtttacttattagggtttaaaattctcgtgcgagtagcctttggatagatatcatgtgaggtccataaaaaaaattattaagcgctatctaatgtgaaaatgcaagtgtcggacgtccaatggacccgagaaaaatcgggcgccgcaccgcccgccgcccacgcgcgtgctccaggcgtccccaccacgctccacgtgtcccccaccacacgcgtccccgttacaacagtcgtccggatataacagaaacaccctattaagggaatccgttttatttttttccaccaacaatatttcagcaagtgaactcgtgatgtttcattatgcatgaataaaatgttgcagtgggttttttatactgtttaatattttccatcttgatggacacgtgggttgttgatatacacggggtttaagtgttgaatggcttcgaatcattcgttgcatacgttgaacaaaattgtttcatctagcgatctgaccgtgtttcacttttttaaagaattgaaacattctttcgctatttgctgaaactttatttttatatagggtaaaagagcgtctgattttttggaacccgttgtttcatatgttgtagcaaaatgtttcatgaggtaatttagttgtgtttcaactttttaaaagactgaaacattttcgatctatttagtgaaacatattctgtcagggttacggataaggtataccctctatccttggatatacgttgtatgctgacacagtatacctgtgcgtatacggatatttcctgtatatattaagaaaatctatcacgagatagaaacggagtccacagatggagggagttctactcggacaagactgggtcgttaccatatcgtgaggggtccgatatctccgagtcccacttggagatcaactgatccgcggtataaaagggaccccccgggcaggacctaagacatcgaatctcactgccaacacatacaccacagcctacgaagccggagcctacaggagccaagtcgccgggtgatctagtcgaaccaacttgactacgatctcgtcggtatcattgagttccattattccctttgtaatatgtgacttccatcatataatcccataccaactggattagggctattacctatcaaggggcctaaaccagtataatccttgtcttctatttgcttgatgtcgtattacgtagatcctcgtaccagcgtaccccaataccctctatatccggtctacgggtatcccccgtcgacatattcgatctttcaaaaatcgggcgctcgatttataggcgcctcctatctattgagcatataaaaaagggtgtatttgtactttgggtttgttggaaccatgccaccctatatttgcaaaatttgagatatgccacccgtatctcaatgacatataggacccacatgaatcgatgacatgtgggtcagggtggcatatcacaaattttgcaaaatttgtgtggcatggttcaaattgtcccttgtacttgtgtgacggtggtgtgcctccttcctgctacaaggaaaaaaagattagattttgagatgagccaagttctttaggacagatcagtatctagcttgtgtgaaatgtcggcatggtccctttcctcatttttcatgtttaaccacagtaatatccacaccacccctaaggtctaaggattttgatgtgcaaggctggttgcgtaacttaacttggtttcattggacttaccctcttcagatcaaattttctaggtggtttaaacatatagagttacgagatgacgatttgacgactccgtgttgatgcgcggagcaattttggacgctaacgtcatgacgtagaaatgatcaattttcagaatgaccttgatttcactaggttgattcacttttgtagaactgaatgaatgatcaatacagtgaatcggtaaagaaagataactattgccctaacctaatgctcggtaggaaaaaagacctaaagaaaggttttgtcagttgtgttgctaactccaatttgctacggaagtgaccctttctatttatttatttatttatagagatgactacactcgcgaaaacaaacactttgcacacgcaaaagtaaccaaagcctaaaactaaagcctgacataattttttgcgtaacttcacatagttgaaaactatataactctatcttcatttagatataaccaaaccaaattatgattaccaattgccttttcacattgtttggtcgtattctcaaatatagcgtgcgctctctctctctctcctataggaggatctctatcacatttaacagtttgttttttgaaactatcaaatacaactatattataattaaaacgtaaccctacatacattgtaattaatttgtaacatttatatacttcattgaaatgtgtatgtgggcaactggttagcagcacgaaccattgtcctacaaagcgggagtttgacttccactagcgtgagtcggataatttttctcggaaaatgctagggatcgggcgcccgccgcttcccgcgcctccgcgcgggcctccgtgccgtccccaccatgcgccccactacatgcgccgttgcaataaattgcctacatattatggaaacgctctattaagggaatccgttttaatttttgttctaccaacaatgtttcagtcagtgtactcgtgatgtttcactatgtatagatcaaatgttgcagtgaattaaaacatcctttcgctatttgttataacattgtttttatatatggtgaaacaacacctgattttttggaaaccgtttgtttcatgcattatagcaaaatgttccaagaggtgatttagttgtgcttcagctttttaaacgattgaaacattttcggtctatatagtgaaacaattctgatctatttggtggaacaacgtccgatttataggcgcctcgatttttctcctgccttgcatgaatctagagagaatacgacggtaaaaaaaaatcaaaagcgttgaagaagaaaagctttacgttcttcagaaattccgattcctttatatgtcaatttgacaatatcggctacgatacaagtaattactttaggccaaattaagtctccagcctgaatgtttttgtccacacatgtgctgggagtcaaatcagggtgtttttttttcttaagttatgcggatatgacacatttgggcccatgatttttaattaagtgtgttaacaggatagtactccctccagtccaaaatataagcaattttggatcctgacacggtcttcaagatgctactttgaccaacaatatctataaaaataagatgttttaaataaaaaatttgcatatatattatgatagtttgcttaataataaatctagtaacatcaattttatatgattgatctttttttttcttattaatggttaaagttaaaaacgtttgacttgttattatgctaaaaatgcttatattctgggacggagggagtactatctcagtccaaaattagatgtcgttttgacttttttgcttgtaaccttttaccattcgtcttatttaaaaattagtacaaatataaaaagaataagtcatacttaaaatatttttgataataaagcaagtcacaaacaaaacaaatagtaatttcataatcttttaagtaagacgaatggtcaaccattacaaacaaaaactaaaaacaataagtatgttgggatggagggagtattcacataggtgccattcaggataaaatgacttcaattttcagcagatgtgtgcaagttgagttgaagagtgttgaatacccggttttaaagttaagatgtatattttagattaacacaaaagttgaaattaaggaggtaaaataaacttatccctatgtaaaaatacctgcaggttgccatcgtacagtacactacccgcagctcgtccggccctacggggcccaagtgcaaaaaaaaaaaaaagcacagtcagcatccagatcacattcgtggacatcagcacagattctcatctagtcatttggttccggcagcgtcgctgcactgcatctcccttgtctccctctcacaagttttccgccgttcgcaaggcaaaaattctgaagcaagttgacgcagcagcgagagcgcgtggtttaattggttggttttgtgctgttttctctaaaaaaagacactgtttgttcgttttgttttcttgcttcagaaatgatcaacagagacctatacctgcataacgactcagaaatatcctgaaccattttaagccaagtgtttactactgaagaatatgatcacatatggtgacagtgacacaatggcatatcgattgtagatcacataattaagccacgggtttttcattcagatgcatccatgcatacatatgcaagccaatcaataatattgataacggctactaattacacctcaatcaccaatgatataacggagtcatataccgttcttgactgatgatcaatcaagaagctataaggtgagagaaaaatatagatcgaaagaggcactgtgagatgccagagatcaaaagtgttcgatcaatcacgtagttatggataccatctcctaggtagagatggatcaaggtgattaattaattaagcttaatttagcctagaaattgattgattagtagttgatgtgatgatgatgttgatgtgtccgtcatcttaaaagtggttcaggaggtggccacccagaatggggcagcctgctccggctcccacttcttgccgcgcctcgccgccgccgccgcggcgacctccgcctccacgcaccgcccgccgcgaacgtacttggcgacgccgccgtactcctcctccggcgtcgcctcgtcgccggcgtcgtgctcttcttccttcttcgtgacgatggcggcggcgtcctctgcctcttgcttgatcagttgcttctccttctggtggcactcggcggcattgctgcagccggcgcaggggacgaggaggaggcggaggcggccgccgcagcgctcggcctgcaccccggccgtccgcaccgcgtacaccgccagccccccgtc

SEQ ID NO: 75284 - DNA, 4026 bp, Oryza sativa
ctgtgaattgttttggtttgtaccaatcatggattggggttaggagttgctatgcataacacctgcaggagttgatacgtagagcgcatttatggtagaattcagaatacgcgaaatcagaaaactctcgtaacacactttttggcaccaagcatggattggtgttaggagttgctatgtagaacacctgcaggagttgatatgtagagcacatttatggtggaattcagaatacatgactctcgtatgtagtaggacacacttgtttgtaccaagcatggataggtgttaggacttaggagttgctgtgcaaaacacacttttggtagaattcataatacacgacatcagaaaactctcgtatgtagtagaacacacttttggtagaattcagaatacacaaaatcagaaaactctcctacgtagaacacacttttggtggaattcaggatatacgaaatagcggttgtttcgcagctagtaaattattgttttagctgtgcgtgtgtcaattgttttttttttttttaaaaaaaaatagaagtattgtcctttcataatgcgaggagcaagaatctccagcattgcgcgtgttgaataagttggacggaatcatacatctttttgtaatgattagagatttgcttcataaggagtttcggtggtcattagggtaagtagactttttgctgaaatctttgaacttctctaatgtacctggcattgttgtcccactgcagaaactgattctctttggagttccacaagaacagcttcaggaacaccaagaaggcttactcatttacttggaggaacacaaggagctgattcctgaaatcgccaagctcgtcttgtcagttggtgctgatttattggaggcccggaaagcatcgaataaggatggtgacagcagcaacagtgaagcatgtgacgagattttgtcttggttacagtggttaatgttcaacaatgagccacacgcgatgcttgatgacttggaacgtagcactgcaggggagcgtgctgtctgtggatctgtttggggacagaatgatcttgcttatcgctgccggacctgtgagcatgatcccacatgtgcaatctgtgtaccatgtttccagaatggcaatcacaaggaccatgattactccatcatgtatactggtggtggatgttgtgactgtggggatacaactgcctggaagcgtgaagggttttgctcaaggcacaagggggccgagcagattaaaccacttccagaggagcttgcaagttctgtagggcctgtgctggatgtgctcttgcagttttggaaggagagaatatgcctggttgaaggtccgccacacgcagagggtgatggtggtaactcgtgcaagagggtcgctgaagaattgacaacttgtgttgctaatatgctgcttgaattctgcagctgcagtgaaagtcttcttagttttgtcgcccaaagaatctgtgaatgtccagacctattagatgcattgacgaaggcagaaaggttgctggacaagaaggctgttaaaaaattgcatgagttgcttttgaaacttatcagtgaaccagcttttaagtatgattttgccaaagtttttatacactactatcctgttacatttggggaagttattaaagggtgcaacgattctctgttggaggagtatcctctgatgcctaccttttctgtgcaaatattcaccgtgcctacgctgactcctaggcttgtgcgtgaggtgaatttgttgggagttcttcttggatgcctgacagatctatttctttcttgcattggtgaggatggccatttacaggtatgcttgattcatcctatggcttgaaactatgttgacccagttagcgtgtactattggtattttctttcaagtataagatgactactgttggtacattttgtgccaagcatgtttgttcgtctgcttttgatataatgttaatgactcaatgttaatcatgtgccatcaatcctgagtctgttttattccatcaataattagttatactagcatctcgcaagcttatgcataaaggaaataaagacgagttacttggataactgggaatgggtttgacaataggcactagcattattggcttttaataaatttatattgacatagccaatgagtctctgaaatatttgtagatatctctgatgccttatagttcttgtgaacctgattaaggttttatttgttgggccttctatcattattcattgatcaactttgcactgtgattcatatagtataatgtgatttcatacggtcatgaaagtctttgtacgttgttatttgcagacaaacaaatggacaaacttatatgatgctactgtcagactattggaagatacacgttatgtccttagtcatgaggaagtttctaaatatgttgcttatgagaggcctgatttaacaaggtcatggattaagctcctgtcacttgtacaagggatggatcctcagaagagagtgacaagtattcatggtgaagatgagaatgagaacctatctgcaccctttgtgctgggacactatcttggagtttgtcatggttctttggtgaaaggagcatttgctcctcctgagcaacatgagtcaactgatgttactatttgctccactgcaacaaaaagcatagaaagttctgagaatcagcggcttgcaaaagtgggaagggtctcccaaaatagctcagtgtgcaatttaggcagcaaagacagttcttcagtcggtggattgcaccacctgctgcctggttaattcttcagtgcctgaaagctattgaaggttggctggcaccaggtatagctctgaggggcaagttatctttccttgatgcgagcagtagtgatcctcacaattttatggctttgcttgaggagcctttgacttctaacaaaggcaaaccaaatataaatattgctgaagtgaatgccaagataaatgaagaaccccgaccaggtgatattgcagatattcctgagtcatttagttcctctgttcaagatccggacaatctgatgctaattgatcaaatagggttgcctcatcctagtaacatggcaggcaaaagaaagatgcacgaaagtagcaatgcagcagatacacaattgcaccctgagaatgccatttcttatactatgactgacggcagccttttgtatgcccaccctgattctagaattgaggaactaggtataatcaacacagtaggctggcctcatgttgttttcgatgtcagctcacaagaaacatcatttcatatccctttgcatcgtatgctttctttcctattgcggaaggcaatggggaaatgttttggagaggatgtcaaacctgggcattgttcagttgtccagaccaatgagtttttttctcaggtacttagaggctgtgaaccctatgggtttgcgtcaattgtgatggagcatccattacgactaagagtattttgcgcacaagtgcgtgctggaatgtggcgtaagaatggtgatgcagctatactgagtgctgagtggtaccgctctgtgcaatggtaatttcatcgtgaccttaagtgagtttgttgtgttcaattaatagtcctgaaggtaataatgttactcgtctttccaggcttgaacagggtttggagtctgatctgtttcttcttcaatgctgtgctgcactatcttctcctgagctttttgttaagaccattcaggagagatttggactgtcaaattatacgtctttggatcttgcggaacagaatgagtaagtcacaggttgctttatcatgacagataaacttctatttctgtcatgtgttgtttttcgtaccacatgtagctacaatttagtttttggggttattacaatcacctttatttgtgtcgcaatcaagcacagctataatgatcaagaagttgaaaatgaacctgcacctatagttactttcttgttctccctcttgttttctcttttgattttgcagaatgttatatct

SEQ ID NO: 75285 - DNA, 2515 bp, Oryza sativa
ttacaattcccctaatcgatagtttgtctttatagtagtaactatattttgtttaatcattgagcgttcccacagaggtacttattcgttgtagatatcacagatttattaaacttgtaaaatgatgatgcacgataagttcacatagtacacggcaactatctcaaggacagtaaaaaacctgtagcttgtagaagttacgtcgaagccatgggtaccaaggtcttacaatctccatggccgacacaaatgacgtcccaacaattcacgagctgggtctgttgggtcttggaggggagaggctgatctaaattgtatgcgctgatgtctttcttggctcgggtgagtgcgagtgcaaagaagaggggggctcggctccgatgaaggaaaggttcttgctaatcattatggttgtgggccagatgcggtagaggaccggagaaaggatgtcagtgggcaattccactccgcttattagttcatggacctcatggtaacataaattttagaagaaaaaataaattagaagaaaaaataaattagaagtgggatgaacaggaaaaaatcccatttgtccaccccacttacgtccctagtaggatggtatctccacgtacaacagatggtatctcctgccactgacttgcttagctttagtttctttgtttccgccgctaagcaccttaccatcatcgtaatttccacacaggacctaacagaggccgtgtatcaatatcccgtgtaataacagagaactttttcacggtcatgtctttatacaactaagacgtcgggcggttgaagacctacacgagattttgtgcatatatgatatgaagtctttgtaaaatagttttccacgtgtcaatttttccaaggagcaaaaaacaattcagaaaacgtaagagccaaaaacaattcagagtacggagagaagtggaacacgaggttttcaagtttgataatcgctcgttcgtccgttgtgaagccatatataacaagtgtcccggcatccagccattaacaacacggagaaaagactgatcatacaataaaagttatgaacagttcgcgcagcaacagaaccgcgaaaccttgcagggaatctgaacgcgtgagacaggagtcagaacgtttataaacatacatgagcacaaagcgcacagtggttaatttatactcctacattaggcttcgggtgacaaagcattttgttctcattggaaaattacacgtgggtctcaggtctcgttgacagctccagaaatatttcacatcaaaaaagcctgtcgacacaacacaacagttagcccacatcagcaccgagtgcaaactagccaacttggatggcatgtatttggggaaaagacaatatatttggcaaattgacgacgacaaggtgaaatcgtacagacaaagagtagcagcagcagtatacatttacattacgttcgatcaaaggtgggagtcaaaacgttagataggacacaaactttgcagaattcaacacgtcaccgagttacaaataagttatatgcaaacagttttgaaatattttcctttccaagggacgcaaattcaacatgatatgattcgtaggttaccttgcaccagataggtccatcaccgagaatcgccacagtaggtaactgtatctggcacatatggcacaatcgtcatctctggttctctctttgcagtgagtgccttagacgcacgatactctggatcatctgtataacaacaaattaaagcaaacatcaaagttctgcaaatctaaactgaacattgtcctacgttaaaaagatgaacagaggtaaacctgatattttgactgtgcaaagaagactgggacatgagataggcagctctacagagtagaaaatttagtacagagagcaagagagcagatgaaatattaaaagaaggttgcgtacctctatattcaaacgaagttccatcatcatatagaagttaagtaaacagagtgtgattatatcaatgtaaacaaataataatattgtgccagcctagcattcattgacgtggtaccgttaagcacaaatggacttggaattgcaatggaccaacaggtatacaatggaactgtttacaagtgcagaaagcgccctgtaaatacacagctagctatgtaatacatctaacacccctgccccctcctcttgctctctcaaacccatggtgggtcaatcgcactgagtttccacagaccatagctatgttgaattgtagcctaagccttcatgaataaatctgtaactacaaatattatgataataaaggtaaaagaaaggatattgtacgtgacgaagtgtgtatccatagaataccacatcctcttcttgtgaagtatgtgatagagtaaactggtcttcaaagtccaatttacaggagaatgaagtgtcataagatgaaataaccccaagccttttaacttccttgttagatcgaacatgtacatcaatttcttctttaggaatcgcagttgaaaaga

SEQ ID NO: 75286 - DNA, 8240 bp, Oryza sativa
tgccccggggcattgctggcatgaccctgtgtggcatgttatcacgagtgaatgtaacagcaccttggattaagcagcggttgttataaggagatctaactgtaggttattttggtatcttatttcgtagtagacaattgattttttagattaatcttatacacggcattgaaccagaataaaagggggttccttttagtttgtctgtctccctgccattgtggtctggttgcctccatgatgtcatttgagctgcttgggtccagggacatggtgatcaggcacatacattatattatcatacatcagcttttagtgaaatgccattgtcttgctgtgacttttcatctcattgctgtgacattcatctcattgttttcctcagctgtccaaattagtatgtacttgaacttttgtcaattgaaagaaattgtgatgtcaaattaggctgacagcatacccttttacaggtatgaatcagttcttatgcaagaaatgctaacttttctcatacaattagtcaaaagaacgtatattttgtgggctttccacatcagacaatttgaaaagagaattgatttataagttagctgttgtggattccacacacagccagattgtgaagtctcttccccgtgccctttcgtcaagtgaccagcttcagaatgttctggattcacttgcagtttattctaatccatctggcatgaagcaggtttgaatccttaaattatattacatgcttatgaaaatctaattttatttttgaacgtatgttttataacaaaggttatcacagggtaagtatgtacttcgcaaaacattctggaaggagctggacttgtatcatccccgctggaattccagggaactacaaattgccgaggagagatattaccgtttttgcaaagtatttgctctcaatgctcagctacctcaatggacacatgtttttaggcccctgcataatatttctaaaattgcaacatcgaaagctgtccttcaaattgttcgcgctgttctgttctatgctgtttacagtgatccattatctgtatcacgtgcccctgacaacgtccttgtgactggtttgcacttgctttggttggcacttgatatatgtgaatcggagagcaaaaggtatgccaaccaatatggtatggatatagtgcagcatgatgatgaatcatgggtgtcctgtcatcttatgcagaagaggcttttcccatattgacctattctactgaactagtacctccagtttctggcaaagtgaagaatgagagcatgcttaccttgctggtttcattaatgcacaaatacaaggaagagaatgatatctccttttctggatccaagtactgcaatattccatcactaattgagagcttgttaaagaaatttgccaacttaagtaaggaatgcttttctgcaataagacaaatggcgccgcatatagtcccgtccatgccacaggataccagttgcaaacaaaatccaggatcttcagattctatggacaagaaggcaaaggcgcgccaacgccaagctgcaatcatggtacaatctaattatattctcaagccatctcatattcaagttcaattatgtttgttggatgggtttgctaagctattacgttgattttctttattatagaaatgctaggtctgcagttcccttgattgcctattattttttttctccttttttaggctttgatccataaatagtttacttgtcttgattgcaaatttacttgatgttggcatttcttcatttgcgttattatatattgttatatattaggcaaaaatgaaagcagaacagtcgaagtttgctgaaagtatgaagtcatcaggaagtgaggggcaggatgttccaatgtctgagccagatgtgtcctgttcaactggtgtagtctcagaggagtcgctgccagtttgctccctgtgcagggattcagattctaaaagtccattgtgctatctgattcttcttcaggtaaccgtagtttgcttggcaaatggattgctctatcaattatgttcacatctacatgaaatagtgattgccattttgtattttttacccatttctgttttgtgttcaaaacacaagcggataggattaattataactttgctagtatgctgtatgtgtgctggtgcttttatacatgcttgcttacatgttatatattccagagatctcgacttgcaacctttgttgagatgggtcatccctcctgggaaaatccaactaaatcaaacaagatatctgggtccatcagaagggaagaatcagctgatccctcaggtgcttcttcttttagttcggaggaattcattgctgatacagcagtagagccttcatttgattcagatgctatggaagttgatgcgttccttgatttctcaaatgagcaacatccactcattcgatatatatcatctttgcctggtgtgtactctaacagcaatgctggtgataccacctctcttgagacaattgaggatgatgtctgtaagactattttagatcatatgtttgggcccaacaatgtagaaactaaagatgatgaacaaacagtgaatacttcgaacctgtcaattggctccaagaaaaacagaagccccagaagttctgtgctgggaacatatgttaattgtctttcaacaaaacaccttcatccgtccaaatcttctggttcagttacaaggaacagatttggtcctgttgattgtgatggcatccacatatcctcttgtggacatgctgtacaccaggaatgccatgatcgatatttattctccttgaaacaaaggtaagctgcactcaaaatttatttagttcaagtaagaaattctttatattgcatcgtgtgcgtattgtgtggtaccatatttggatgagaatctcgcacttttagcagtgcacaactcgacaattggtagcttcttgatttaacaattattcatctgttcaatttgacaggtcaccttctcacagcttgaaatgagaatatgtactactaccttacacttttagacttttaggaacaattgttgactgaaaaagagtggtgtctcatattttatgccaagctgcttacacttctgttgattgaacatttgcagatatgtcaggagacttggttttgaaactggtcatattgttgatccggatctggtattttctatctatacatttcataactctctctctctctctctctctctctctctaactcagtaccttttttccagggagagttgctgtgtccagtctgtcgcagatttgcaaattctattcttccagcatcacctgatttctctagtaaatctttgaggaagacgatgccatctgttcagataccgtctgaagctcctcctgcgtcatcatggacgacgacaagtaacttacagttccctcatgcactctggcttcttgaaactgctggaaaaattgttggacaaagcaagtttttaaaagctttaagtgggaaggtcaatgatactacagagccagctctagatccttccctacgaagattgtgtatgctttactaccgtcgtagccacaacagtttttcagcatctgaaaggctaaacccgtccctatttctctgggatacactaagatactctgtggtatctacagaaattgcttctcgtggtagaattgcaagctattctgaatcgaagtcatgcatagaatctttacgccatgaactgaattcatcaaatggatttatactgtctctgttatttcgtgttgctcactctgcgagaaatttgagtcgccttgaggttcttttgagattcgaaggtctacaactgttagcgagctctatttgctctggcacttctggtgataaagatcttctgaatgccactaagcggaaaggtatatagtgcacacttaatttcccatctctgcctctaaatattattccctgtatatgtttcaatatcaatgtcatactcttgtttctgataattataatggcaaatgttaatatattaatgcaagaagtgtttgataaatgtaatctgacagccttaagaaaccaaaatgtcataacaaggtagtttgatgcacttctagaatcggtgttcttttactcgggctcttgtttcacaggaaactcaaatacctctatattttgtactgttacccagatacggggatacagatacgtgatacggggatatggcattttctaagaaacacggatacggggatacgtctatacatacacacagacacacagagagagagagagggagagggagagggaataaaaaatacagaaaactgaataataagtgtagaatactaaaacacccaaattggttctctcttccatcgccccgctgcatcagcagccacactagcagttggaatgctagatgcattaccattcaagcttccatcaatatccatcgcatctaacaagatatgtcacttgtagtcttgtactaagaaagtaagatctgcagtggactggaagaaccaagtactaggcagcacaggctgtgcggctatgcctggttgcggagctgtggcagccggctgccagtagagaccctgtttcagatggtggcaccacaatggccggcggatggcggaggcactgtggcatatggcggcaccatgacggccggtggatggcggaggcgctgcggcatacagctgcaccatgacggccggcagatggcgaaggtgctgcggcataatggcagtccttggtgtccagcatcatcgttgctgcgctttgtgagatgggcgtcgtcatgtcgaggccaggagatggcggcggcacattgatcgtatcgagagcatatcctgaattattctgtttatttgaaaaccttgttaatcaagaatatgtatgggatatgtatcggagggtatccgatctgtatccttatccgagaatgtatctgatacggatacgtgagctgtgtgccgtatcttgcatcctagattctgcatgtgcatttttaattgcatatacattatgcacgatatcatacttgaatatcccctcacattttttcattttcaacaggcattatgccaccgatgggtgaccccactagtgagggtggagtcttccctgatatccaattttggaaacaatgtgcagatccagtccttgctcaagatcctttttcatcattgttgtcaactcttttctgtttacctgttcagtttctaatgtccactgaattcttcatccctttcgtccacctattctatgttgtttgtgttgttcaggtatgctgttttgccatctcctggaatgtgcatattatccttttttattacttcattacgttttatggcatgcattgtgttgtaggcattgataacatgctatggagaagaaacatttgacagatcaagtttcagcaactgcctccttaatgatgtttgccagactatgtcaacaattgatattgctagagaatattttgtatccaaacacattgatccttcttgtcacccaaaagatatggtccggagattgacttatccgtatcttcggaggtgtgcgttactatgggagcttctaagatcgtcttcctcagcacctttgtatgacagttctaatatctgggaaggatcatcacatctttacttgaataatagcgcggcagactcactggcagtggagctgaatgggataagggaattggaagacctgtttcagattcagtcactggatccaattctccaagatgaatctgtacatatgcttgcgttaaaatggacacaacatttctgcgaggattacaaaacccgtaaatatagaggcgttcatttctctaccccagcagtgccatttaggctgatggagttgcctcctgtctatcaagttctcctggaaaggtttaatctgaacctaattttgattgattccctccctttctggttctgggtcttcaggaaccatatattgcttttaaggctgaaggctaacacttactgtttttcccattagatatgtcaagatgcaatgccctgattgcggttcagtgcctgatgaaccagcattatgtttactttgtggcaagctatgttcgcctagttggaaaccatgctgcaggtgatggtgttcatttagttcttgtttcactcttgctggttgtgttttaattatgaagtgagggtaaacttttattttgtatattgtgtgtaggactggaaagtgccttaatcatgcgtctcaatgtggtgctggcgttggcatatttcttttggttagggtatgtattaagttgtgactgcatatcattcttgttatcggtgttgagattgctttcttcaattttgttgtctgttttgtgcagaaaacaacaatactgttgcagcgatctattcgtctcgccttttggccatctccctaccttgacgccttcggtgaggaggtactggattaatttaaatactgaatagctttttgctggcactaaagcatgtttatttgcctcactatccccgcttgccttgctatccttgcattcttgcgccagcatgcttctatgctagtgtgcctcatgaaattatgctcttgaatggaccttggctgagcaatcttctccacccataattcgatgagcaattgtaagatcgaacactaactgccttgatgtaaaataccatcatcaaatgaactgaagaattatcctgtcaataccgtgaagatcccattgactgaaaccagacgtaacttctctttactgccactgttgagtatacatacacggaaccagggcagggtgctgtgaagattttttacctgtatgcatatcgtttaaaacattgcacctaggacggattgatggcatatgatttgatttctagatgggatgaattagagtataggatgcatgccttgtagattattgagatatttccttgcaatgcaaagaagctataaaggttagggtaatgctacaaggatgaggcttgttctcacctgaggttggggcatatgctaccaaggatgtgtgagccaaacgaccccttgatggccttgggcaatgctatgggtaatttcattatatgtgatcctatgccttttttcttctcatgtattgctatttggttgcaggatcatgacatgcacagaggaaagcctttgtatctaagccaagaaagatacgcagccctcacatatctggtagtaggctcacccgcctttattaacggctccatttcaatcatcaggaattttcgaataacatgccctccttttgacatgataggtggcatctcacagccttgacaggacttctgaagtacttaggcagacaaccatcagcatttatggatctgattgagtgcagtgtgctgtgggacaatatccaaaggtctgtatcatctatattttgttagtgtttgattctggaataccaaaagctggtttcttccctttttatcaaatgatgttaatcagtatttaaatcaatgaggccttatatcctccccaggattgagataaccggcagattgccctgcccaagcagctactgctattactactcatttatgcattctaccctattctggctgggtgtcgtaaaggggatgaaaaagtaacacatctccatggtagtcagtggtgaccacccaactaaaaagttatgtcccagccatccagattattctaatttacttagtcacattatttgtcagtattactcaccccaggctgataccatagtagcaatccataactctcaccaattaccatcttctaccaaggcaactattgttagaagtagaaactataacgagagatgaactgactgacaactactgtaaaaagtagaaactataacgagagacgaattgacatagctgaatggtctgcaaggcttcttatttacagaagattatgaacatcttccttcactcttgtttatcagttatggataatcaccacaacctagtctataaacaatattgccatattgcaatgtgagtgctttttttcttaatatcagtttattgtgttttgtcgataggatcttgtgatgtgaatattttctggagctgtgcgggggaatgcaatttgggatcaatgctttttaatggtaacaacgcttcctcacacaaggtataaccactatgctctgctcatgcatgtaaatgccgttgtgttgtactgcgttgtttctgtcgtctgattcttctgctcatccagatggcactgttcttcagct

SEQ ID NO: 75287 - DNA, 13603 bp, Oryza sativa
gttatcaaaaactaggaggctcttcaagcacttgtgcttttctatagcaggtatttcttctacatcattgctgatacataagtggcgtagatttggtaaggctttgctatattccatgttcatgaatatggagtgatcctttgtcaaaaattgaccaagtgacctcaatagatcatgcattgttgactcgcctttgtctacaaactctggtcgtggctgcagaagattccttctgattagctcatggtagtactcttcagcaacctcatgtattgagtacccatgcacttccgtcacgaaaccttcagcaacccaccagtaagcgacagcatcacgacgtatcacaaaatttgacggcaacaaagcacaccagagaaagcattgtttaagttcagggggtaagttgctgtagcttaagtacagagggcctcctagttctctgggaagtccatgaatggaccacttgctatctcggatactctcccattctgcccttgttcttttagtagatagaacacctgcaacaactttgatggcaagaggaaggccatcacactttttgacaatttgatatccaacaccactgaattctctgctttgctcgtatggccctaatgacatcttcatcagcagttctaggccatcgcaatcattcattttgtttaccttgtgggtataagttgcatgcatttcaaccaaaacatccaggtttcttgaggtcacaaggatatgagaattcaaacctctcaagaaaggcaaacgaagaagatcaatccatacatcagatttccaaacatcatccagcacaagaaaaacactcttccctctaatagtgtccactagaagcggtagaagctcagtcttagtctccagctgatcacaaattcctccagccattctgattgcctgttttaacaaactggtctctgtgtaattctgagaaatgcacaaccatatatgaacttggaatttctcccttatcctctgttcattgtatatcttttgagctaatgttgtcttaccgatgcctcccatcccctggatcccaaaaacagttgacctgctttcattgtagttactactaacaatcattttgacgatgtcatcaatagcccttctgatatcttctccaaccacctcaagttcatctacaggagatgtctgacttctgtcaacaattgttatctggatttgttgcccgttggttctctccaagccaaacatctctttgttcattttaatttcttcaaacttttcatttatattatcaattcttttggcaatcatgtgatcaaatgaaaactttgcaaagctagagaacaagggctgattgcaacataccggccttggtggcagcaagagcttctgtgaatgaaccatgaaaagatctacgatgtcatcgacatcaaacataacatctctcatgttcttccaccatgaatctatccctggatcctccatggccagagcctcagcatcctcatgaacagcgttgaagaattccagatttttcttcaggctctcaataccccttttcacacttaatgtcatgataacctcatcctcaataagttgacccagcttttccaagaatttccaagcgagagcatccaaaactgtgcccatagtgctagaacctacggattcccactggatctctcctatgggagatgcttgaaactgcagatcccagaagagatatctcacagagctgctgagtgccgatcacttaaatacggaagatggaaagagatattgaagcagtgtggctaaaacctgatgagaacagagagggcaatgcagattgcagaagagagctgttatagattctcctccctttcttgccaccaactgcctttgtcacaatggacattgacattctctattgcaaaacgtctgaaaaacctgaaaaaaaattaaaacagtatgaaagcactttttgaggcaaaatctacccacaaagatttttgtattcaaatctaaatgtttcaacgatgatgcaatgtgaaaaagggcaagtagtgttacaaaattgcaaggggattcaagttgaaagctcttccaggctgtgtattcttttcctttcatccccttgacaataataatttgattttattgcagcaaaggagccacttggtgctttactttcttttcctgtttaccacctaagaagcctggaagcactggagcagagttctctttttttcaggaatatgcaacaaaaaaaatatatttatattggcattaaggttgggtaaaacaaggttcagagaaaatgatacattagatcaccagagtgcagacagcagaccgaaggaaaaaatagagtcaaacaggtgctggccggtgctgggcatgcaaccgcacgcaggaatctactgggcatttcgtcaaacagctcatctgcgccccaaccatttgttgcaaagtccaagtttcagagcttagagaaaacatcgaaaggaactcatcccattcgcatcagtcgcgttgcacataatcaagtcagaaaagaaaaaaaatatgatggttgattacctacgcaagaaagagagatgcttctcctagcgaaaccaaagacggcgacaacgacccacaagcaaagataagcagggcctaggtcgaactgagcctggatcaggatcacatcgcataactccagtataaacaaagagcaaattctctgattcatctcgcacgtaacgtaacgtaacgaatggggcgctcggggagagcgatgcgcgaatggcgttcgatgaaatgcccctccaagttcaacaggcgcgtccaggccaatcgattttgttttactttctgaattgggccctgtcgcgaagactgcgacctgaattgggccgtaagcccgtaacctaagctctacgccgaaggaaagcccaaactctaaaaactcctccacccccgcgcggcgggaaaccgctcctccccactccgttcccgcgcacattttttcggcatcccacccgtcgatttttccggcatccaacgtcgtacatccctccacgtcatcgatccgcgccgcgtgccttccaccaatcagggcgcacgtcccctcctctacaaaaccatcttcccccgtctcctttccccacgccgcaatctcgcgaatcccaccgcttccctttcctctcctctcctctccccgggaagaagacagcagcggcatccatggcgcccaaggcagagaagaagccggccgcgaagaagcccgcggaggaggagcccgcggcggagaaggccgagaaggcccccgcggggaagaagcccaaggcggagaagcgtctccccgccggcaaggccgagaagggcagcggcgaggggaagaaggcggggaggaagaaggcgaagaagagcgtcgagacctacaagatctacatcttcaaggtgctcaagcaggttcaccccgacatcggcatctcctccaaggccatgtccatcatgaactccttcatcaatgacatcttcgagaagctcgccggagagtccgccaagctcgcccgctacaacaagaagcccaccatcacctcccgggagatccagacctccgtccgcctcgtcctccccggcgagctcgccaagcacgccgtctctgagggcaccaaggccgtcactaaattcacctccgcttaggcttcacccctgcatctatctattgctattgctaatagttgtagtttgatctgtttgtgttagttttagtgctatcgatgattggaaaatggatgttagatcgttagcttggtagtcagatgtcagtgatctggaacagtagctctgattttaaaccatgtgaatgtgattcctgggtatgtgatgtttgaccgccctgtgcctgctggtcaacgaatgataactagatctaatttttgtggaactatttacatggttgctacttgcattctgttcaactgttgtaaattcctctgtcactcgttggagttttattctctgaagcatgtgtggaattgcctgggcatgcttttgggaaactatagtctgtagtcttatgttatgtttggttgccctgagcttgttggaattaatctatctaattttgcgcaattacatcctgtgagtatgctgttgccatttgcattgtcttgcaaactcctttgtatgccacaggaatttgatttctggagcatggatgtttggagtgtgatactgtgcttattggcccatgtaatttataagtacgagtaggtttcatctaagggcactttctggatggagtccaatatttttttagcctgatggcaattttggtttttgatctttgcgtttgaaacaaaagaagagttgtgtgaattagttagtactatatagtatgacagcttggccatcaccgttctattttagctgataactttgacatctgaagtaagttttgctttaccttagtactgtactgtttcaactttcaaagaagtttaattggaaatagtaactgaaacaccgtaagtattttgcttgctatttcaggatgctgctacactagcctgtttcctataaatttcctttgaatcaaagggggccttatgttccgaaggtctaaggaaggctctctctttgttcttgattagcttgtaagctaactggcaagcatgaggtatgcactacactgctgcatcttttatcaaagcttgctgttggagttgttgctctgcaggatatgccatgtgtgaagatgatgaccaaactcttgtggactctagaatcttataatgttatcctttggttctttgtccagtgaggttgtttgaggtgtataatttttttcgaaggttctactgcaagagcatcctgaatttctgttgggcttgtttgcattaaacattccatgctgaattgaagttaactacattctgtttacatctttacagtggcatgcatctaagcttaatgaatattaactacgcaaccttgtgttcctccaattattcctggtacaatcatcaacactgtctacatatgtatcttgcccaacgtttagctcacagtgctatgttcttcatggccgaccatccaagacctgagatattcatctctggttgcatgcatctctgatacagcttctgccaacatcattcgctctctgggttgttgctttgagcatgatatgccgagcctaagaacagacaccaagcactgttgaataattcttgtttttatgctttcatttttaacatctgcaacattttcttcttcatgaagccagattgttggatcagctatgtctaggggttggtgaagaaaagaagctgcaacaaacttgtgcagatccattgaatccctgaaaatgtcatcagtagggctccttccagtaaacatctcaagcaacaatatgcctaagctgtaagtatcgcctgctctggttattgtagacccttccccatactctgcaatgtttgcaatcaaagttagttgtcaaccgtaccctccacatgtaaaacaaatacaaagtgccccagtactccaatccacacccatgagggaggagggggagggattatgggaattaatgtaagaagttcagtttttttttaaaaaaaaaaatctacctggtgcaatataaccaatggaacctctgattccaattgagcttttcgaactttgaagagttttagtactacttttcgggaggattcttgatatgccaaaatctccaaccttagcactcttgtcttctgatagaagaatattactaggtttcagatcacagtgtatgattggtggctggcagtgattgtgaagataatccagtgcatcaaagatatcaacagcaatgttgagtctctgtgaaaggctgagtgtattgctaggagtgagattgcttgacttgggatgaatccaaccatccaagctaccattgggcatgaactcaaaaaccaatgccttgaactcttgaccctgtggaccaatacttgagcaacaagtgatgatctttatgagacaacggtggcgtactcttctcagagcctcacattcagcctcaaagctttttgaagatcctgattgttgaaggtcgaacacttttacagcaacaagtgcactctcatcgtctaaagtacatctaaaaacagaaccatatcttcctttgccaagcaggttggcttctgaaaattcattacttcctcttgataatgcataatatgaaaccctttgatactgttcctcaataaccagggatgttgcttgtctattttgtctttgtttgaacttcctttggtgtaacagaataactacaatagcagaaactaacaccaatattgcacccgttgttggcagagctattgcaagagacttcagatgctggtttctgttcttgcttacattgagaatgggacatggagccaagtgaagctggggtattccaccgcacaagttattccccacaaccgatgcaaaagtcaggtttctgaaaacacccttaactggaacttccccttgcaatttgttgaaggacacatctaattgccacagcgttgtcaaattttgtagagttgctgggattggtcctgaaaaattgttgtgtgctagaaacagctgttgcagattgggaatcctagcaatggtgttggggatcctgccagataacttattcatggttaggttcagtatggtgagcccttttaggttgctcagagattgtggtattcctccttcaaatgagttctcttctagatagagggcttccatcacttcacaatttcctatactgtcaggtatttgtccagatagctggtttccggatagatccattccatttaggttaaccaagctaccaacttctgatggaaggggtcctgacagagaattatatgacaagtccaagaaccacgagagtgactgcagctcaaaaatttctttggggatcgaaccatttagatggttgtatgacaaatctagaacaaacagtttttttagatccccaaggcttggtgggattgggccttccaaattgcagtagaatgcgtatatcctattcaaatttgtaagatttccaacagatgccggtatgaggcctgacaggctggtattgtacagggaaatttcaaccaagtttgttagcttcccgatgctttcaggaatcactccagataatatggaattgaaccccagatcgagaaagctcaagcctaccagattgccaatgtcctcaggtatgctccccgagatattgttgttatctaaattgagcatttgtagcgtcgttgacaggttcccaattggccttggcagctgcccactgaaagagttgttagcgaggacaaattcttgcagctggctgcagtttgacagtgaagtggaaattcccagcccttggtgttatctgcctcaagttgatttcctaccaaatacaaatactgaagatattgcaacctccccaagttgggaggcacaaatccggtgaatttgttgtctgagaggtacagatccgtgagtgttgaaagattggagagagaatgagggatgactcctgtaaaccggttaacatccaatccaaacacttgtataccgggaagcatgcgaccaatgtcagaagggatgctgccatgcagcatgttattgccaacctggagcatcatcagcgacgacaaattgtacagagatagcggaagttcgccggaaaggttgtttgcattgagaaaaagataacgcagacctgcgatatcgccgaggcctggagggatgagaccctcaagcttgttgtaactcagagacaagtgctgcaacgacgaaaggttggctagcgaggccgggatcttccctgttaagctgttcttcctgagctgaagcttcttgagccgtggcagcgtgttaccgagctccggaggaattcgcccgccaagctgcgggttggactggatccgcaggattgtcaagctgatgcaggagctcagattagcagggatcacacctgagatggagttgtggtccatatcgaggaccaggagacgccggagccggccgacggccggaggtatctcgccgtgcagctggttggagctcaggttgagccgccgtaggaaggtgaggttcccgacggccggcgggagcgtgccggtgaggttgctcgacggcaggtccagcgccgccaccctcgtcggccaccggtggctgcatgtcacgccctcccagccgcagaagctggcgctggtgttccatgaggcgagcgcgcttgagctgctcccgctgagccctgccttgagagcaagcagcgccggctcatcgcttgccgtgccggtgccgatcgtcatcaggacgcagaggagggacaatgcaagcctcatccgacgtatcgccatgtggattcttggttcggtttgagggagcgttcttggagcagagtttagttaacacgactagctattttagttaaatggagatactagcatatctctgtttcctgctgatcaccagtaccagtacatttttctttttcttcttttggaagatttcacctgactttgttgacctggttgggactggttctcagttgcactagggcccgcccggtttagttctcaaaataaaaattttaactctgtcactttgaacattcggataaatatatgaagtattaaatataaaaaaaatactaattatatagattatgtgtaaattatgagacgaatcttttaagtctaattacagtaaatatttgcttgttaatgataaattaattatgtttaataaatttatctcatagcttactatcggattttgtaataagtatttttatcagtgccggacatttgctaatgctggactattagaagcagtgtacattccactatgccaccaaacgcaagtggtcggtcaggaaaagtgacaaatactgccaacatgccgtgagaatatcttatgacaaactagtgttccttttcagcgaccgtggcgacgaaaggaaaaaattgacttgactagaatgctaaatgattaagaaggtgtgttgggggattagaacgtagatgacttattaatatatgattaattaattattaattattttaaatttaattaattaattaatatgattttttttgaaagaaaaaacgaggctagcacctcctgtgacgccgcgacctctcagagacggcgagctcgagctttggtgttgggactctgccgagcattcgtgccgtgcatatctggaaggagatttgactgaacagggagccacttcgccgtcacaaaggactagatttgcgttggttttaatagctgtcttacagctaagtgatgtagatgaaactcgatccataactgagggacaagaagtgaactttttttcaagctctgaacatatggattgcatttcgaggaacatgaaggaattaaccagcccactgaggtccataagtaaacacgatgtagacatgtagtacacaaatccataggctcagcccattttgtactgtatagtccaagcaggctcaaagctagattctttaccagcatgaaacttcagatgaagttcgtgtagccagcaacatccaagtaagcaagataaacatccagtgacacaagtcacattaaagcaacattcaagcaaacaagcaaaattagtataccaactcactagttcagtttcactagatagaaagcataccacatgacacagcactgcattcttaattacgtacacaccacaagactggagaggaaggactacatcatcgtacacacgccatagatgtctcaaaacatctttattcttagcacttatttaactaggatgcatttcttcagtctcaggtcttagatcacaaactcagaggaaacacaaagttacagtgacaacaactcatcacttgtaactggatcaaactactagcttagcagtactaggcccttccatctccttggtttcgtcaggaggttgcttgcttcacttgccgcagttgcaggggttgcaggtgcagttgtcgccgcacttgcacccgttctctgctcctgctccggcggcggcgccggcctccaacccctcggcatgactgcatccatcagagaatcagccaaccatagatcagtaattaattagaactcagcgaaacatgaaacaatcttggattgttgctacgcaattttcagagtaaaaggcatcatcgttttcttcagataaaggggagagtttttgtcataacgtgcatgaagtttttagtcgttttccttacgctgtagctagcgctgcaattttgtcatacgtacacgtaaaatggaaggcagtgagcctcttgactctcgacaaaatgttttgttctttgtgactcagaaggaaaaaaaaaaggcaggaaacatatgacaattgacaaaagaggttggtagctagaaagatggaggtactcaattctgttctattagagtatatgatagttagagtaggataagattgatttacatggacttctttcatatctataatcttttcttatctctacactgtactcctatatatactgccccctgagactcattgtattacaatggtgtcgataatcacaatatttccctctccctatactattctacaaattcagtaacacatggattttgccaatgaatcacaagtacatgacatggagaaggaaaggattagtgcacataccccttggaaggtgcaacacccatgatgacagtctgggtagtggtcacctcctcagccatctccgggtacatcttgcatctgcatgtacaaataatcaatcagaaattcagagcctatttcttgtctgttcaaagaagaggggataaaaaaaatcagatccttatcagccatcagcatgcatgctcctcatttaataacggtggaaaggagctaaatcaaaatctcctataatgaatcttttttttcctctcaagtaagatcatcatcacattaagccaccatctcaaaaaagatttttctatcatgaactttttcctctcaagaaagatcatcatcagatttggccaccatctaaaaaaagatttgttcacagactattgagtccataacatgttctattatccaaaacaaatcccaaggagaggcacacatatgacacatacaacacatgcatgtcaatatgtcatgaatacataccaagatcaacaacatggataaacacaaattcattacggatcacaacacacaaaaaaaaccccagcaaacgaacaatatcccttccgagatccaccgaatttccatctcaccaacaccaagactagacagttattatacatgacagatcaagaacagaaattcagaagatggtgatcggatcttaccctccgcagccgctgccgcactggcagccggatccgcagccgcagtttcctccgcagcacgacatctttctttcaaagatcaacacggatcgatcgaactgcgggcactgatcgcacaacacacgagcactcactctgaaaatctgaatatcaccttcagcacctgaaccacacgcagggaggggggcggagagggttgctacttatagagagggagggaggccatccgccgtacacgtggcacgcatcgggagacctgccgtgaacaaatcgtcgatttggggaagggggggaagtcacctcctgtgggggtgagtgagtttacggttttgcccctcattgattgagcgattcttcgggactcaaccgtccgtccgtcgctcgcggacaaccgaacgcatatgcatggcgtgatcacgtatgatccgcgagtttggcgtctggtttgtggcctctagttcatagtgagaattgagaaggttgtgtacgtgtttgtttgttgagttgttgggagttcgtgtatatttttctaaactaaatcagcacagaactatcaattatattttattttgaatgagtataattaaaaaaaaacatcaacgagaatagacttgtcaagcatcaacctattaacaactataccaacatagggttatttacgtgcctggcgatgatatgtgtagggtttacaatatatgttataacatttatggtactaaagtttacattcttttacatatgtgcttgtggacatactaataagttagtgatagatcaggtacacaatcacctagcctagtcatggcttatctaaaagtagatgtcctattaaacttcagcaaatattttttaaactttatcgaaaaatattttctaaagaaagaaaatattggaactataaattacgggtatgtttggctgtctgttttgcgcaaacggcgtagctgacaccgacagtgccgaaaagcgcagccgcaaccagcttgccgaatatgccctatattatgggatagatttcattctcatcattcatgtgctttatatatttcttccacaaagtttatgcatttctttataatatgtcatcatacattcggcgcgctagaggtgtataatgcacgttcaaggaagaatcaaaataccacgccgcatcgctcgcagcacagaggagattcagaagatcacaaattcatggtgcttattgatgtgttgggccatgccattatgtcaagcacttgataacactgaaaatggcctggaaatggcccggatggtaaggtcgtaggtaggcataaagcaggttcatgtctactctatcaatggttgtttactgaaaagctattattgttattttatgttttctctatttttgtgaagttattagtcaccaccactcgctgggaactaggaagagataatcgtgacaaataaaataagctccatatcaatctgctgatcttttgcatcgaaaattttctaatcctttttattctaacatatattttctcagttttaaaactattgacttttaaaaataacatttcattatttgtcttacttaaatatgcaaaaataatatggcatgtttaaagtatatttcataataaaataaatcatagcaaaataaatgatacttatagctttttaatacgatggacggttaaacgtcgtgttcaaaagtcaacaagttaatatattaaaagtctgaattttcttttagttccaatacctgatgatatattgcacataataccagtttatttcacttcgatcataagaaaaacatacatgcagtagacaatgttcttgcaagggtagtggcacaaatttcaggtccaccgattctctgattctggtgccaatttgaaacttttttcgtgtttgacgtgcatggatcacggataatgtctcacgcacaaataaaagaaaagaaagagaggagaagagttcaaatattcattgcagcgagttggaacacgtgtaatccacacgtccataattgtctatgctggccagaatggacacgccgcactttgttttaaatttaaaataattttttaaaaaattaagcataagaaaagctgaagaggacatggcctgaacctccacggcaaatgaaaatgggcgtgtcattatcggatagagaagagacaatgccatcattgacttttgactttgcgaatcccactgattagtactcccaccgttattttaagtgcgaccataaatttaacgtttaattttgattgtccgtcttattttaaaaatttttataattagtattttggttgttatgagatgataaaatatg

SEQ ID NO: 75288 - DNA, 863 bp, Oryza sativa
atggcgacccttctttttttgcattaaggaatcgccgtcattgagccattagctaacagcagcaacactggaaaaagcaaattaagcaaaagcaaagatgaatttaatttttttaggagggtttaattatgaatttaccattttaccccctccttgtgtggccctatataaatgagtggtactcgctctcctcttccccacacacccacaaacgcagctgagctgagctagcaagcgagcgagccgagctcgagctccatttgcttcttctcgtggcggcagcgcctcctccccgtcgccgtcgtctccacgtcgtccgctccgatccgcctcgatcggcgttcgatcgcgtccaccacctcgatctccagaaacctttatataagcagccgcgtccgcattcttgttcgatctatctctccacaccatgccttcgttgctcgactcgccgccgcagatcacgccggcggctgctgccggcgactggagctcgctgtacgcggcggcgcaggcggagacggccgtgaaggcgccgcggcatggggcggtggcggtgaagaaggccgcggcgtatggtggtggcggcgggaggaggatcaagaacctggagatgtgcaccgaggcgctcgggtgcgagaccggcggcgtcgacggcgcggcggccaccgccgccgatgccgtcgttgtcgctgctgctgcggcggcggcggcggctgaggatgccatgcccgtggtggtggagaccgacggcgcggagaggaagaggcgcgcccgggaggaggaagcggggtcgatggtggagctggcggccgccgcggcgagggcgcgccgcgcgggcccccgcggcggcgcgccgctgcccc

SEQ ID NO: 75289 - DNA, 31706 bp, Oryza sativa
aaagttaaaagtttgatgaaaaagtttagaaataaactcagcctataatacaaattgcagcaaatgtatgcagtgtaatctatgcacaaccgtactagctaatactcatggttagcaagtcgtcatagggaggaacatgtcttcaagagattcaacatcttaatacgtgatacgagtagagaccgcaaattgttcaaccaaaggacatcaccactatcaccaaatgctatcagctgtgtcctttttaaaaattttgtcatgaaccaataaatttggcacttgtagttatttattatgttttggaaaatagaaaagtacgcatgttctagatgacggatcacgcacgctagctatatctcaaacaagatcacactatcattgccatctctcataaataaaagagagagaggatcatatatcatgagtagtatcatataattgcatctcatgtccctgtatgactaataggcgatatgatcgatctatactagtataccacatgatcacatgatttttttaaacacatgctgaatgcaagctgccacctactactatacatatactgtactatgttgcattcctgtaataaactggccaagtggtcgaccttctgccctccggtctttagtctcttactaggccataatctcgtcattaagagtactaattcttcttcaaagaaaaaataattaataagagtactaatgagatgacttgaccgcttcagaatattcctgggccgaaccaccttttctatcgttgattacttgtaggcgttcgagaatttatactcttacccggtgaccacgctactgtcattttctaccgtctgtttagccctttcaaccatttcaatgtacttaagtctatgacacagcccgtttcaggcgacgtcatcaccttcaagttgttagcttatactaaaccactgggccggcgtgactgagataggcatgcggtgacgtttagggattaggtagtttcgttttatgtcaaaataaatttattaaattttgttgacgtcaaattttgttattgtttttttaaaatgaaataggcatagaaagacctctttggtttgacgtcctaccattttaggttggtatgcagatgtagtgatgtattcagggttactaaatattcagtgatagtggtttgttaaaatattgcgtttgtcgccttatttcaagaactttattttttaccgaaatcaattgagttctgactttcaaaagttagctttttgatagtacgaattaaaaacgtgcatgtagtgatgtattcggagctaccgaatcttgttgtgaacttgtgattaagtggtttattaaaatatagcttttgtcaccttattttataagaaccattttttttaccgaaatcagttcagttctgactttcagaaattagcttcagatatttgagcatatggatgaggaggtagtgaaaacgtgcaaattaccagatgtagggaagtatttggagttaccaaatcttctcgtgattgagcggttggttaaaaaacttaatatagtgcttttgttgccttatttcaactcctttttttttttaccaaaatcggctcggttctgactttcaaaagttggctttcggagatttgagcatggatgatgaggtaggtaccaaatgtgcaaagctgatgaggtcaagttgagatggtcaccattattagtttctaatgaacattaaataggatagaaaataaaaaaactattaacacatgattaattaaatttcaattatttatataaacttaaaaaataaatttatttaatattttaaattaatttcatctgaaagtattttatgcaagttttatattaaaaagggcgtatttaaaaaactaccgcaagtttttttaattaaaaactttcagtgtagctatattttaactacactaaactaggatataacttatataaaacttgtattcaagtatagtttggtttagttagttagtactgagattttaagtacaacattttctatcgatttttttcatgcacatatttggagacatatgtggagacaatctcatggttgcaaatctaaaagttttagggaccaagaaaaacctacgaaagttttattttttagtaaatttaaaaaacgaactatcatcttaatcagaagtgaaggagggcttacccgtcgaggaggtggaggtgcgcctcgaggttgtggaagcaggccgggtcgagcgtgtccttgaggaacggcgaccgcttgtggtcgagcgcgagctccacgccgacgtgcgcgtagcaccacggcacccggaggatgccctccgccacccgccgcagcgccgccggcgccccctcgttcagcaggatccccggcatccgcgccaccccgtcgtgcacgttcaccacccgcagcgccttcaccccgagctccccctcgaacctctccttgaacctcgcgttccccaccctcggccccgcgaacgagtacacgcacaccgccgccgccgcctccttcccgccgccgtgcgccgcgctcgcggcgcccgactccgcgatgtcgtacgcgctgatcatcgccagcgcgctgccgaggctgtgccccgtcaccgtcacgctcacgtcctcgccgagcgcggcgtagcgggtgacgaggcggcggacctccgtgagcacctgctcgcgcgcggagtacttgcagaagcggcaggtggggtccttgtcggtgtagaggtccacgaagccggactccaccttcacctcccggtccgggcacgggatgccctcgtcggcgacggggcggaggaagtccatgaggtcggagacccactcgaggcgcgtgaccgtgccgcgccacgcgatggcgatgtcgcgccggcccaggcgcgcggtctcctcgtcggtggagacggcgacgtagccgatccagttggcgcgctggctccagatcttggcacccgcgcgcgactgcgagaagaagtttgggaagcggaagttggaggtggcgtagaggtagcgggtcacggtgtagccccgcgcggcggcgggcatgccgaggcggtcgaagaaggcgcggcgcgggtacttgcagctgccgcagtagcgggaggacgggtcgtagtcgaaggcgtcgtagcacgcctgcgcgaactcgccgtagcggatgagctccgagcggagcagcgggtccatcgggtcgagcagccccgcccagtcgtcgcgcccgtggatctcccgccaccgcgccgccagctcgtgcccgtcctggtggtgctgccggtgatggcgcctccgcgccgccccgaggtcctggctatcgtggtgatacagctcctcatcctcctcctcctcctcctcctcctccgccgcttgtccgtggcgaacgacgacgtcgtgctcgagctggccgacgagggaggcgagcgcatcgtccctcgtggccgcggaggggaggaggcgcagcctgtcgccgtcgtcgctggctgtgccggtgaggaggcggcacggaggtggagcgcgtcggaaggagaggtgcgtgtgggcggtggtggtggcggcggcgcgggggagagaggagaggtgcggggagagttcgcggcaggagatgggcgccatcgggaaggtcaccggcgaagtcgccgcgggttcgggtgagcgagtattctggacgtaccaacgtggggagatcatcaaaggagtagtttattgatgatgatgggtgtaggactgtgggaggctctgtccggtgggtcggctaccactgccgtaatttattactccgatactgtaacaatcgattaagataacagactttgcctcagtcttcaagactctaagagccctttaaatcataggaatacgaaaacataggaatagaaaaaacacaggattttgatagaaatataagtgtaaaacagaggattgcaaaatacaagaatgaccgtttgattggaccgcaggaaaaacataggaattagaggagagataaagactcaaaaggaaagtttctaagaggttttacctcatgttagaatttctccaaaacttacatggcattaggcaatccataggaattttataggattccataagatccattcctttgattcaaaggctatataggaaaaattcttataggaatgaaattctctaaaaatttctatgaatttcctttgaatcaaagggggcctaaacatcgtcgaccttcgactggtcatggagtagggaaccggacaagtccataaaatttgctcgctaatttatttctcacatgatagtataatattttttttaaaaaaataaagttcactcgttagttcatttctcacatggtaatataacttttagataaaataaactagaaatgaaataagaagaagaaaaatcccactaacccatcctgcttgcatccatagagataaaagagtggcagggaaagggtgagaggagggaagaggacaactgaacatttctgtttaacagagtatttattctatccttaaaaaaatcaattgtttatatatcttgttttaagctatttattaagttttatttctaaaatatttaacttatccttttattttacaaaatccacatcaataatatttttaaaaatctaaattaaattgggccttaggtgacttgagaagaggagagacggagacactagtggtggcggtaataggaaagcaataccaacgagtgacaacaagtctagaggcggtagtgcataggaaggtgggggtgtcactactctagcagggagaaaaggaatccgtcaacaggctataccccatatatggtatttttgaagtataggagtcgttggtgtcaaggtatacgcaagattaaggtaaaagttaagagacgagagacatttattttttatacatatccaagactcttacttacgtgtaataactttactcctgttgatcggaactggtgttgctattatatatcaatatcacacgagtacaataataaggatgacctaacataatctctatcagtatagtggtgtaaagctgtcgacgactagtagtagtcgacttcctcgaacatgaactcaacaagattggagattgccctagcttttgtggcgctatagtcttgtcttgacttatgctaatctgtattggttttttatttgtgcgtcccttctccttctggtggacttgtatttatatcctcgggtgctctcttgtccaagtaaggcgagggaggcaactatggatacgattcaagtagaccttgtagtgttcaagtaggactttgtttctcttcccttatccagaacaccttccatatatgagacttgattctgtattaaacttagtatatggttggtcccaccgagcctaaaatagaagtaagaagtatctcatgtccagaacacttacagaacctccattttgtgattcagccaaggcgctagtgtgcggacctaaagtcgggaacacgagacaatgagtttatacaggttcgccgtacggaaacgtaataccctactcatatgttcttatctggatccttttgctgtagtgtgtacaagatgttaagtttcttctattctagagctggagagggctcttgtccttagtggcttttttggttggtagattcaggatgccctcctctctttgtctcttgagagtagcggtgatattgagttctatgtttgggtacatgaatggtgggattgatcacgaagagatggattaattagtttgttgacgtgcatgaatttctaggcaatgctaagcatgtaaaagtgattaatggaaaaagaaaaaaaaagaaggcaaccgataaatagacaacttaagaaaaaaatattttggtattgcaatgtgatcttaggtcctagcttctctcttcccattacgatcacctttgtgcggagaaagtcaattcaaacattttaagggtacatacttcatttcttacacatcatcgtatatatattatatgtctaaataaaaagtaactattaatgacatagtaccaaattttggaaacaatgaaaaggaactgttcgatttgatatcaaatctgtgtccataagagagaatatgcgcaatgacaaaatttaataggatagcatttccatggtttgtctagtttgttaccctgttcaagttctggtacgatggattttgatagaaaagcaaacatagattctagttggatcacctgaataggaaaaccgtaaaaacgtagaaacatgataggatgacaatcaaatttctatgttaactttaaaaatacataaagcttcaaaactattatacatagggaacatgcagaaaatttgagtcacgggaagaagaaaacatgaagcacaacctcaatcttattttcctaaatgtttcccatggattggccgtccattccatacaatttttaaaggaatttgtagtgctggatcctttgttttaaatgtatgcattgaattttttttcataggatacaaatctttcaaaattcctttgcttttctattattccatatgagctgtgaaaatctatggtgtaaagatggaagtgctaatattctcgtctattttttcaattgagtcaaatgcattgtcaattcttaaagttatacttggtgtcattatagtttctaaactttcgaaatacaaatgtaacccctcattcttgttaaatatacccactccgttttcaaatgttgtaacatagaatgagattagacccatgttagcactacgaatttggataaagcagttatctgatttgtttgttttactaggataagtatatttaagtgcagagtgactatcatacaagttaaaaaaaatagtaggacgtgtactctatgtactaacgtggttaccgacgtgtatttatgttgttttcaaagtttaggaatcaatattatatcgtgatataagtgtcagcgtatttcactcttcttaattagttgcttatagctactaatggggttatgttcggtaggccgaaactatagctgcaactttatctgccgctgtcttgtgtgggtggtactatttgtgcttgctatagcacaacattaaaccatatagccaaacaaccccaataattcttagcagatattctttttacaaaattagttgatagatgtgttcaatgtgttcaattaaactgtatctctatctctactattataaaaattgaagatgtttttgctggtattttggtacgtcatccgtgttagagtcggtttttaaatttttttcgcttttagaaatatacatccatgtttgagtccaattttaagttcgtttgcttttagaaatataaaaggagtcgtataagaaatctctttaaaaaaatttgcatactaacttaagatgagtgtcagactcctaattacaactcatgattttctagaaaaaaaatatccaagcgaattctcacagtaaattttaccatagccaaaccgtataacaataataagattaaaataatattcatccgttgtaacgcatagacatcttttatagtaaactaaaatatctggttagtgcacgtactcatgtctcccgacgcattttgcacaagccggaagttaaactccagtaaaaaacctgtcacttaaaccacgctagtttttgaaggaaactgccatcaaacggtttgtgcgagtgagcgcgaccgggaaaatcccccgtgcgggcgccgggcggtgctccgcaatcaccctatccaaccaaatccgcgagaaaactccatatcccctccactccactccacgcgcggctctacctcccactcccccctctcctctcctctcctctcctccacctccactctccgctgtccacacgcgcccgcgcgcgcgagaggcgagagctcgctctcccagtcccatccctgtcgctccccatgttcgccgcttccacctcctccaccggcctccccttgccgcgcgcgggcggcctcctcctcctccccacctcccgctccctcctcctcccgcgccaccgccaccgcctccgcctccgcgatgttggcgccgctgcggccgccggagggggagtgtccggcgggggcggcggtgctgcttcttcgagggagccgccgaggacgctgttcccgggcgggttcaagcggccggagatccgggtcccggcgctcgtcctccgcgtcggcgccgacgaggcgctggcctccggggacgcggtggtcgcggccgtggcgcggggcgtggggatcgtcgtgctcgaggccggggaggagggcggcgggcgcgtctacgaggccgcgctctcgctcaaggcgtcggtcggggaccgcgcctacctgctcgtcgcggagcgcgtcgacgtcgcctcggcggtcggtgccagcggcgtcgtgctggctgacgacggttggtgactgctttttttctccccagcttcgtatttcgtacgagtagttgcttgttgtggtaggtagttgcttgtttgaaacaaagccattgaaaaatatgtttcagggtgatatttattcggtttgaaagttgaggccgaacgccaatcgattttatagttcatggcgaaaaatggatttcgagcaaagtttaagggccataattggactttaccctttagaatatgccatatggtttcgtataatttagtaccacctctatcccaaaataagttcatttttcatcaatcacacgcatatcataaaaaacaaaaaaaaaactagaatactcctattttatcaaatcccaatgcaactattcatcactttatctactccaaataccatcctttcttcctttatagttggtacccactacaagtcatttatgctataaagcttaaattctgtgagaccacatcatcaagattatattaaccattagatcatcttgcgtctatgcaaatcaaccattagatcaagttcttctcagccgatggcatttgagaggaccaatgctttttgtcttccgcttaattacctcacgcatcattatatatccctttatcactaaccactaaccaatacatctcccacctaaagcctacaccactacatttgtgtctacctttttatcattccttttaatttttctaatgcatctactagccatatctaggttgatccaatggattttcttggaatatttatgcttgaacaggcttcctcaatcatctaaagaggaaatgtcaatggtccaatgaaattttggtttgtcactgtcatagatgacatcgaaaatttgttggacagattacaacactcgatgatttttaccaattgcaaggatgtgtatctatgcctatctcctatggtgattggtttttggtactctatcatgatcttgcttcttttcatatctgatttcttcgtgttaaaaggttgtgccaaatctttgtgtttttaagaccgcaatcactaaatttgtttctccacagttcctccaatttacttataggtgaacatgtttcttgaaattactagattcatgcacccaatagttgtttttttttaagatcatataccaacatatgcatgcaacattatccgtattttctctttgttttctcacaaaaagaaatattttattagttatttaaaatatctgaatgagatcttaagccaatttagtacataataaaaatagtgtcatgtttgcttaccgtttatggttcttcgaaatgggagtatcttaattggaatcatgtcatttctattcatatagcaattcaatgtacagatcgaacgttcaagcatgttgatcatgtaattatgataaatttataactatatggtcccttctatgtaatgatactataccaatagtcaaaagttctagaattattcagtcaaaaaaaaagttctagaattatagcttacaaattcatgatataactgtcccgcagcaacgcgtggggtatcaactagtcattcacaatgattactccaaaaatgaacttattttgggacaaattgaagggctaaaaatgaacttaatatgggacgaaggaagtacattttttagtcacttgtcttacctgctccttttcccagttttcagtacttgtcatgtcaataactttgaccagatttcgctagatattgttctctgtcgtggtgctaaccaataatcagtcagtttctttagaagtactaaaaaagaaactactagtatgtagcaacaaccaagcatttttctaaggaggttccttctgtactttgatgcaggtattcctgctattgttgcaaggagtatgatgatgaagtccaactcggactccatatacctccctcttgtcgctagaaccatacgttctgcagacactgcaagaagcgccacaagttcagagggggctgattttcttatcatcgataccggcagtgatgatgctattaatgttatgaatggtgttagtggcactcagcatgtgaagatccccattttttccactttgagtgattcgcaaagtgaagggtcttactcagataacacatccaggttgctccaatccggtgcatctggaattgttatgtctttggctggtattcaagtactcgctgatgatattatagaacgggatttttcaaaagtggataccgctgaaagtgtcctacaggctaattactcttcagctagtactttggaagaagcagataatgtaatggtcctaactcgtgagaaggcaaaagttgctggattcacaaaactagatgaaaaagtaatgcagctgatatcgatagaaaagcctattctaagtgaagctgttgctgttatccgcaaggcagcaccaatggtgatcatctaatgttacatatttggtagttgaagttgccctggaatgaattcagtttttcttcacatcatcatttctagcatatcctcgacttgaaatataattttctgttttgtggcaacagatggaggaagttgagcttctagttgatgctgcttctcgcctgagtgagccatttttgttggttactgtggtaatttggtttacattaaatgttgatagcttgctttatacttcatagacagatgattttttagacatgattcttctgttgtttgcataaataatgaaattgtattatgtggttcatggaaatgctgcttctcacgctggataacactgacagtcctgccatggattttctcaaagcaatttatattatatgattatttctcaccccaaggatttttttatgagaagttatgaccatgttggatcaatgcttagcagcaattatatttttaggcggttcagataaacctgtagcatttaatgttgattttggctgattttacatcatgaactctggctaaaaaatttaaaaaactaaaattctttttaagaggagaaatattgttcacactatgctcgtatgatgctgacatacactatgtttttctgaaaaaatccatttacagcccacacctttgcaaagtgttgaaatcaactatctcaacctccaaccttggaacttaaaaatggatcactcccaacctgaattcctggagtagagaattggacattttgcgaccacaaactctaaaatcttgttcactttttaaaccctcaggctggtttggttgatgtctgctcacatgctgatgaccacactgatgttttagctcacatgccagcccacctagcaaagtcttttttaggtctggcactgacaaaatctcaagggggtggcatgcaaatgccacataaacaaaagcaatccagttttgctgtgagagggttgagagtttgatgttaaaaaatatctggttttgtagtttagagttcatataaactaccagaagagtcgctattaaatggacatttcttaaaacaaaactcatttatgtccacatcctcatttatgtaactggaagcatatatgccgacatccttgatggtgatccatttgcatcagctgacataaagccccttgcttttctctttcatctttcattataattaatcagattataactccaccaaacataggtcctgttctacaaaggcataaactgaactgctgtgcttgttgtcctgatgaaatcaatttattttattaaaaagttgaactgttcttcagactgttatacattatattggtcaatctatcttctcttacatttatgtttcttaattagtctctaaatttatctcagggtgaatttaattcgggaaaatcaacttttataaatgctctacttgggaggaagtatcttcaggaaggagttgtgcccacaacaaatgagatcatgttgctatcatattctgatgttgactctgaaagcgcagaacgatgtgagaggcacccggatggtcaatacatgtgctatttatcggcacccgtattgaaggaagtaagtacatagttgatgtcttgatgctaccctttcaccctttactgtatttggttgaacaagctagctacgccaggatggttatcatgatgtaaggaaacataatatttttcaactacttgaaggctgctttctctatgaatctcaaagaaatatttgttctaaggaagcattcgagttaatgaatatgtatgaaatagaggaatacaactctttcctctacaaaatgctgtagttttagcatgtacaacctgtctgttagctgtttactgactttttatgggtctgcattcgctataattgagagggatttcaaaaaataaatggcagtcgtcttccaccttatttccccttagtgtttctgggttacattaatgttacaatgccaacttactggtgcaattttcttgactcatgacttcatctccatggctgtgagatgtttaattgtgtactattgaacagatgaacctagttgatacgcctggaacaaatgttattctccaaaggcagcaacggcttactgaagaatatgtgccccgagctgacctaatactctttgttctttcatcagacagaccattgactgacagtgaggtaatgattatgattatttgattgtgccaattctttaggcatttgatagtcattatctcaccactatgttttaggaatggtaggtagaaagcatgaaacaataaaaaaaatgagtcaaatcctataatagatcatttgttgaatgtgccccatttttatttcctctgcatggataactgaataatctcttgatttgtatttggttctagttctttacaattatgaaattaatcaaaagggaaggattgtctgtatgacttgtctaagttcctgggatcggtgggtttaaaatataatctcccagggcgattaactcaatgcatccttttatcatgcattggcaatttagcatgctgcacttccttaggaaagtgcctgttgcctgttgcctaaattattgcagaacacacttccttggccccaacctatgatatgcattctgtctcacattttttatgtagtttggtacacttatttgaatactgactaaagacttaaattttcacacccaagtttattttttgaggaacgtgatattgtggccatctgtgacgagcctttttaaacttatagattgcatattgcttaggattttatccttatgcgattccttacctaacaaatattttattgaaaattctataatccttatttatctctcaaggatgcagttttgtccttggtcctttattatttgtcctttacagtggagctaaaaacgttcttgacttctaggtcggatttctccagtatgttcagcagtggaagaagaaagttgtatttgtactaaacaaattggacctttatcggaacagtaacgaggtctgatataaatctctagttcaaaatccctgcaaaatattgcctatcctatttacctttttcctgattgctattttgcttctcaatccaacggttttagcttgaagaggctactgcatttatcaaggaaaatgcaagaaaattgcttaacacagaggatgtgacattatttcctgtatcttcacgctctgctctggaggccaagcttttgtattcaaaaaatgatggaagagagcatcatggggaagctttgtttaatgaccctagatggagaaacagcaagttttatgatctagagcattacctattgagcttcttggatggatcaacagaaaatgggaaggaaagggtccggctgaaacttgaaacgccaattggaattgcagatcgtttgctaacgtcatgtcaaaggcttgtgaagctagaatatgaaaaggctattgatgacctaacatccatcaaggatcttgtttctggtgcaaacaattatgctgtgaagattgaggctgacagtgattcttggcaaaggcagatttcatcccttgtaggttttctgaagatgactatttctgttttacccttatgttcttcaattctactatgatatattccctatttgcaaccataaggcatacatagtagttagctttgatgcaaaataagagaaaacatacaaataatggtgtttttcctgctggtttttcattttttctccctgaagtttatgcgaacaaaagagtgaaagtcttcctctcctttctaaggaaattatgaggggtggtttagtttttcttccagtggcatgtgcttcagttgagatatctttagtccatatgtaatactgtatagttgacaaatgtcttaacctgttgcattgatattttctttttatcttgcagattgcgagagctaaaggccgagcaatttcgctcatggaatctacacttcagttgtcaaacattgaccttatttttacatacaccctttcaggggggaaaagcactcccaccaaagttacatcattttttcaaaatgatattctgagcccttcccttgatgacgcagcagtatgttgaacactcttctcatttacatatcatattaaaaattttctttctacatgtttgtattttccacattttcttgcacatgtcattcagacaaaaattgcccaggtttgttgcaaacaattcagatacataaatatcacgagaaaattgagtagtgggcatcattaactcctggtgtctggttcatatttgttcatgcctgttactcctatttgtttaaaagatttctaacatttgcttcatgttggttatttatttgcattgtggtgcttatttgtttgtgttatcaacaaaactttctttcttttgtctagaatttgctaagtgaatattctacatggttgagttctaccaatgtccgtgaagcaaatatatatgtggactgcttccatgagagatggggtgcattggttgcccaggagcaaaggattccgccagagaaaaatgaacttgtcaatgaagaagagaaactctgtgtaaaggcactggatggcttcagtgctagtgctgctgctaaggtttttgaagaagaaattcgtgaagtggtatgcctatgaagatatagttataacttttttatacatacagtatacttctttattattcctgaaactgtagaataagcttatccttataaactaacaaagtgtgacttctaagccctgaagttttcagcacagatgagaaaacctaaaaccactgaaaggtctcaagtaatactgatacagaaagtcacatggaagagatgatataccaactataataacattaaaataacctgaagtaggggagttggactgaagcttactttgattctttttttcttaatgaaaatgataataatggtcttcttaattcttattatgtaccaactattttaattttatcataggcaagtaattagtatttgggcaagtagatactcttgctggggtagatgaagccttcctattactactacttcgtacttcccatggttatcaattttgtttgagagcatctagttttgaggccgtctatgatttcattatacttgttttttcttcgctgttctcattctgagctttgctaagtgaaggcttggggaacctttggagggctaggggttgctggattgtcagcttctcttttgacctctgttttgacaagtacacttgaagaccttcttgctctagctctttgctcagctggcgggtaattctcgattgataactagaggccacttttcagtaaataggtttgctatgcatggaatcagctgatatgaaattatatgcatattgatctaatggacaatactcctttttcaggttctttgcaatatcaaattttcctacccgtcggaaacttgcagtagagaagatcggcaaggctgctgaaaaactttcttctaaagttgacgaagctattcagcaggatatatcccgtagtgctaatcaattagtccattttgttgagactgtcagcaaaccttatcaagatgcatgtcagcaaaagatagattggctgcagggtgttcagggtgagttgtccactgttgagcgtaagctccaaactttgaaagttgaaattcaaaatcttcatgaatcatgaggtttcaattccattgaaattttcttcatttatttgcactcatgccttggatgggtgatatgcgctcatcaaattttgttagttggtgttgtattatggtggggctgttgatagatatatctgtaatatatgttgtaccttctcaacaagtgatacttatcacgtaatcaggagcaatgcaaccacaggttcaatcgatcattattcaaatgtttttccctgttctatgttagttgcccagggccattacaaaagctttgcaatggtgttggaactactgccctacacatgaagctggatttagattgagtttctacatacatagtatgtaaacagttctttatatttgaatgtaaattttaaattcgcgaacgctttttcataattttatggctagcttcaatcaatacgactgcttgcattcactaataaacgtttgttgtcgtacacagtacagaatacacattatggcattattccagccgtatatcctccaattgtttaatttctctggtccagttggtacttcgtatcacccctttttcttatgccaagttcttctccgtcgtctaattaagacaaaaggacaagtactacaccattcattggtaattgcttctgttgaaatcttgtagctgtcgtgcatctgggcatctagcctttcggttagtgccttgctacagagtacaactagatactgttgatagcttagtcaaatgccatccgagtgcccataaaacctcctctgattggaggtcttggcaacaaatggtgatgtgccttctgccactctcttgctctctttattcttcctttcactaccatgtctcaggtagatgcatatgcacggatacctgtccaagctgcacggtatatcactgaacttgtgggtaacagatgccaagctgaatttattctctcccactctcttttcatatgtatacaccatacacacacatccacgagtgcgttctcatttcatatgcgacaagaagaaaaaagccaacaaaactctttatggaagcgcgcccgtaatcgcacgattacgggtactaggatttaacctctgataggtaagagtcatgtatccacacacgtcaaatgtgcttcctcaaactgcatttgttctctttctaggattggaaaaaatgctgcctgaaagttcaaacattccggtgagcaataataatgcaatatgccagtgttccaagattatttctactaattccttcggctcagattaattaacaagcagttgaattttcgtgctaccgaaactagcagctactgggggtgcctaataatcgcctaccattccatgttttgtccttgtttatgtttgttttgctaaagcatgtcttgggagtacttttaattgcttgtcctgcatgcatcacagcatcagcagcataaacttttttttgcaccccttttctttaatttaagagtagtacaatgcatgaagtagccgcgagtgcacggtaggattcttgcctttgcggtgctggattcagctcaacgctcgttggacacatgcgaagcacaagcacaaaaggttaaggcgattgtttaccttgtgttaaaaggtgctaagttgacatcattaggggtagatatattaaaagtgatcgagactatgcatgcctaaatattgtttttaacgttgtcgtcacgaacagtcactgtgatacctccgttttaaatatactctctccgtcccataaaaaaccaatctagtatcgaatgtgacacatgctagtactacgaatctgaatatacaatgtcatatccggtcctgtattcgttttttatgggacaaatggagtataactcagtcggtttgttatactgattgttataattaaaataaatttaatgtaaaacaagtttcacagcaaaataaatcatacttacataaatttaaaagatgaagagaaacataagcaaacgaagggctaacatgtccgtgagacaacaaatgatcgtgtatgcatgagatttccattgagatgaagaagtgatgatgagctttgctgtgctcaagagtacgtaggtgactaggcttcactttgtttttagggagacaaaacgtctccctagctacgtaaactactcctgacgtgtcgcaattagtgaaaagctaatccttcattttaatctctaattaactatactatgaatcatggtggcctgctcgtgcagccagaccatggaattagctgtttgtcggcttcttgtcctaggcgctggtttgagcttagctatgctagagctagagcttagagcaggtacaatagcaggctataagcgagcagcgggctacacatctgtagccagctgaagtacggatttcaagacataatgtgtatatgataggtaggaccagatattaataatatagtaagcacctattatatgaattggctatatataatttagagctagtagtgggctatactattaaacttgctcttagctgaatcctttctgcatatatatgtacgtacgatttcgatggatctcgcaaatctgaacaaggtgacagcacaatccgggctcgaagtgacggtactcgctttggctgattcaccggtggccaaagatctcacattgtctgtgaaactccacggcctttttatttttgccggccaactttgtctgaaaccccagcatatcatccaggggcaaagattctgagctacaggtgtcaacaggggagaagaacgccactgacacccaaaatgagaggccatagcttaattagcaatggccagtgccagatgtggccagaccatggcaccatcacatctcaaatcggtgtattatgggatacatttgacagtaagcaatacatgggaatttaacaaagctgaatatgtaacagaagttctagccaggggaccaagctctcaaaggaaaaaggcattgtccatattttgatgtcatctagtagtatatatcttggagcaacattgtccagtcatttcttgagaaccaaaaagatgagcttagcttaagaacataaatgtcttgctttctgcttaagaagggtagctaaaggcaaaaaaaaaaaaaaaaaactaatgcagaggcagacatattattatagaaatatggaacagtgatctttcacttaagaaggcaaaaagggcagggaccaatgtagagacaggggtttgtaggttggtaccacctaaccaaccctagatactcttaacatttatgcaaaagttagaacatataggtaatgtagggttataggctatgttaagcaattaagcttgcaaactacctcggccgtccaaattgtatcgactatcacaagtgtttatataaggagatgtattactactgatttgaccaaaaaaaaacaaaatcttcaaaagccatgattctctctctaaaaaaatgcatgcacatagccaaaaaaacgctatgtagttacaattcatttcgaattcaatcaatggtttgaagaactagaccaattgatagcaactttctggtgtggtactgtcatttgtcttatttttgttttcgggtaatctccaaaagaagagagaaaataatcagaacaaaatcaacatatgccatgtacagtactatccattgtgtccacaagctaaggtagtaacatatgtgagggatgtttcaccttttggttttattcttatccactatccagagaaccaaaaagctagcaaagcacaaaccggaaattgacctcttcatggaattatttttattttcagaaaaaaaggtcaaaaattaagaaagcacccaaccagtgcgtatttttatatctcctccacaagatagggaaaaagaccttttccatttaaattgctaggaatgtattcttttacacttactaattattttttcgcatccgaaaatttctgaaccatcaattctgaagtctgattggtgcaggtggatccacaatggatttagattctttcagctgcctagcaaactacagtaatccttaatataaatacatcatatggaaattgtttacttcacaaaagataattagcaaaaagcaattacaaccacagaaggaaagggacaacttattgatcaatatttcgtaaaaaaacacttattgatcaatatttgtgcaccattgacaccggtacactactgctacgatttacacttataacacaagtgcagacgttacattggtgcgttgataatcaaatattagtgctaattatttacaccattacgagtgcatgtctccttggtggtttgtccacggtatatcctcatccatccaaaacctctggacgtgtgtgcacaacgtgccctgcaaatttaaagcaactgattggagcaacttatttctgtccccaatgtaaaataatgtccagatacaacgagggaggtgatgtgatgtgaataatgctccaattgttttttttttttggtgggggttaagttggtcgtgagacatggatgatatcaggaggccaactgagctgttaaagctgatctttgccgtgacttgttcgtatatatgatcaattattctttcctcagtgtacgtacagcttacacaaaaatctaatgagggggataatgagactatgttaactgaaaacctagaattggagaaatgtgacattccatccttgtctgacattgcaaaacagatggaagaggaagagtgtgatgaagaggatagctttcaagaggttccttacaagaagaacagacccatgaaagcagaacctgctattacttcaagaatgagcctgaggaatagagctgaacttctaaccaaaaagaagaatctggagtccacgggtaattccaacccttttgctgtttttcagttaattgatccctttgagttgaataacattgctattgctgctaatatttccttagatagtaacttagtagaaatcaataatactgtcagggttatggataaggtataccctctatacttggatgtgcgttgtatactgatacggtatactcgcgcgtatacggatagttcctgtatacgttaaggaaatctatcacgtgacagaaacagaatccacagatggagggagtcctactcggacaagactgggtctttaccatatcgtgaggggtccgatatctccgagccctacttggagatcaactgacccgcggtataaaagggaccccctaggcaggacctaaggcatcgaatctcaccgccaatacatccaccacagcctacgaagttggagtctataggagccaagtcgccgggtgatctagtcgaaccaactcaactacggtcttgtcggtatcatcgagttccgctattccctttgtaatatgtggtttccatcatataatcccataccaactggattagggctattacctatcaaggggcctgaactagtataatccttgtcttttgtttgcttgatgtcgtactatgtggatcctcataccagcgtaccccaataccctctatatccggtctacgggtattccccgtcgacaaatactattgatactattaagaccaaggaggaggttcaagctaaaattagctaaactgagatggaaaaaaagagaaggagaaggaaaaggagactcatgacataccacatactgatttgagagatgtcttggaaaataaatccgaagaggttgacattgtggataacactgaacaagaggtaggtgtagtaaacaaatcatctgagagcttagaacagaagaggagaggcggtcctaaaaaacttaggaaaaaaatgaaagtattattttggaatgtgagaggtttgggaaataaagctagaaaaagacagttgaaagagttagttagagatagaggggctgacattatttgcttacaagagacaaagaaaatgagttttcaggataaatagttgaactccttccaaggctccaaggatttctcttgggcttgggaatcttcaagaggtgcatctggtgtaattctattagatactaacaatgaggtgattgagaggttggggactcatgttggtgcttttttcctgagtactgatatcaaatataggaaagacaacagtatatgggaagtaattgtggtctgtggtcctgttgtggattctttgacagatgagttcttagaagagttgagatggtatttataggataaacaacacccttttatcattggtggagatttcaatatgtacagatttgctagtgataaatcaaatgataacctgaatctgagatccatggagtctttcaattcttttatctttgatcttgaacttagagattcatatagaagtggcccaaaattcacttggactaataagcaagattgccctactttagaggtgctagataaagttctagttagtgctggttgggaggatagatatccaaattctactctttcctccctccttaggattgggtctgatcattctccccttattctagacactggtgaggatttagagagacctcttaaatattttagatttgagtcaacctggctagccatagagggttttcatgagatggttagacaaatttgatccctagagatagttcttacatccttgactactggaataaaaaacaatcctccctaagaaggtttttgaagggatgggagataaatacaaaaaaggagaggaatcaacacaaaactgagttgacgtctctgatccaagagatggactctcaagctgacctaagggagttagatgtagaggaatggaataagagatatgaaatggaacctgagttagaacacatatatgagatggaggaattgttctggcacaagagatgtggtgacatgactttgttgcaaggagacagaagcactgaattttttcacagaatggccaatggaagaagaagaagaagaagatgcatgatactctccctggaagatgaaggcaaagagctgcattctaaagaagagttgaaaacccatgtcattgagttttataagactttgtttagagctgatgacccttcaaatgttcacctctcaccacttatttggcattaagagttgagcttgaaagatagtcaaaaagaatatcttatttgacctttttccatagaagagatggacaaagttctaaaagaatccaaattaaatattgctctaggtcctgatggtctcaatgttcacctttttagagctttctggcctgagattaaaaatgagttgtttgagatgctgctgatgttgtatgaagggaagttagacctaaaaagacttaacttcggagttatttccctgatccctaagagctctgatcccaccaatataagacagttcagacctatttgtgtgctgaatgaatgttttaaattcatcagtaaagtggtgactaacagattctctgaggtgacctctttagtgatttggcatacacaactacctttatccctggcagattcattctgaaaggttgtataatcctacatgaggttcttcatgtgttgaaaacaaaatcaaagaaagggattattatgaaaatagattttgaaaaagcttatgacagtgtgagctggaatttcttatttgaggtcctagagaagaagaactttccaaatagatggattgattggatcaaggcttgtgttatgggtggtaaagtccatgtcaatatcaatggagagagaagtgatttctttagaacttacaggggtcttagacaaggagatcctctatctcctcttttgttttaacctagtcagtgatgcttttgcagctattcttgatagtgctaagagatcatttgttcttataggccttgttcctgagattttcccaggaaggatcacctatttacaatatgctgatgacattgttatttttatttcttttgatgctaagcaagtgattgtcacaaaaattctcttatactgctttgaagagatggcagggatgaaaattaactatcataaaagtgaggttttcatagtgggtttagagagattagaaattgaagaggttgcaaagatgctcaactatcctataggtgaattttccatgaagtatcttggtttgcccattggtcctaacaaaattttaaaccaagagtttgatttccttccccagaagatggaaaaaagaccctctctttggattgggggtaacttaacctatgcaggaagagctattcatatcaatgcatgtttatcttctatcccatcctatgctgtgggtttttaccaacttcctgaagggattcatcataagtttgattcgataagaggttagatactattgggctggcaataaacaagggagaaaataccacatggtgagatggatagacctttcttttcctaaagagtttcgaggcattggtttaactaaaaccagaatgcttaactctgctctattggctaaatgaatcattaaaattgaatcccctaataatagtctttgtataaatttgttgaggagaaaatatattcaagaggatggtatcttccaatacattggtgacaagggtctcaattctggaaaggtgtgatgaatgttagaaaatggatgacattagggtctgaatggcttctgggagttgggaatcatatttgattctagaaagatgtttggaatggttcttgtccttttaaaatcactttccacaatttatttgagatctgtaatcaacagaatgttacagtctcagagctgatatcaagaggtgctaatgtgctaacttttaggagatcttttggagaactggagagaaatcagtggttagagctgagaggaataactgaaaatacctccctaagtgtctcacctaactctcagacctggggtttatcagctaataaactttatacaacaaaatcgctctatgaggctatggcttttagaggtatgaaagatgttaaaatgtagatggtttggaaatgccctgctcccatgaaaatgaaacactttgtttggttagctatgaagggtagaatccaatcagcagagcaattgaaaaagaaaaactgcgcaggctcagaattttgtcagctctgtggtgccttggaaactacttctcacatcttattcacctgtcctatggcttcttttgtttggtgtgtgtgtagatattcttttggctgggtctttgttccgagagattttgatgatttctttctcatttctaagcagaacaataaggcaaattctatagtttttccagctttacttatggttgtttcctggttgctttggaccaccagaaacaacatgattatcagagataaaatggtttactctccactgatcctgcctttccaaatcatttcctttttattgcagtggaaagccctatgtcgttctgaggtgactttgctgatggagacgatggctgagaagttaaaagtgacaacaactacccttggcgctcagagaaccggcgttggatgatgatgtgccttgttttagcttgtcatagtatcttttgtttactgtctaccttagagtttttctgctcatggcctgatgtgtggtgactgtttagttttactgtggtagttgtggcttaagcctgtgctgtaaaatggatattccccataaccttgttcaacattttgctttcaatataaggagggatgtgaggccttttatctaaaaaaaattattctttgaatggtaggtgatataccattcgatagtgagttgtctatgatgatttcgtcaatcttaagatattcatacacactctttgaagatactcatatggataggatgtatgtatgcgtttatagaggtgtgtgtgagcgttagcatttgtactatgttttgaagaaagaaaaaacacgccaacaaaataagatggctttgcaatctagactgatatccaccgaggaaaccctgctgtaggatacaaggtcttttcttttgttttgttttcaaggcttgggccactatcatctcctgcccttttctccacattctctgctccttgatgggtcatccatcgccacgttttcttctggtccgacatggtttgaattatctcttggaaactttgcatgaaatatatccaacttttcttgtgaggaaaatgtagctacaacaaaaagttttgcgaatgtacaagctatattacgagtaaaataaaccacgtgtgtctaaacttgtccagcggattcacttagatctacaaactttgaatctgtagttcgagttttctaaacttgtctaaatagttcattatagtttgggcctatttggtttactagctattgttagtatcaaaatatagatacgtttttagaactactattaggagcgcagcgccaaacatgcatcagctcaggcccaccccaccccgcgtcccgtcatcccactcctaccgttatcggagtaaacgacttactcctatcgcgtgcctctaccacccacctatattcgagtaaacgatttactttgataataaaaaccactcccttgcttccgatcccacccccacgtcccgcatcgtgctcccactattatcggaataaatgacttacttcgataaaaacaacttctctgcttccggtatatatattctatttttctcgtacccaaccaaccactctcgcccccacttttattttttttcctttttttcggatctgaatcgatctaccttcctagtgcacagatcggcgacacaccatggaggaggacaacgacaccgtggtggttgatggtggtggctggcgagcagtggccagcggcggttcaggcgaaggcactgcttcggtcctcgctgccggacgctgggcagcaccttaaacaacaaggaggtgttcacttaggtcaatagcaacaaccagcggctgctccacgtcagcgacaatgctagaacaagcaagtaaggaaatgacactctgatttgcatctgcatactctccttcaacttcacgcatgaagccccaattttttttttttgcaaatcaaattaacgtgcaatctccaatattacctgatctcaattgataggctgcacaggtcctacatttgcacatcattctccatgtggctagccctgagaggatagggtggagtacgccggtgatagaggttgtttgctatttttcttttgctcgtcatctctattgacatgaacgagaatgtttttgcatttttttcgtgcttgctagatgatggatggctgctactgcgcaaaatcgagctcatccactacatccttccatgattccatcgtcgactactgctcgccacccggttgccctctccactaccagtcacaagacacaaaccaccctcttcatccttatagcaagatccagcaaagctgccagatgaatttttggctgaatcatttttttcttttctagtttgattcacctgtgagtaattttattgcttgtctgtgattgagcctgcaattttttcattcatacgactattttgtgatacagatcaacgatacttttagtatcagtttttactcttgtatattgaacacatcagtaaacatattactacacgagatcatggctatatcgataggaaggtgataattgttttactcgatgaccacaaaatattagtttttattcttagactatgtattgaacacatcagtgacatattactacacggtggctacgagatcatgggctatatcgagaggaaggtagtaattgttttactcacagaccacgaaatctaaacaatatttataatattggaattactagcgttttaagctagtagtaattcttttacgaccatctaggtatggcgtcatacgatgtggaggcattcatgcgagtaaatttgttacttttgaatgagccgatgtgggaggctgggagtaaatgaaaaactccatggagtatattcgttacttttgaaacgtgcggagatactagaaaaacagaaaactcagaaagaaaaactagacggtaaatattttactaaaacgcgaaaacagaaaaactacagagaaggaacgaaaaacaaaaaaatctagatggttaatattttaccgagcccattgatgaagcacggatgagatggaaaagagaaaaaagaaacacggaaggtgaggtggtaaaaaacgaaaaaaacaaaccgagaaaagatgggatgcggaggaaaggtggggtggtaaaaaacaggaaaaccagaaggagagggcgtgctacgtttgaactaatattccgcgctgtagcacgcggattagcgctaccgataagttttagcagtaacaattactggtagagtaagtttatattggtcatgtttttgtttgttatcaccatagagcgaaattgtaaaactatatatagtaaaaagtattctagattgctactaaatttagtataggcattgatttctgtatagttggtacccaccaactcctaaatcttatcatgcaagtgtgttatatcatcacccattagtaattattatttagagcatcttaaatcccatacaagcatgacacatcatttacaatttattatatttttagagctcgatatgtaatatcaaatcattatatccacatcattttctataatgtataacatgtattcatccatatattttgtagtaaaacgtgaggtatcaactagtatatactattattgatagggcatattttggtagcaatctaaaacagcccgtaaatctaactcacgttgcaccatctactacctccgtcccaaaatatagtaatttttagctatgaatctggatacgcgtttttggacggaggtagtacatggcagctacatggtgcctgggtggataagaacaaaccaacatgtacaatctgatcatgtgccctcttttttccacctaaaaattttcaaataattgaatataacgcttgtcaagttcacagtcgaaatattacgttgcgcttgaactatcatagctatcctttgaaataggcattcattgattcataaaagttgtttcacgtccataattatcgtgactaatgtaaatcatactccttagatgatttaactgcaaaatgcccccacctagaaacggcacaaaaattccagctgcagtgcacgagtgcccaccatggtagtagaaatggaggtgtgggcgaggttggaccgttgaagagtttagacaagtttaagaacctcaaattcaatatgaaaagttcatggacttaaataaacaggtagacaagattagtggcccatggtaaactgaaaagagatgaatatattactcaaagaaggaagaaaaggggtattcatgcacatacgcactttcttacttatttggatgagtgtagatatccacaatccctttggaagaaggaaatttgaatgtaaatactaatcaacccgaaccattctagccatcaaggtttaggccctcaagagttgtactcgactaacataaattgtcttacagccgttgatataccacctctattgattcgacgtcttctgatattagatctaacaacccctcctcgaccacactagtatacatacttgtttactttaattaactcctctggtgctgaatctggacgagcgacgaccaacgatatgcatggtggcacctaagtccccggcgacgagaagtcgggagagctagcagctcctatgttggtttttcttttctctggcatgagtttgcctcatgtcttatgcttcgttcattgccttgtaaagagtcgactcttcttttccttctcccctccagtcatccataccgtgatggtatttttatgagcattttttctatccttaaggaggtaccatgaggtatcataaggtaacaatctaatctaactattgatttaggatgggtatgatggggttaaataatgctcttgccgtgcacgcacgtggaggtatacatttcatcgaacaccttcaaggcgtcctgcggtggcctccagtccctcaaccctccaggaaccccctcaccggcggcagtccctcaaccctccaggaaccccctcaccggcggcagtccctcaaccctccaggaaccccctcaccggcggcggcatggtggccctgttcccggacccgtacctccacggcggcactgacgaggtgaacacggcgtgctgggagaacgacccggtggtgcgccggttcctcgccgagggcggcacgcacaaccacctcctggaggtgttcatcaacacgacgcgaccattcgtggcgcaggagctgaaccagctgccatggcattcagtacctcaacctctcggccaaccagtttgccggccgccgtcgcatcgcattgagtccgccgcggcgaccgtcgcatcgagcttccgacgaatcgctgctgcaaccatcgccgagctcccgatgaatggtagctgcaaccatcgccggactcccaccgattcagcgccgacgtcgcatcgagaccaccgcccgccgtcgctgatgaatcgccaccgcaaccatcatcaagctcccgtcgctgatgaatcgccgccgcaaccgtcgctgatctgggccaccatcgggtcgccgatctagggttcgagacctaccgcccctgccgccatcccaagcttcgggtttgtttctctcgttgctcctgcccggcgagatgcggaaacagcgacaaaggaggaagagatgcgcgtgcgtgatgcggaataaacgcgaaagtacaaaactaccctcctatcacaccctgaagttcttttccaagcctaaattgaagttataaatggtctcaagaaaatactggtgtaaaagcaagagtaaaccctaataaatcaatgcaaataataatcgaaattggcatgtggaattttttcttgagttctacatgtcgaaatacgctaacaagatttttagtggaatttttagagctctagaaataattttaaccaattaaaattgagcacaagcaatatttaatcccaggaaaattcatttccttctttttctttttccctttttctctttcgaatgggccgccggcccattctctcttctctccccctccccgctgggccggccgaaggccacggcccagccagccgcccgagcccccctcctctctccctgggtcgccgacaggtggggcccacctgtcgggcccgtctcccacctccagtcggcgccgccgcgccccgcaaccgccgccgcaccccgctcccgcgtctcctgggcaacgtcgccctcgcgcccactccccctctctctctcccgtccgcgcccgcgctcgagacggccgggattcaatttttgaatcccacctctctctcctccccacccctccccacccgccggtgaaatcgcggtctccccggccacgatcgaccct

SEQ ID NO: 75290 - DNA, 120728 bp, Oryza sativa
ggcccgcgtgggagatctggaagactggtagggtgtggccacggggatcgggggcagggagggaggcaccggggagtagggacggcctaatgttatacgggactcttgtggcaaatgaaatgggctcctcccatgttgattttggataagttaattttacaggtgtttcactcccttatctaatgttttcattttcatttaaaaatatatatgtttgctaattttacatatttggaatatcctatgtcctcttttcttcaacttcggtttcccacttccaccgcttaaagcttgatggataaagtggcggtctctcctaattatgtttgtccatcatgcctactagcaactcagcaataaaatgcgtcaaaaaagaagtaagtcaaactcatgagccacaagagcattggtgaagataaatggagctcgagcttgagatggcactctaggcaatgcaaatagagatcgagctcagggtcgtatcgatgtcgttaatcttagtgcatggagcggatttggaggacagatgagtagaaatgtaagatggcaatgacaagctcatgaagaagcatgagcaatgtggtgcaaccatctctaactccaactaaacagatatgggtgggtggatagcgccgatgtctcatgtggaggcgagtaggatggcagcaacctttttcgaactccaaccagctggatctaagaattaaataggaacaacatggcaacaccataatttgtggagactctcggctgcaaaattcgagaaccgtcgttgctttcctctatggagaagcttgagctcaagccttgggtggcactggcagagacgctcgagctacaagtatggtataggtagatcttgaacttgatcttaggggaggtgatgagtagattaaacttgatcttaggggaggtgatgagatgtaaatgatggtggtggtgctgcataattggagttagagaagagagatggattaaggatgatcatagtataaaattgacaaacatacacagcttgaagtaatatcgttaaatatgggtggttcaaaatgaacattggtaaaaataccataatcaaccaaacctaaggggaattagaggtgactttgactcaaactacctcttgcaaatttacaacttacacttgcagtataaaagttcgatattagatggaggctctaaaaaattattcaatgtgtatattagtatattttaaacattagcataccaggaggcataggtggcttgccccccgaaagtgcttgtacaaaaatccattaaaattatatgaagaagattggctagctcgatcggtggtttggtttaaaaatgctctagtaacaacatttcctttaatcaaattaagatttgttgattttttgactggatcggttctttagctcctttctgaatttggtctcaactaattgtatagaaaaaaaaatgaaccaaactaaaccatttcaagcaaaggtaaagaaaaagtgaagctgacttatcatcaacccctttagatactgagtagttggattgaattttgaattgtacaatggtcctccttttgtggctggacataaattgcaccttcaatgatggatttctattttccaatccatcctataaggtggtaagcaaacaacaattccaaatacaagttgagatggactcaaaagctaagatgtgattacatgacttcatgtctatatatcgtggttgtgcatctagcttataaagattcaaatccgatttaccaccggtatatatcaataatctttgagtaattacacaaatgcatgtttggtaggtgagtacatgtgcctcaaacaatatttaaatgtgtgtaaattacacgcacgacacatacgtgcgtgtatatcgtacaacagcgttaatgtgattacaaccgtataaaataactccctctcaagggaaaaagagttgaggagatacaacaaacttaaggcacctttggattaaagaattttcatatgaattttgagaatccaaatccttagaattttttcttatctaggttgttaacgtaagattgaagtatggaaattcctttgaatcacattcctatacgttaattccatatgaatttaacccatgacctcaaacctcatttttattttttcctttgattgcttttctttttctaatctcagctttcctagtataaacatatcctctactttttctttgtgatgttttctcttccacatcttgtgtagctgcaagacgcgggagatgggccccggctgcggacggggtgccggaatgaacgagcgagcgtgggccccggccgcggacggggtgccggaatgaacgagcgagcgtaggtgagtgccgatgactaccactagtggagctcttattggctgtggtggaagagtaacatgagggattgtggccaccaccatccacactaaagtcgtcgccctatttgaccgagaagctagttagcacggtgaaaagtagcaacttgatcgatcagtcacctacacccacactagaagaagaatggcaagaacgagtgagctatatatgtgggaaggcgagagccacgatgccggccatcacgacagtgtggggggatacaggtgtgacgttgggcaaggcggcgtggtgattgggtttgggtttgaggccgccccggtgttgacagcaatgacggaggtcgggatcgactggagcgacattgaactgccagctgggacgaccggtgtcggtgtgagagggcgggcgtccaacgtcgatctactgaagccgaggcaacgattttttttttttcgtacgccagaggagcgaagaggatggcgcacatcaggggcacccatcttgtgtgcgccacatgtggatctggcacaagggcgaagtgagacgaagcacatgggatcaaatgggggtgatgtgggacccacaaaacatgtttttaatcgctagtactggctgcatgcaagttgtttgacatgtgaagttgtgctaccgcccggtgccagatttatagctcgctctcttctctttccttaattatctccccctccacctaggaatatgatgacattaaagtttttggagcctgctgattcatcttattgtatatgctcttaagaagtcaattgcgtcttctctctgtctctctctcctttagaatcaatccaaattcaaatattatttttctgttagtcattcaaacacatcatcttttgaattatcaggtgttatcaacaactattgttcctgcaacagttgaaaaatagctataacctaccacggtgttcaattgatgcagtcgcaacaacaatcccggtcgatcaagcccacaatgttttagattcttatgagattcgctagcaaactactccctccatcccaaaataaactaacctcataatagaatatgacgcatcctagtataaatgaacatgatgtctcacgtcctagtacgaagttggtttattttgggacagagggagtagcatttaaattcaatgcttattttatttttaaatctagcgtagtcatcaaatccatagtagtcaaatcaaatgctacataacctgaattcaacgatcaacgacatacataggagtaagtaccagtaccagagctcttcgaccgtctgcctaagcctaacacacatgacacatggacaccgaacacaaccgtagttcactgcaaaggtagcactactggtaggctagtagcaaagctgatgagagcagcggccgcagattcacagcacgatggggtcggacgactgcgagcccttccctcccacgcgcctgaacctcttcgcctgcacgcagctccggctgctccgccgcaccgcgccgccgccgccgcctgatcccttcgccgccccgtcctcctcctcccgccgccgccgccgccgccacttctgctcctcctcctcctcctcctcctcatcctgctgctgctgctcatcagaccgctccttcggcggcacggcgtcgtcgtcgtcggcgtcgccgcgcacgatccccggagcctccgcgtcccccgtgccatgcggcgcttcctgctcgcgcggtggcatcacagccaggggagggatcaccgcgatcacctggggctggggctgtggcgcggcgtcgcctcgcttaagcggcggagcaggaggggaggcctcgatgagaccgcggatcctggacagggacgtcgccagctcggcggggaggcggtgttgctccagaaaccgcgcgacggtcgggagctcctccctgacgccctccacctgcatgaaccgatccaatcgatcacaacaacgaaacgcacgatgcaatcacccgaactgaaccgcgatgacacgctcacgtcaatgtgacagcttcctcagcacgagtgttagggagatggattctaatctaatcactcggtgcatgtccacacgtttattatacgttagctatatgactatgatttttttaaaaaaaatgacaagatagattgataacaaacatgccagcaaattcgacttctgtaagttgtaacaatgataacaaagttaattgcgaatatatctatactaattaaaatttaatttgctacttttattacaatttaaataagtaaaatttgagcttgcatatttgtaggataacatattattacatatgaatctaccttgttattttttttttaatttttttataaccatttagttgatagtatgtagcaaaagggtagatgtccacctaagtgattaaaagtgtttcaccgacaggtagttttaccacggatatcaggctgagcccaagggaagctcgcgccatggtcgccggagtgaaaacatctgcggcggcggcggcggcggcatctgctgtatgaccatgatcaccaccatctgcagcgttgatcagctgctggaaccgttcgatctctgaagcgtacatcaggctccagtccactgccgggttccacagctgccgctggaacgcggggacatcgttgagcgggcgatgctgttcttgcccaaactggcgagcgaaccggtccggggcgtagatttccttgaggttgaagctgaccagccatgttctggagaagcagaggttatccggagcagcgcaatgcttcggaatggatgcaggatcaacgcccttgtagggctcccagttgacctgaagttgttgttcatatcatcatatggtctcaaatcaaatggcaagggaaaggatgaaatgctgaacacaaaactgtggtgatgactgatgagaatcacaactcagatggatagacttttacatcagaaacttgaagcaggccgaaggctttcctgatgtctgaaacgttcttggccggttgagagatcgtgctccctgtccacttgagtactcgtgggaagatgtgttctggaggatcatacatgtcagggcgcaatgccggaatatactcatatatccagccctacagacagatattcagaatatatcagaacattttcgcaatggacacagtgaaggcacaagtcacaaacttggtctgtaaggtaaaattttgtgagaaacaaaaatggagaattttgttatttcctatcatctttatgccttactatcaattacaattctcatgttgaagttcattaatccttttcagaaaacatgaacagatcataacaatcaaaatagttttttgatagtttcatagaactggaagatcatttcctactcgaaattcaagtgatattttcctatacaatggttttgttaaacataccatgagcaaagccgcgctaccgaatagcctttttctggcagaatgggccacggcgatggagagagccttgtagagatgagcaagagcagcagcaccccaagcatattcctgtaccttgtcaaagtctgacagaagtggcaaatactttggtgagacatagcccctgtccctctctggaagtaaggctgatccaatcaagaacaggagatatgccctggtgccatacatggtctgatcattggtggggcgttccgggatccggctaaacttggattgcagccaagagagcttcacatggctgcccctgcagtccctgcaatcaggcacttgccccagatactggaagcagaggtcttcgaccgacttgttgagcacagctccggttgtcaccacacggcctgtcaccggaatccccagtatgtaggcggcgtccctgagtgagggtgccatttcaaagccattgagctgagcagtgttggtctccttgctccacagttcgaagaatgccatgagcgcgatgcgatcgatgactaggcctgctgtgtgtatcaggttgccgagcccgcttgcatcgaccaattgttgctgctgctcattcagcttccatgtgtcgagtctctccgtcgtctggcatacggttagttcatgggttccctgtatgtttgagcatcaaaatgttatgatttaggtacaaactatatatcacaagagccaaaggaaggttcagcaaattggtgtcgcttgctcgttgttgataaataataattacctgaatgacgcttttgtttgttggttctgcctctgcggattccatctggttccattaagagaaggaatgttatgtggtaagtgtgcatacaatccaagaattgctcgcagagaaatttcagtttaagcatccaggttaagtacggcaagaatttgcataagtttgataacaacttaacaagtcctcaatgagcggtctattgcttatatgagcaactgaacatgtaattgagactttgttcccctcaaggaaatgaaaaaattaactagcacagaatctggaaactttgacattggtaatcaaaaggactgtatatatcaggcatgatgataataaggctgggaaaaactgtagataccaggtttgattcactaaagttcaccaaaaaactgtagaagtttttaaacagatgacgtgagctctacccttaagaggaagagaactgcaaccacaaagagcaaaagcactaggaacaactgctttaaattttcttcagaataaggagaaagcaaaatgccaggattggccacatacaaggtacaaaaggacagcagcaaccagccaagaaaccatcaaagtttacctgaacaaaaaagatacgttgtgaaacaggaactgaactactcatctaatcaactgtaaaaataaagaaacaaaatctggaggaaaattgaatcgaaatgacgtagatgaagttggttgtgcgcctaacagcagccatttccatcatcttaaaatattgcagcagatgaggaagaataccagcactaaattaacgagtatacacttgatcaagaagatggtataccattttaatcatagaaaacatcacacaaaagagggggaacaaaatatcgaagaaatacatccgataaccatccatttccttctaaaactgactaggaagagcaaaataaaattgaccgctatcctctaaaacccaaccacaaatatggaaatcgggacagaaaacaaaggggaaaggagaaaaaaaaaactgaagaccatagatgagatggaacccttacacagaagctggagaccatccatagcagttgaaaaattcagcaggaaaacagaaacacacaccccacacaggcgattcccagtcataagcacaaggatgaaatgatgaaagaataccaaaatgcaggagcaaacaaagcgatccgggattcaccatgaacgaaggagatgcaaggaaaaaaaaatactggcatatcatatcacacgatgagagtgatagaaaagagagagcaaactaaccaggatcaatgagtagccgcagcagcgagcgagaggcaacaagagcacagcaaagaaggcgaagagcttcttctatgcaggcgagcgttggttgggcaatgaaagggcaggcgatggcgattgccttcgtggttgccttgcctccaccgctgacgtgtggggccccccgtgccagaggtcgctgctagggcgaaacgtggcgctctcatcactggtagctttcccatgtagaatgatcactgatcacatggtaacactgtcctcggctagccactgcctcgccaaatatggctataggagccttcaatggtgcactgccagcatatcaataagctggttttaggatcaacagcagcaggagtagctggtgcaacaaacaatccaagcgtacaaggctgatgaattgatgtgatagcacagtaggctctctacatctctacttggatcattctacaagcagtcaaagcttagcatcattataaaatcaccaattcaccatgttgcaagagctgcagattaaacgggagagggcacaatccagttcacgagcaacacagttaaaagggtcttggtggcatcatctacattttgcccaactacatggtagagactagagagagatagtattaacaaggagataaagcttgcaagctctgcgcagtgaatggcaaggcgctaccagcaaaaagtctacgacgctacataaaccagttaactgtcagcagcccaagtttttctgctactttgtacataaaccatggatgatcagaggaagatcgggttggtcgcctcggctcccaccccgtccctgtgcttgaacattttcagctgcacacagagacgcccgctccttcggaggttctcggtgtccctggggagccggatttcgtcgcggtcttgctgcctccgcttccttgattccggcgagctcgagtccagcgaggaacaggacggcgtcgtcaggtgggagttctgccagaggtccatgaccccttgttccttgaactcctccgctccatcgagcagagggacggtgccatccagaaccatgtcgcacttgctatcctgataaggtatcagcacggctgggaatcggtccgcccttgagttcggagggcttgaaggatcttgaaagaatgacggcttccccctctttcttgggttctttgacctgacattgctgtcctggccctgccctgcttgatctttctttcggctactctgtggtggggagtaactcttgatcatcatacccactctctctagaaagcttgcaacttccacagggagtaactgtccctccaggtaacgatcaattactggaaaatcattcctcagatcttcaacctgcatctcacaaacagcaattacaataaggaccactatgcaagcaaaaacatatgaaggattagcttcttatttgtagcttaccattgaagagaagttctgagatgtgctccgactacatcctgcagcatcttgtttagttatagactcaattgggagggagttgatattggtttctgcaggagtgaaacgacagccaaccaattgatggaactcctcgatttcacgagcatactcaaccctccagtccttccacttgctccaagttcttcttgcccacatgggcaccccatggaggcgaccttgttccctcccaaactgcctagaaaaccgatcaggtacatacacctcttttatgttaaagctgattagccatgtccgagaatagcagatgttatctgctgcaatgcaatattctggaataattgcaggattcatgtccttgtaaggattccagttgacctgaaaatataattaattaatataaaataacacaacagcagttaaaatctttgttataaatctataaaataggtagacttgcacttgcatcagaaaattgaagctcatcgaaaacttttctccattccatgactttctttctctgtccacgcgttgctcctccaaagttccatcgacaggcccggggcagcaaggtgttctgattcttttgttggggttgagttaatggaagatattcataaatccaagccttgagagaacaaaataaatctcattaacaaagataccaaatatcatcgacaatcattcaaatttattcaaacaagaacagtaccatgagcaaagttgcactgccgagaaactgggtagtagcattcggtgttacagcaacagatagtcctctgtacaaatgagcaagggctgcagatccccaggcatattcacgtatctttctaaaatcagccagaagaggtaaatatcttggtgatacaaatcccctcatcgtgtcaggaaataaggtggagccaacaaggtaaagaaggtatgcccgggtgctgtaagcaatctcgttgatagttggattttctggcaattgatgaaatttcctgtacaaccatgtcaatctgattaagccacacagttgctctccatttccagggctctctcctaagaaatgcaaacacatccgcctcacagcttcatcaccaattggctcagcagtcaccacatgaccagtcactggaattccaagaatatatgaaacatcacggagtgatggggccatttcaaatcccatgaaatgtgcagtatttgtttcattgttccatctctcacaaaaggctgtaagcaaagaacgatcaatagtaaatcctgtggtgagggcaagatgtccaagaccactagcattaactagttgttgctgttcgtcagttagaacccattcttttagcttccgtgtctgctggctgggaagcagaacaccatatcgctgtggaaaattgagtgtctgcatgtaattttgttcacgatggccaagtgaaaacaaagggagaagcagctacataccgtccagatttgtgagcttccaaccggtctccgtccacttggtttttgttgttgtgttaccacaccttgagatgcaaggtccatttctcctggaaaacataagagggacaataaggtaattgttctatgatgcttggtccattgttaaacaaaaaaggaaaaaaagaaaaagggcagttgtaacttgtgtggataatacttaataaaacagtgtgtaaaaaaggaactatcaacacaaccagaacaacaaagtccataaataatgaagcaaaaacaaaaaagtgctctctcatacttgtttacgatatcagtgatagctgatgataagtaaattcacgcacaccatttatgaccaattattttgacaagttcaattttttactatattttgctaagataatgatagttgtcagcacaaagagagtcaagagcaaacgaattcaggtagtctgttgaattatttttctgcttactgccaatctaatagctggatataagaactaaccacacaaaagtgtgcagtatctcttgtaataaagagatagccggattcttcatgcaatttgcagggctagattatagtctattgaaagtagaaatgcatttgctatataactcttaggtttatttctagaaacacaattgtaactttcatacaggtatagtaaagaaagctctaaaatatatccaataaatcttcaccattataatctgagctcatcctgatgaacagtgacgatatttctccttttatttgataacgttgtaatttctagcccttgatagagaatatggtggcttctgttcagcctgttctaatagtaaataaatgctagtggtagtctggtggataagaatgtcgtgatgctcacatcaaagaaaaaagggggatgccgtgatgcttgaaaaaatagcatgtgagggcagttctatgtacctcaactgtcggcaaatgaagatcatgtagtaaaataggaagccatgcactaaatcatactacattatggtgatatttccatgtaataatgacaaaatgcaagagtatatagtaaggtcgatcgcttaacacaaggaaaggggtaaaaaaaggaaagcaggaaaaacaaatatcatccatttctagtgtttcctttttacattcttcagtattgtactcttattattttattaagaaatgtaaacagtggcagagaggttttgacagagtcattggcttatgaattttacccctaagtaattgatagttgagatctaccaatgctaatcccttctcatcctaatatctgtctagctatccagcaaataaattagaaaaaaatattctaactatttattttcaataaatgttccaggatacactttaaaaaaatagctccagttgttattaagtgtgtatggatttcagttcagttcagtgtggggtacatggtacccagatacccatagcaaggcgttttgggccatgcggcatgaggtgggccgagtgccctaggcccacatggttaacttgtaaactaagaaagagataagggataagttggccaatcctatcccttgtaaatagatggtaggtacccggattatgaaggctacactaccatatctagccggttgcctccgcacctatataaggagcaccgggaaaccctcattcttccataagcgccacgtgctattcctacgccgtgctgcgcactccaatacagatctaatccactcatctggactagggtattatctcacgtcgagggtctgaaccagtataaacaattgtctccatctctcctagatctagtgcaccctataaattatattgccgatcataagaatcgacattcggctttacagcttcagccttatgaaaaatcaccgtgtaaagatagcacacaaaatctcaaacagtccagcacaaagcccacattttcagaccattgaaaaaccaagagaagacccgcacattcaagcataaccacaaccagaaaaacatccgatcttagccccatcatgatgctccagcacaatgaaaagagaaaaaaaaaggaaccactctacttccatgaaagtttatcccatggcactctattaatcgctgccacacattcagtgatcgaaattaacaacaatctataccctcaaggccacaacatatccagaaaaaaaacagtactaagaacagatgctatgtgctaaacgcacgctaatttcccacagcatttcattgcactcccccaagccatctaccacgggccacgtactacgaaatgctaaaagaaaaaaaaaacctagaccatggaactcgcacagatgcaccaaaaccgctggatggatggatcaagaaccaccaccaccaacccacccaccaagaaccgaaacgggttacaggtacccctgatctgagattgcaggccctcctccgctactgtagcgacggaacgaggcgtaggaagtgcgggaggagcagccggtcaccttactcgccggggaaacgcgccgccgccgccgccaccgccgccgacctccgcttcggagcggaggagaggttggagaaagcgagcaaaatcttcgggaggggaaggaagaaagaaagaaagagagagagaaaagcttatcgagtgcgccccccaccctccctctgccaggtgggccccacacctctcccccgcaacccccatgtgggccccgcgcgtcagcgtcccgagcaccccgcggagccagccagccagacggttcgagccggaccgggtcaagggcttcctctttcctcttccgagttccgaccccgtcgcgttaaaaccctagccaccacaaccacgcactcctcttttttttttccccttccccaccaccaccaccgcctctctcgccggcgaagagaagggggaagcgcggctgcggcggcggcggcggcgcgcggcggaggtagggcttgaggtcctgaggtctctcctccgtctcgatctgcctcctaaccccgaagcgagagggattttgcgcggggagggtgggggtccgtacagcccggccgccgtatcccggggtggcgctgaggctgccatcaggttggttcgctactcgtttccttgtcctcgttccgctaggcaatttcggtgtggtggtggtttcgtggagtggggttgggggggggggggtctgattcaatttctagggtttcgagcgaacaggtcgccttatcatgaaacggtttcgtcgattggggttgggattattgcgattggtactgcgtaggtgagtttatggggattgcttatcgagcttcgtcttccacgggtagagatccggtggagatttccggcgggcctgtagctcagaggattagagcacgtggctacgagaccacggtgtcgggggttcgaatccctcctcgcccacagacttccaaaggggaatcgggacttgtagggttagggggggataaattggggcttctagggtttggtcgcgaactcacgatatttgctagtgttatgctgatgtgtgtctctctgctctgctctctagctgctaggttaatcgagattaattctgtatgtatggatgctcaccctagctaacggttgttggtgcatcaaaaatagaaaccaaaagtggaaactgatctttttgttgtgagttatagccattaattgcttctgttactgtccacatttaagtgcctccatgttttttgtaaagcctccatattattacacatgtatcaccataaaaatggaaatgaaggtatcttggtagttacctacctaccatagaataaatcaagtttacaccgtaagcatatactccctccatcccattatatagggcgtacctgctctagacgcacagaccaaggattttcaactgttccgttcgccccgatacgtgaagttttgcttcatccgtggaccttgatcttcacagtgtgtatcccagcaggccacgcccacgtattgctgggagagagaggccttttaactaagagcaggtacaatagcaggctataagccagctataaacatattttaaggagataaaagaggagagagaagagcagcgagctacagatttgtagccagctgtagcacggactccaagacgcagtgtgtatgacaagtaggaccatatattaatagtgtagtatgtaactattgtacgaattggctattaaattgactatagatgatttggagctagtagttggctatactattaaacttgctctaagagcacccgcaatggtaaagtaaggtgctatctataaaacatgtacatctcagcaatagactagaataatagtaaaccatctcaatagtatgtctacatgggtatctatagctctctaatacattgcctcgtttttctctatagactatctccaggttagtagatagctttgctctctctcttcatttaatctcttctaagtaggaaaatatgctgacatggatctcttatagagagcctatagataaccattgtgggtgccctaagcaaactaatcagcaataatgcatgcttgtaaacggaagccgaggaggtgatgtcttgaatgcttgcatgcatatgaatggaaacgagcaaaacttaaatgcttgcatgcgaataaacggctgtcgaggagatgccgtcttatattgtgggatttgagtaaaatacaggtacaccctatatattggggtggagggagtggtgctgagcaagaaaaaaagagattgctttctctcatagctttacttgattgttcctgttcctgttcctgttcctattttttctttttctgaaaaaaatgaattttagaattagcatgcaatattttcattgcacgagaaaaataataggtgcttagttctttgtcatcggttcatgcatgccacatgacacctcttatcttgctgtatctatatctgcccatgatgtgctagtttgtggtactagaactaagttcaagcatacatcttttagggtatgtttggatcctaggcaagagaaatcttatcctagcttagcaaggacagcagtttgctaacgacaataaaaatcttacttctgtgggaaagcttgcctataactgcccaggaaagcttgcccagcttgaaggacataaggcacttctgtgtgacagttgatgcatgctaggctacaaagccaaatgttgtgcttagtttctttgagctatggcattgctgggccaatttgtgctggatatgtgatgcgaactgataataagatataaacctacccttagtttcgagctgtgttgtttcaattaaaagcactggttgatctgccagccggcaatccttggttgtctgcctgcgcctgtaggtgaaccatcagcaaacctttttgtgagttgaagatagtatttttcggtagcctttgctagacttaacaaagctaaaaacaggattcctcaactgatcaagaattacatttatgcccaatattgagttcacaccatgagtttcattcacaaaggatcccttgctgcccgcctgccatgcactcctctaaccacatgtcaatatattattattccttattacaataccctaattactcgaataaagtaaaaaaaaaaagaacaaaggagcgaagtatagtgtagttactccttccccaccgaacatatctcgttccaatcttctatatctacttccctcctgctcacgtacaacaattccaccaccaaatctgtcaaccatgatggcgtacctcgccaccggcgaccactagaggcctctgtacttgggtttttgattttaggcagttccatgacgtgtcttaaaaaagagttgagttgatctggtgttgtcccccaccaagaccagaaccgccagcacgctgttggtttgcccagtttcgctgcatcccttgcctctgcgctgatgatgcaggcagatcaactgcttcctataacgtcttggcccatgcattgttatcatcgaatggccttggcacagccaacattgacacttacccagcgctgtgggcctgcgagatatggtgagaggtatcggtgtccgatgtctgttaggcaggagcggatgtgtggtgaatattgacacgtgaaaaaaaattaataagcaagtcatatctggttgcatgtatgagaagtttaatgtttttgccagattctatgcaattttgtttgaataatactctcgaataattatgtacaattgaacacctcctgttaattaattgtacataagcaattctcattatttctatgttctgttcctgtttgtgtttactattttattctggcatgttaaacagcttgcctctatctgaatcttctggccctgaaaagaagctaaaattatttttctttgtcaagaccaaaaagtatttattcaaaccaaacactatgaccacacaagcttgtaagaagagaagagcagtttatataagcagtgaatcagaagactctggtacagactctgaggttgagggaagcaaactctccaaaaaagatggggtcacgtcagtctatacatgtggtcaccagccaacctctaagaataaggttgatccgatgaatactagcaagtcaaggcagtgtggaagtattctgaagaagctcatggatcacaaaagtggatggatttttaatacaccagttgatccagtggtatatggaattcctgattactttgatgttattcgcaatccgatggacttgggtactgttaaaaggaaactcacaagcaagcaatattccaacccttatgagtttgcagcagatgtgaggctaacattctcgaatgcgatgaagtataatcctccaggaaatgatgtccacggaatagctgatcaattgaacaaaatatttgattcggaatggaaattattggaaaggaaatggaaagacagaaatttggtacaagagcagccatcactgaaggtattaaaggctcagcctgctgttaccccaaaacctgtgctacctaagggggtgactgcaggcacaaattcagctgtgagcaagacactggcaactgcattatcctccaaagtatgatcacagtcatgtaccctcattcagtgatttttcttcttgggactttgatcaaagtactgctctctttgcaggtaaaaattaaattttctgtgcgaggctctgagctgacctcttccaaaggtgtgaatagaataaactctatgcatacaatctttccattgttgattgtatttgacagccattaccaatgcttttcaattcagacacgcctttgcaagcagttggcagaagagacggcacaattaaccaatctctcccttgcaccaaggttttgggcacgagctcctttgtttatacttgagtattcttatctgagtcttggtatcattagctaaacaattgtgtgatccccctcttgtcttgtcttttatttttaggacaatgctaagacaccaaggatacaatcaagtgaggacagatctgaatcaactggtatgtttatgatttccacgtaattttatcccatactgttttattttactaaagcactcaattattatcttaggaaatgaattgcggccttgcgatgatgcttctacttcacctcttgcttcttccagacaaggttggacatgctatctatttatccatctatttgtgcatgttaatttgcatactagtatctctgttctcaaaaggatgatgtcctagattcattgcaaacacagtcaaacctcaaaaatcttaaatcattaataaatgaaaaaataccaggatttaaaaatcatattagtagatttgtgaggaaaaactgtcatatggttatattttaaatattgttcccatactatcataaaaatacaaactgattccatttgtcatccttgagttttcggccatggcgcaattctgtcgatttcctgcacgtgatttttcggtcgtctcatcattgtttgtttttcatctgagtcctgtgcacactgtggtccgttgtctgcatccgagacccactcacatccgttgtccaacgtcccacgcatgaccctgcctcaccttggccacatgcacccctcttccgtgtgcccatggtgctcccctcctgatccatcctttcctttcgtccatctccctcttcctatgctgcgagaagcagagctgccacaagcagaggcaaagcacagagcgtgattcacttagctaagctgaacatgatcccttaatttttctccatcagataagcatcgagaagaagtggaacaaatttctggattgattcattgtttatgtgagtagttctcaagtctggtttagttacattacgtaaatgtttctgatccacacccttcttttcgtaggacgatgaaaaagaatggataaagatcccaagaatacatagtttgatctgaatactcataccttgagaatagcacatctacaagtaggatttcctctgtgatcgtaccaaaacatgagttccatttggattttcttttttatcattggatttcttcaatgctatagtgtcattcttctggcgcttaatgctatctattcccaattacaattgtgtacagccctacacccgttgcaatgcacggtcattttgctagtaaatatataacttgagaaagtaatgataaaacatgtgcattggagactgccgatgtcctaaatgacaaccatttgagaacagagggtagtaactttatcatctattctttccatatgttcctttgctaatatattgcatcttatgatgtgaattttcagaagaggaatatttgcctgaagaacctttatcaccaagcaaggctcttcgtgcagcaatgctcaagagtcgttttgctggtacaattgtcaaggcgcagcagaaagcacttctggatcatgtattatttctgaaatgtgtactgaaatttgtagatttcaattaggctattccttcgcataggacaagttctagtctacgtctgtgtagctcttgctgatgtgcttttttaatctcctaggggaagaaaatagaccctgcgaaattgcagttagaaaaggagaggctggaaaaaaggcagcaagaaggtaagaatttgcttagcctttgatagcagatggcatggagctgtttgattggcaatacattttttctttaagttcatcaagcattttgatattttatattcgcatagagttctcatctggacttaatatgggatggctgctctttgtgaaagaacttttagaacacattacggtgaaacttgattgacatctcaggcttcgagaaactttgggatcaaaacagtccgtcgagagactttggggaacataaccccggtacatgctagagaattgtttgaacagtacagtgtcccacatagacaagtttgttagtaggtagaaattttatagcaaggcatcatcaagagtcgttttttaacaagtcgatcaggcttccgaccatttttttgttccttgaagcaaataaacttaagatttggatatatagaataagaaaaaagagtaatctttttaccagttgtccccacatagaccacaggttggctaattcaatacactgcttcatagtaactttttgagtcaattcatatactttcacgctgtgaatactcctggtcacatcggatctatatctattttggccaaacgtaatcttgtttcaatatatcaaaactgtagtaattttgttatgaaaagcatgtccatgatattccacattatcacattgttggaaagtctaaaaacaactttattttgttggaaagtctaaatttactttgaagtgtaaaaggtggcatgttttctctgatgggggaatgggtttcctttaaaatgggaacgaatgctcataactatagtggtaactatatattgtatgtattattcttaggttatacttttattttgtattggcacgcatgatttcagttgcatggctttcttttcaatttacccataatgcagagaaagcaagaattgaggcccaggtgaaggcggctgaagctgctgcacaattaaagctagacgaagaaatgaggatgaagagggagcaggaaagacgagcagcacgcctggcactacacatggtattacatgctgccattttctgaccaactagtttgtatgcttaatgttgcacggtgattactcaatctcttctcctacgcagatgaagaagactgttgatattgacaacagtgacttccttaaggacctggaaaacttaagcaaaaagtgggagctgaatccccctggcaaacttattgttgattttgtcgacgggatcgatctaccacctggcttagggagtccgctagagaggcttggccttttcatgaagaaggatcttgaggaagaggtcgaacatgaaatggaggacagtgtatcaccatctacggagatcgacgtggaggaaggagagatcagcttctgtcaatagcacggctctaaaatatccattgtttcttcctttttttctttccccccatcagactctgaagcaacatgctcgcatggcttataaaattgtgcgcgagtgctgtgttatttattctgcctcaagacaacatcataacataagccgagtaaaatgaagcgttggttcatctagtttgtgttgtctaaccagaaaacaaaaatgtcagctgaacactgaagtggagttatcggttgcgtggacttcgccccgattttgtcggttctgtgaaaccctgtatgttgtaggtgttccacgtatgcaattctgtaaaaaaaggaaaataaaaaaaaagttgtatgtaatgtgatgttagactgttagtatataataatattatagttactgatgagtgtagatgtttgctattgctggtagtcgcctcttgctctcagcagtctactcgttaccgtgtgttgatgttgtgaccttgtgatgctgttccagttgaaaccctcagcgggcagatcccttcaagcacggctcaattggatcagcaaatcaattagagtagatatgtgttgctgatgatcagcaaatcaattagagtagatatgtgttgatgttcttttctcaacaaagtggccgtagtttagtggctcaattggatcagcaaatcaattggagtagatatgggttgctgatgatgttcttttctcaacaaagtggctgagtagatatgtgttgctgatgatgctcgtttctcaacaaagtggctgtagtttagtggtgagaattccacgttgtggccgtggagacctgggctcgaatcccagcagccacatttataaattttgcttttcaattttatttcagttttggaattctaatattcgtatttttcatctcagtctcttttaacaaaattccactacatctatcgcataataattgtatttctatgatttaaatgtccccaaataattatccaatagagtactaatgtcatttcaattttggaattctaatattcgtatttttcatctgtctcttttaataaaaaaaattactatacatctatcccataataattgtatttttaggatttaaatttatccccaaataattatccaatagagtactaatgattccattcattacttcccttccattctgacctatacactatttaataagaggcattatggtttttcttctcaaaccttaacactaacaacctagaattataattttttttggacggagatagtattactttattttttccgtctattttctattgatataatttttaattagatttaatggtattataacttttatggttttaaaatatattattagtattcacctatttaaagctgcgtgccattataatttcaagaccattgaataccatgccaatataaaacaagcaggtctataatgtgcgttgaatttctcccgtggaatacgctgttttgacaatagtacgttactcctgtaaagttcagaatgaaaggtggatatccctgtaagcaaatattagcatgatacttcattttaacaacgcaaaagaaccataaacaaggataacagtcttcgtttcaacaacacagaagacaaggatcattacagcattgcagacttgccaaatgtggcgtaatcgttacattcatccatgtgttatacatgcagaatggtacatactacaatagctcaggagtcagcgtagctgtatttgtacaagagccctcgatataacaaaatcacagtacattgaatactttcatcaagttttctcatctatagacccatccttttgggcctcaagtatgtcgagcctttcttcaagcccggcatagaaacttgctgctgctgcttagctctcttctctcgctccctctccttctcaagccgtgcggcctcggcttgttcttgcctcagcttctccatctcctcctccatcgcggtcttgtcctccttctgcctcttcttatggtcgaggagcgaggtgtcggtttccttaacagagaagaacatagggcccaactctgccagccactgcgggtcaacagcggtgacgcactgcatgtactctttggtcgtcaggacaagctcatggtagacaacatagtcaggggtgtaaccaaggccgtagagtgcactgctggggtggaggtggcatggcatcccgttccggcagttcacatactccccgacacccttcaacctcgcggcattatggaagtatgcagagcagatggcttttctcaccacatcccattccatatggcatgatgtcagtgggatcttcagggttttcagtatgtccaatagctgtgaccttacttctcgagcctttcggagacccttgacatggaggaagtggtcattacaccagtctccacgatattggttcgacttccattgcaggtagacattcagaagagttaaatgatcagattctggaacaaaaaatttctcccttgctgcatcactctcctctgctcgatctttgggacgaaagaagactgagggcaccgagagcattgacacaatggtcagtacttcatcaaggcactccagctgttctcccatgagaagcatctttgctagagttgggtccaacgggaattcaaccatcttccaacctattactgtaagagcaccaacattgttcaaggcacccaacacccagagctggtacatggagttgaggatgttctcctgcgggggtgggtccatgaagtcaaagtcaagcaagttttcgactttcagagatttcagtagcagaaccacattccccagattggtcctttggatctcaggcactgggttaggtagcatctcattctggtaagctgattctgtgaacagtctgtagcatgtgccaggaccagttcttcctgcacgtcctgcacgctgatctgcagctgctcgactaactggaaaaacctgaagagcatccatacccatccgtggattgtacaccttcatctttccatacccagtatcaatgacataaaaaataccatccacagtgagcgaggtctcagcaatgttggtagcaacaatgcatttgcgagtgccctcttctgccttctgaaagattttggcctgcaggtcagcaggcaactgcgagtagatgggcaagatggagagcttgggtacagtcttggtggatgatgatatcagctgctccaggcgctcagcaagcgcatagcaggtagcctcaatttcctcttgccctgtcataaatataagtatatccccagggccactggttatgtggattgtcatagcctgcttcactgccgcttccacatagtcttcacatggtgttttgctgaacatgatatttacaggaaatgtcctgccaggaatatggaagacaggcactctgcggataaagaaatgttacaagattagcaaaatagaaaatggattcaaatcttactaggaaaaagaaacagagcaagttatcttaccctccaaaaaattttgagaatttgtccgcatttagggttgcagatgtgacaattagcttaaaatctcgtcgacgtgcaacaaccttcttcagtatgccaaacaaaacatcagtattgagtgatctctcatgtgcttcatccatgacaataacactaaaaaaagtaaggaaaggtgctttagcatttgggaagcagtattttgatactgtatttagttctatcaacggtaagagagctatcagcataccgatatttgtcaaggtcagcatctttcaaggtttcccgaagcagcactccatctgtcatatactgcccaaaaaaaatcccaaacagaagcagaaaccatgttagatctccattactacaacaaagcatcaatcaatttttttaatttcctaaatggcataacattgttctggcatgaagtgtgttgtgttcatttgatgtaaaattcataatgctaacaacctaatagctaatgctgcacccaaactaggctactaacctaagcatattctagttttaggaaacttcctactaccaagtgaaaagacaagtcatcaaccaaggagtatcaaaacacaagaagcaatatacctttattatagtgttgggactagtcatgtcctcaaatcgaattgcatatccaactttatgtcccaactcagtctccatttcttcactaactcttttagcaacactcatggcagccacacgtctaggttgagtacagccaacaatgccggtggtggtatatccatcctcatgcagatactgagtcagctgggtagtcttcccagagccagtttcaccaaccaccacaactacttgattttcacgcacaacctgctcaatgaaatcaaaacaaggtaatcaagaacttgtaccactgcatccttttgaaagaaactaaaaatcaacatcttccaaaggaaacttgattttcaaattaattacaattttctgaagggcaagaattattatcttgacctttctccttgaggatagctgcataggtgtactacaatcatcaaaaccatattcaaaatattctaccgatttgtttttgaataatttacactatagaaaagcaacatacctcaaacataacaaatgctgtaaactagcataggaaaacaaaatgaaaactgcaaataaaatactgaaaatgagtttataaactttagttacaaacctgtagcaagtcatcccgtacagtaaatatcggaagatattgcctctgttgagaaagagattttgattttgcaaagtcgctaacagcttctgcttttaccttcatgtgctgtgaaaattttgcttcctctttaaaatcaatctcaccttggtcaccaacagtagcagtatctgcatcaacctgatttttcaaaaaaaaaataagtaaagcgtaccagctaaacactattaggactatatatattatggcaaataatctacctgttcagccgttttctcaacacccaaaatatttccaagcttagatccagcgagctcccaaaagcgttggcgtgacttattcatgctctgtttttcacgaatttccctgaccaaagcagaacctttgcgtgcaactattgccatatcggaggttgggtccttcagtggcattacaggttctgcttgttttgtgaatacaactcgcccatccaggaatgggggttttgtgtctgcaaaaaattataccgtcagcatttttaagttcaacagcatcaatatattgtaaacaagtagtagtaaaaaaactttgtgaaacaagtatgcagcacgctaggtaatgttctattctcttcaaaattcgatacaatgtagcatgtacaacagagaaaacagagaacatagataactcctaatgcaggttagaagtttcagactgacatagacaggaaaggtggaaatatgtgccctgaaaatggtacataacacctctcctacatatgttcacagctcataaccgctattaattcaatatctgcttgtttcattctttctgcgacatagaagttccgagagtatctacaagaaggatcacatgaagcagccacatctactagcaaatgcacgtaatagtaaatgcataataagataaatagatgcaaggacctcatcagttagtacaactgcgagcttaccttaccaacataaatagtgtctattattttcataagtaaaattgcatatacaccattacatgagaaatagatagatgctttccaaacattttcgtagcttgtttagtgacaactataacatcgataagaggctgcgatattcgaagaacgtaccatgaacaagaagtattactttcctttcgtcctcatcatcaaattctgtctgcacctctgttcctctgacagctccagatctcaacaactgtctatcctcccattgagcattatcagcagtcatctgtgataacttcttgctctgagcaagggtcatcagactgccatctttacgagtctgcacccaataaaaatagtaagaaatcagaatacaagacattctctacaagttaaagatatgaaaaattattacaaaataactatatttactgaaaaactaagtggataattcttgaccatccaattttttgcaggtcttgctgcacatgggtttggcagtcttgaaaaaagttaaatgaatacaatttcctaatgatgatgcaattttcataatatacataaggaacttgaacaaggaaaaaacatacatctaatttggtggtattctcaagccttactttacttcttaccggtgcacttttacatgtctgagtacaaattatcggatgtttacagtaaatcacaaaatgcaagacatttttacaaaggcggagtcttgctagaagatagaagtatcagatccatacattcagtccagcgccacaatagcacgaccttatcatttactaattaatcagatatattcatggtttcatagaggctgtagctgcaataagttctactcaattactcagaacaaataagaacttatgaaggctaacacgaagtgcatggaagcacgggagatgtaaacaagcaaggaacttaccagccgctttggtaattgtgcttccctctttttgtaggaactatcatcttcaagatacatagaattatcaccatcaaacatggtgttgtgttcttcacaatcatacctggagtatatttgtaaaggttagaagaatgtgtaatcaatttgttgttgtataatgataagagaatgtcaaaaatcattgtactttcatatctctacactaccatgtctggatagaactatggcataaaatcagaattttgttacagatatatgaaaaacatcattgtgccaacttacttcagatgccattaccatttttagctattataaatggagccaataaatgcaacagcagcaattgaaaggctttgttgatcacttggtttgcaaatatattttttttctatcagacacctacatcatccttttgaatacaaaaaccagggaaattttatgaggaaagaaaagtaccacgcacgatcagcattataatccatctcctgcatcatttcttcagatatctcatagttgccatcggcatctgaggggcttctatcagattccctgtcctgagataacagggtagaggttattgtcagaatgaccagtgaagaaacaaaatgagaacttgcaatatactataaagtgatccacaaacaacatgaaacttaaagttagttagacttctgtcagtaaataccaaatagactcaatcaagtctattgtttgattgaaagtacatgaaataattaaatgaattacatagtagcctaactgtaatactcttcagacagaaagaggcagaaaaattaaagcaacttagatcagtcacatggtaatttcgtaacattacttcagttatagtttaagtaatgctatacacacgttcagttcatagaaataaatatcgaacatccaatgacaattattctaaaaacacagatagagagaaaaaagtgaacaaaatacatgcttcattacatttatcattgtttcgagcactggtctaaatggttgaattaaattaccagcagagttaccacttctaaaaatcggcattccaggagattcaacattaaaagactgtcgtgctaaaaggaggattaatttctcaatagatgtgatagtgtttaggaatgtatgaatggggcttccaactctctacaatgtatatagcccataggactacaatcttcgtctactctacttcacctcctgggtgtatggatgtcttaaaataatcataccgaacttgcaacatatgagatgaatgcaaaaaaaaaaaacacctgatttttcctgtataaaggcatgttttgatttttcctacataaaggcatgttttgtgaaaacagaatcctgacttacatttgatgcagatgtagacgaaaaagtaagctggtgggatcttccaccagaacgtggataagaagacccttttgatgaaccagaagcgcgaattggtgcaggtgatggagatacgttatcccatggggatgctggatattcaaaacaacaatagaagtatgatttatttgatttaaattaaagaagaaaagtgcaaacaacattgaatagctgagcttttgttacctgcataacgtggcgtattcccacctagccaaggagacactaagcgtgcatcaggggatgcagctgcaagcataggagatggtgaaggatgttgtctatgggaatttgagcgatcatcacggtactcccgacgaggtgtatcttcccattcccatcggccactgtcccaatcagatcttgctaacaatttgcaatcacagccacaattttatcagcaagtgacaagccaattagcctaagcatgaaaagaataagataacaaacatgataccaggtgttcttgagcttcttgagctatgctcatgccgacttcgcttgttcatgtagtcaacggatgtagatctctcacgttcatcacgcctattatgcgattctctatcatcatggtgtccccgccttccactgctactatagccaatggatgcagatctttcccgttctccatgtttatcacgggatcccctatcctcatagtcatcatatctacgaggagtgctacgagaatgggaaccttgagaacttctagatttgtgggtctgtaaaacgacatgaacagaaacagacttggttagtaaggtgaagagaaaataaaacagccagattctttatgaagttcccaaagtaatatgggacacaagtaatcactaacatcttgtcgataagatccatctcggtgactgggtgaaggaccccttccatcctcatcagtgatggtaggttctgaaaatggcgataacgctttagttacaatggacaatcatttgcatttgtaacatacaagagtgtatatatataggacctttgaaagaggttctctcatcagagttggctcctcgatagcggcgagaaacactgccacgatggccactgctcaggctcttctcatcactctccgcaggtcccggcttctcatcttcatcgattgaagtagcagctgccactaccttctgaggcggcggcttgaaggcattgccgccttctgcttcccgtttcctgtgcgcgaggaggtccaaacctgcaaaaaccacatctcagaatcagctcacccgagctctagattttgcaggcctcgacgatttctgagtcaaattcaaattgggatctgctcatcaagttttacacactaatctcgctcgcggaaatcgaactccctagcaactctagaaatccacttaaaatcaaaatttcctgaagtctcgtcaaatacagaagcagaagtaaaaccaagcaccaccatacctagggcggacttccccggcggcggccggtacatgaccctatccctgctcggcaggatcagcccctgcgcgcccgtgtcgtcctccggccccagggttgtcatcgtcgcgtccatgtccccctggaacaaagagagaggaagcgccatctcggcgtgagaccaaaagctcgctgactaccccaaaaccccaacgcgctcgaaacagattactcacctccatggtcgccggcgggcggagcggagggcggcctccgagcaccgggcggcgccggttcgactgggaatcggcggcggcggcggcgagagggaaagagaggggggaggggaagaggtcggcgggtggattttgattttggcccctccgaatctggagaggtgaggtgagggcgtgggggatttgggatttgttggtagcgggagggattgggatgtaaaaatcccaacgggagttttccacttgggaccctgtaggtttgatgttattacaagctgtgtttttactaggtcggttagagaattttgtactctagtgcaaagtaaatggtggtaacggttaaacataatcttggattccgagataattacttatttgccctctaaattattgaatgtattctctacttagaaaaaatgtccatgtgttgcaacgggtaaagtctattttaatcttattatatggtttagttaagataaaattcagtgtgggagtctgcttggatatatatatatttttagaaaatcatgagctgcagttaggaatccgatcgtctcaagttaacatacgagtttttttaaacatatttcttatatgattccttctgtattaccaaaagtgaacgattttaaaaactgactcaaatatggatatgtatttcaaaagcaaacgaacttaaaaaccgactcatacacggatgacgtaccaaaataccggcaaaaacatctttaatttttataatagtatatttggccctcataaaattggctccccttttattgtctcttttttctcaactttttttatttgcccttgagtggttcttcatttaaatttttcaaaaaatgcccatcttacccctgcatgaatagtagaatctaataaattattttctttaaacggaaaaaaataaaattgggatatggtatcataagtatatcttttattcgttgcatcatatgtaaatttttaaaaaaatcgtaatagtattattttctttaattaacatgtgtcatccaaacaacacatattgatgaataaaattatgaacatacagttttagtttcattaatgagaattttttttaaaaaaaagggcagattatgaatttatttggaatgtgtggtaccctcataccatatgggaataaaaagggtaataatgaaaaaggtgttaagaaattcttgagatcataataattagttggtgcatcattaccagttcaattacactcttcatcaagcatcataattatgaattttgtaagtgataacaaaatatttgccatgagagagcacctcttgtgaactaccaagggcaaaaaaaatacttttatggttctttgggcaaataaagaagaatagttaaaaatgaagggtgatgtcacaataaagggagagagagtttccgagagaaaataagggactaagtcaacttccatgaaaaataaagaatttactcttggctttccttccttttattaatttaacgtataaaaagtaacctttgaagcatgaagatgagataaatactaaaaccatttcggatatttttgtcctttttggaacaaatattgaatgttgagtaaggattgtattatagtcttaggcccagttattttcttcaactccaaatttcaacttactcatttttcgttaacacgttattcaaactgttaaatggtgcatattttataataaaagtttatatgagttgtttaaaaaaatcaaataaatctatttttaaattttttataatagttaatacttaataatcacatgttaatgagttttctcgtttcacgtgtgctacaaatctctctaaagtcatggaaagaacgctgcacaaactacatgtaatatagaacacattgctctatgtgtctctctgtcccagaaactcttgcctgcattcataactaaaaattgttacattttaggatggaaagaacggtatttattaaatactcaaaaaatatataatatttactttctactttataggatagtgaattgatgtttgtttgacataattgttccttgatttactaatcaaacaactttagatgggtggggataacacaaatgagaagattatggttgttcaacataattggctaacatcaaggccaagtacacaaggtttatgggtcctaaaataccttatattgcatatcttaatccattcttattctagcacggtactagtaaaacatttcatgactaactacatcctcataggtttgtatagaagattgatattttttaggttaattggatacatgccattataaatttgatgtgttttgagatatgccattataatttgtgtatttggatccgcgccattacaatttgcatgtaagttgaaacctgccactagtctacatattttagccgtattggacataattgcccccgtcttcctcctccatctctcgtttctgtgtaacaccagccgaagccttcttccccacctccggcggagtgctgcctcgcagtgacgtagtccccggcgacacgaccatacgacccctccgcgcggtgagacgatgaccaggaatccggcggcggagaggtattgcgcggctgcccgccgccgggagacggcgccggggaagaacttttgaagttgacgaggccggccacgatggagctccgccaccggtcgtgcgcagctacgcccgagcctccctgtcacagatccaccgacgccgtctagccggagcagtggtgcatcctggcccgagctccgccgcaagtggcttcgcccagatccagataaagcgagagagggggcgccgaatccaccgagagctggccggagcctcgtccgctccgagctccgccgaatcttgagctggcgtccgctcgtccacctcgtatcgccggcttcgtctgctcatcctcgtgtcgccagcgtcctgccgtcttccattcgtcctcgcgccactggcggggccatggccgtggcgacgtggtggtggacgaccactgccgccgtctactgcaacgccaccatcgcctcctcctacctgcccgttgtctgccgcgccttggcgacgccgacgagactagcccccgatgctggtgagaggcaccacgccaagctccaccggcagcatatatctaattaacccacaaaaggattaattagagagtgagtgagaaagagctcctgctgctcctgctataccgaggcaactgagagtctgagactgagaggagagaggttgaagatgagggtatttccgtcacatatatgtaaaatatgtatgtcaatggcaccattacaatttcagacaaataccaatagcatagttctaaataaatgaatagtagtggtaaatttcaaaattaaaaaatttgtaatgttatatatctaattaaccatatttggtaatctttgaatgcgaactaagggtagagccaccatttctttatccattatatctatgacattaatctctatatatcccgtgcctcatgggatcatgcttgtgttggtactttagatccattgagtctacttctcttcctcaatgatataacagggcatatgcgagcttttgacaaaggtagtaaaatgacatgtcccgctcaaatgttaagcccttgaatatcttggtcattgaagtggggtagggtgctttaagtttcttgataattagcccgatgattggttatctgacaatgattatgacaatactatgtttaataaaacaaccaacaaacaagataaatgatcaatgaaaattttcaaatacggcaatctgaaacaagtcatatatagaaggaaaaatgatgagggtgcctaaagcaacaagtgaatttgacaagataaatgagtatacatagaaaatttgagataaatataggctgtgttcggcaccccttttccccaaccactctcccttgttttccacgcgcacacttttcaaactgctaaacggtgtgtttttgcaaaaagtttctatacgatagttatttaaaacatcaaattaatctatttttgaaaaaaaatagctaatacttaactaatcacgcgctaatgaaacgctccgtttttcgtgtgtaccgttccgattgggaaaaaggatgccgaacacagccatagttggcgaggcatccacaaaaaaaatattgggctttcatgttttggtgaaaagtgctcattttgatcgtcatatcctaccttagtataaagttggtatctgttaactcataaagctcaatatgtaagtgtgtcagatcatcacccatatctattttttctataaagttaagacccaaagctgaaacctcagtattccacgtcatcgctaattcttagccgttcgatcggtggatgagatcgcatatgaaccgttggataagaaggtccccggacgagatgttgagcagtgtgtttatgcatgcgttaatttagaatgcatgtaacgcaagcatgtatgggtgagatgttgagcagtgtgtttatgatcagaggccatgggccatggttagtgccatttattctccttctaaatctctattaattcttctagattttttaataatcacatacatgtaactgaacagaaccaacgccatttgagaggttattggttcgatatggaaatgaaaattggtcacatattggtttaatctaaatgcatatatatgcagtagacccacccgattccttttgagcaaatgcaatttcaatttactaggcatttccatcagttatccatacacaaagattagtcttagaatactacaactgaaagtatctcatgtatttccgcagcaatatcaaaccacctttattttacttttcaacgatcaaatcctatatgatataaattgttataaaccccaccatcttaattatttgtagcttttttcaatagttgattaaaactgaaaattatacaagtgtagctattatttcttctaacatcatacaaaaactcccgcaacaacgcacggggtttcatctagtcttactataaagttaatgcccactaactactaaagctcaatatgcaagtgtaccacagcatcaccaactagcaattattatctaaaatgttttagatcacatgcatctgtgccatatcatcacccactagcaattattatctagagtattttaaatatcattcaaacatgacatatcatttacaattttattgtatttttagaactcaatatgtaagcaatgtcatatcattatctccacattattttcatattatttagatatatgcacctaccattttctataatgtataacatgcattcatctacatatctcacggtaagataggataagcaaagttattgctttcttatgtcctccttattttgactttcaacattgcaagcaatttgtagtaaatgagaaagataactataacttcgacgagcaaacttgtttcatctatgcactggtaccaacactctttgcatgactttttgttaacaacgtatacgtcgtgctgttggccccgtctaccagttgatatgccaatttttgttgagaagtaattgttatgtacaagtcatttaaagccgttgcatgtcaaccaatatatagccatcttaacatacaagcgcagtaatcctatgtgaaaaacataacgaaccactacatttcaatcgaatagggtatatttggtgacaatcaatagcacataattcattttttaatacgttgatgaaaaaagaatagagggagtatatgatattattgagctaaactaagattagttcaaatactcatcttaaaattccttagaaattaatgtagaattgatatttcgtttgttccaaaatgctatcgcgcatggaaagcaagtcaaggcgagggaacacctgctcccattcttcggaaactcgaggttattcgcgcaaaatctcctcccgtcggtcgcccgaggtctgacctagggttccggcgactcccatggccggccgccaccgtaacccgccgcccccatccttccctcgcggcggcggcgggggcgtgggcaggggccaccacccgcctcctccctcgctccaccaccaccgcctcccgccgcctcatcacctcgacgacttccgggagccgccgctgctccccccgcaccaccgcctcgacgacttccgcgagccgcaccacctgccgcccccgcaccaccaccaccacctcgacgaattcggcgagccgccgcgccaccacgtgttcgcgggccacggcggcggcgccgggccccccccggcgccgcacgtcgtggcggcgctggaggagcggctcggcgcggagatcgaggaggcgcacgtgctgcttggccagaaccagcggctggccgcgacgcacgtggcgctcgtgcaggaggtctccgccgtgcggcacgagctcggccgcaccgctcgcggccttgccgctgcccaggaggaaggcgaactccgtcttcgcgaggtgcgatgcttttctgatgcgctgattttgtctctgttttttttcccactaaatccttatgagaaaaatcgatctatagcacagaatcctgatgcttatcccttgcatatatttggtctgtttagttcggcaaaactataaattcctcttgcaaatttagttccaactttgacttcctgactcaattgcgctaaaattttattgcggtgggtctgtttgaagtgattatgcaagcataataaccaatgtcgtctattttggaaccctccaaattttgctttgtgaaatattaggtgcatgataatgcgggtctgtttgaagcgattatgttagcataagaacttatgttgtctattttggaaccctctaaattttgcgttgggaaatactgcatgatagtcggagccagtggtatactgtatttgccttgcattgtgcctttgtttgcaaaggtgagggattcagtgagaagaaaattggaaagagggcagtgtaggtacggtagggttaagggctgggcttgcaagcagagccactacaatccatcgtattcttgttttggtagtcttgcaagcagaaccactacaatccatcatattcttgttttggtagtcttcatccaccttagtgttgtttccatccgtctccccctatgctgataatgcacggagctggaggtcagcacttagaagtgcaatgcccgtaactccataagatgtgtgaatatccacattcatgaatcctgggtatggattttattcacatacaaggtgaaccgtgaactgctcacttcatttgaagtcatcttattcttctccctcttgcaagattggtaagcaatggaaatgcggcagggagggagataatgacgagtgagaaactaagaatagaggggagatggcagcaagctagagtagacaaggcgcatgtttatgccttttcgatgccaagcacaataactttccccttcggatgccaagtttgcacaacatttgtccacaagggaaaaagttcattttaatatttgacaaatatgcaacctgtcatggctaagttctagattttcttagtgatacactgaaatttgcatatcataattaatgagtaaatttaaacagcacagagcgttctccctataaatccagaattttctctatgcatgtgtttagttggagggattttggtgggttgggagggggccaacccatttttgtaggtgtttggttgaaggactaggtggaatgggatgaaaccaaaaaggaatattccatcaatatttgggatgagacggtccgccagaaatggccggaccgcgcctatccacttcacccgcgcacatcacgtgacccgcacatacctccatccatacagtgaccttatccttcccagccagagtctattttttccctgtttttacccacccagcgagagcgatgcaacaggagcgagagtggcgatggtagcgtgcgcgccgtcagcgacggccgccactccttcctcctccctcctccatggtggctgccgcgtgcacgcaagtcagcaacggccatggctccttcctccctccatcatgcgtgcgggcgagctgccggcggccacgtgcacaagagtcagtgacggctgcggctccttcatcctcccttctcgcatcctcttgctcgttgctgctgcttgtcctcgcatcctctctcgtcaactgctacgagctgaattctggagctgaggagcagagctagcttggctgtgatgcttgattcgtgattttcgatttctgatagtggatagacatcaccaaagagaaagacatctacgtatatgcaaattaatagctctagcagctctaccagtatagtcaacatgatatatagttgtgaaaatatgtgacggtggattgacatcacaaaagagggcatttttgttagaaaaaaaaaaagctcggtgtgagaggtaacctcactaactcaatgtgaggaggtatctctatccaactatcccaactccatccctccatccctccatccaaacaggtgataggaccattccatccctttttatccctcaaaccaaacaaaaaaatagggttcattcccatccctcaaaccaaacagaaaataaatgacagggatggacccaacccatctcacctcgccctcaaaccaaacacatgctatgcgaaaactctgtttattggagctgtgtaagtattttcacactgcttgatatgatgtttgaaacttctggtcgtacaatggcatatgtaattctttccccccaaaaaaaatcttaactgatctgttcttaatatcttatttccttctattttccccaattatttccacatatcatcttaatccactgcctttaaatacatcatacttaaatgcatattttgtgttgagtataggttcaaagctgcatatctgagtgagaaaggttcattgaaattttcagttgaagagaaactgcattgtttggtaatattttcaaatgtggtcatgtcaagcttatgtctctttgacccaaagctatctgacttagtgagctagtaggttagttctgcccatgccaagtaaaattgacttgtgcctttttggattgtaacatcagaaataattttaataggtctatgagaggtcaatgaagatggaggcagagctgcgagcagtagaggaaatgagggcagagcttgcacaggttcgcctcgacattcagaagttgggtgcagcaaggcaggaactcatgggtcaggtccaggggttcacccaggacttggctcgatcagcagtggacctgcagcaggtggctgcgttaaaagctgagatccaggagataaggcatgaaacacaacatttgaggtagagccttgttaatttcatatgcactttcagtgttctgaaagagagcgatgtgtatttttagtctttttgcaaaaatataatctgtatatgcaaaattgttggtgttatctatttcccactgaatcatcttagctatctcctttgcacttgtgagaaaacaatccatcgctgttttgttttgccattctcttggttctatgaactcttttggtttgtctggtcaagttacgatctattataattaaaatttgaaatggaatgagctcttactttttttttgtccaaaatgaattccagttacccctggagtagtagagagagtgaaattccaagaataaccttatgtttttcaaccttatatggttgtattatttgacctgcagatctggcattgaggttgagaagaaaggatatgccgagagctatgagcagggacaagagatgcagaagaaattgatatcagtggcttctgaagtggagaagcttcgagctgaggccgagaagaggtcacgagctgctgtgtctggaggcaatcaaggtacttaacaaactctggatgcttatttttctctagtactctttttagtggttcgggaccatctgtgttatgtagggatacttaatgttttgaaatcagatcatgtcaaccaaagggcataatttgtaaggttgaccatgtagtttaaatctctttccgtgttgcacatctggaatataacttcatcatgacatggtgctcccatcctgcagtgtacgtcggaggctatgggaatcctaaggccgcatatgccgcaaatccttataatgctggatacaacataaatcaagtatgtctcttattctttgtttccgcaatacctatttgcatattctttcatcctcatttcttgctacttttgaagccacatccccaggcaaacactgctgattccggctcccagtttgggcctggctcaacgcacgctccctggggtgcctatgacatgcagagagctactggacggagatgatttttttttcaggtgtgttcagcaaattacaaaagcatacttttctgggacaaacctaacagctttcatgcaatggtgaatcatgaatgtattacttactagtatactctactgtgagttgtgctgtacatgtattacctccgtttcaaaatgttgcaacctaggacgtgatttatcctaatacaacaaatctagacaaaagttctatccagatttgttgttctacgatgggtcaaatctgtcaaatcccatgatgctgatggagactgcagatttgcgtcgatgtgcattttccacgctagaggcatccatttctggcgcagcaatctctttcgatcgatctatggacgagtgcgggcgagattcgttgagaaacataatggatgatttgtgatgtcggaattcctgtacaggaacagtcacgctgcaggaattggaggaattgtgaagattgtgcaaacaataaggtttcacaggaggaaaaaaagagttaaacttgtgaattatcccattaaacaacgcggtgttttattcttcatcattgtgaccatacgtcaaattcgacaactaatcttgtgggccaaataagcattttgaattctgagcagacaatgacgctacttatgcattcaacaggaaagcacacaaagacgttatggaacagaatcatcaatcaataaacatcattagagaaagcacacaaatacgttacggaagggaatcatcaatcaataagcacatcattagcgaaagaatttggtacataaataactttacattcgaaaggcatcatcatgaatggccaaagcttttagtctactgtctaatctgctgccaggaaaacatgtatactgatcacaagttactaaaacatgtacaaggtagaacaaagaacataccagtcatacggcctaaacaactccaaaaggaccaaaaatcatggcagtcccaaaccaaattacagattttagcagcgcaaatctagattttcaactagcatttggcggtttatgcttgcgggaagactttgtttggcgggatattttcacgcctctccacgtaggcagccgggaaccatcctgccacccccttgcattctccttcggcccaaccattcggagcaatctagagcagatacaaatgaaaaggcaattagatggtaaatttggattgaggtcttaatgcactagacaattcagcaccattgtttgttggaccaatcgattcaaccctacccaactttgtacatcatctggttattccctcgttgattgacaagctaatttattcctgaaagaaggacaatcactagctactacatgatcaggacaagcctccagagactaattggttccattgccagaggaagtaaggcactaattggtcatctagtctagagactattgaaaatcacttaagattctttctgcgggcaatgggggcagtgattaaactgattatcacactacttcgcagatgaaatgattattaggacactgacctgacgaacaacgacataatcaccaacaattaaactcaactccttttctgtggtaccattgaagttatgcaccgcctgcagcaacaagaaggttcaatgcacatgacatgtaaaatatggtataattgcttggtaatgtcagttactcatgttaacctcagcaaggaagtactgggccttctcagcacgcttatgggaatgaatagtaggcggtgcagattctctcttttgcttttcagaggacatctagaaataagaattatgcaaaattcagaaatgcaagagattttgacagtttacatgataagcagagtgaaaattctacctcagcttcaacatcatcaagtatagcagctaacctcaaatgaaataacttttctgcttctaccttcaacaggataagtgacaaaggataagaatcaaatgaaacaactcaatggtgatagatgaattatatgctagaggcaggcaacattaccatgccaaccaggcgctgaagagttatcctttgctgctgagattcaacagcggcaagtgcagcagcagcttcctttcctaacacagccatgcttgctttgtgctctatcattttagattcagactgttgaagcttcgtagtgtgctcagcaagtggagcttctcgtacccgttgcttccttctagcaatttcagcagactgtatgacaaacaagagggttaagatacataatggggaaaagtattctatgaagcatagaagtagcaatagtaagattgcttgcttgcaatatggaacaagttgctaatacatacaaggatctcagcttcatgtctcatccggctataacgttgtgcaagaccacgagcatcttccaggggagcgcctgcagccatagccctcaatggatctatagtctgaaattcaaaataaatggaagtatatttgtaaaatacattgaaggaccaatgcaatactacagatcttaaatttctagagatctttaattgaaggctaagccccagtatgcactgaaaaagaatgacaaaaactgcatcttcaaaataatggtgaattggtgatcgcttgcatgacaactatataaatcacgtgcaccaaaaggtaaagggaaaatgttgtatggtgttttatttccaggcttagatcaatagacctagaaaattgtgtctaagagagaagatagggcaaaaattgggaccaggcggtgagacatcattactgcttggttttaatgcaccgacaagtttccaattattgaataggatgaaccagcataaaaattcggattccacaatcatcagcctaaaggacttccagcatattcaatatgctggactgtaaatgagatctctagtggtcccttccatcagtacacttttaggatatactccaatgtaaagatatgaactggatgagatccatcagtatatacatatctaggcttgagtatgcatgtgcacttctcagcacataaacatttcattgcaaattccagtacattctctctactccagcctaagtgattgagtgctaggctgactgcattatgttggtgatataacaaaaaaaggacagttatttcttgctatggcccaaaaagtcgctaggcgccagatggttggaagagcaagtgcctagtgactaggggcaccaatatgcagtctaggcagctcctagaaccaagttgactagcggcttccaaccaattagcaagcatatgacatacaagaaagatactagaacatcaatataaaaatactagagccctcaaggctgggcagcagcataatgcaccatcaaatgccaaattgaggcagctaccctgtgcctagcaccgacttttagaacactggtagtagcaaggctctttttgtagactagtagctcctcgtacagctaccagagagatacacctatctattgaggcatacaagaataacaaaagaagggttcaaaataccatatatatgtacatactaagaaaaaccaccgattgacaacataaatgcagggtacagagaaataaacattactgtgcacaagccagcaaaatttgtctgtgtgagaacagtactaattaacatccaaaaaagttacctgagaagataaaattctattaaattcttcgtactctttctcaacatttcttagagcacctccatacagagatgctgcttttgcaagggcttcatcactagcactactttcacctccatatctataacaatcctctgaaaattttgttcctgtgaccaaaagaaagaaaaatgtataccggtatcactcgtaagatgttgaatttggggggattcgagcagatcatgcaatgctattctttttgaaaaaggattccttgcatacatttttaaccattgccttgtcttcacaaaaaaggtctcaggctcaagaaattcaaatttttatttgatagtcatattcttttgtcacatattcatcctctgattttgcaagttgagagaacatttctcaattcccaaaagccccttcacaacatttactggcagcccaatcaaaaagtggtaataaatattatcaagttagcaggatccgataatcgatagcgaagtttccattctagtacatttagctaaagatagcaccattcatgatgagcacgtcctactcctattatgatgtcatcacatggtttttgtgggtattgtcattcctcgttttcccattggtgttctggccacgtgaaacatgataaatcatgctctcagacaaagaaggtgaagtttagaagtttggatcaggtgattttacagccagctcatccctcaaattaaacacctcatattctggaaggtagagaggttctatcatctgatcctcattaatattcccaccattcaagcataaaaatgatggaaaagcatgcaaatccaaacatgacataataagctaacagaggatggaaggcatgaaccacatacccacttcaacatgcctgattccaatagaaaccaaaccttcagccgctcgaacaatgtccttttggaaatcctgttagcatatatgcacgcattgagtttaataactgaaaatggaattcttgggaagtatttcacgtaatcatgcaaatattctcttctgtattaatgtcttaaaaacattgtgtaatgaactgaataaatcagacatgtcaaatgaaatacaccagcaatatatcaataacataaatgcaagattaatttgctgccagctgatcatattacataggtatgtattttatgctatctgcaattctccttccttacccttccagaacgagtagaagtgtacaatttctcaagctgttgatgtctctgtaattcaacttcatcaattacaacagcgtctgaatgttcatagcccgtagtactgaactgctttatcacagcctgaaatgtaaacatgtaagcaaagaagacttgaccatgaatatagcacatgaagcactagcagacacttccaagaagaaaatatttagtcatttacagagagcggcatggttttataagtgacaactaagccaaattaaagcttcccatggatataattgcactatgacaattgtatcaaattgtcaattgggcgaccgagcctaataaaggaaggttaacgtacgtgatgtcttccatttgtaagaattgcgaacatacccgaccgacagactgagtaacttggataaaaactaaaattacacataatgttaatgtttacaagcatatgttgcccctcattacaaaattactcctgtattaagagtaaattccacaaaactacatatactttgaccaaaacatcgcaaaaatacagatttaacaccaaatttttcacataactacagattttagagtttaaacccttaacactaatgttatcttcaagctataaaatgttgtagttttgtgattatactggtgctaaacttgtagttttgtgacaatgttgctattaaatctgtagtttgtgatactttatcttaatggttacactctggtggaaaatatatttaatctaaaatcagtaacaatctaacagctggcaaacagaaggggaaactatatctaaaaaggataaaaaatagctcttagtttcacatttcaaccaccacccagagaacagatcaggcgatacaagaatagtaattcacagcttaaatctgatatcccagggacaaaaaattcctgcaacagcgagccatctcgtcgccatttctatttggttttctcatggcgcagaaccctccgactaagtccaaaacggaaacggagaaatcgcacccgctacaaaattaaccattccttccccctaacaaacactgagactgaagggccccagatctgggatccgaacctgctgctgcttggcgacctgctccttgaacttgctcgcctgcttcctcagcacatccatccctctccctccccttccctcactgaagcggacgtcgtgctgcgaccgagacgaggaagaagcgaagcgggggttgggggaagagcgcgaaggtagtagggctaaccctaatcctcgctagttagaaacggaggaggaggaggaactggaagcgcgagggggcggcgaggaaggaagaggttggccgtgtggcggccggcgacgcggcgggcgctcggcgaacggaggaggcggggcggcggagcgagagcagagacagacagaaagcgagcgcgagagccgagagagggagcgaccccgatgcgagagagaggagcagttgggccggagtcagcccggatgggtggatgggatggccaccaaccaaacaatttttcttttttctttttggtagaactagaaagaaaacaaattttaatactccctccattccaggttttaacacgttttgattttagtgaaagtcaaactactctaagtttaactaattttatagaaaaagtagtactcatatttttaacccaagactaatatattatgaaaatttattcaattatagatttaatgaaactatgatggtattataaatattactatttttttcctcaaacttagagtagtttgactttgaataaagttaaaacgtcttataacctgaaacggagggagtagtactaaaccatttacagatatactagtagtacaaagttattgaaaataaagaaaatatttacaaaatttatttgaaaaggtgctactagtactttaattttgaagtaaattgcatcagcggtacacgagcttgttaggtgagtgtaatctagtgtatgaacttataaaatactcgttttggtacataaagttatcttgcacgtgcaaactaaggtcaaaaggacattacataactaattttgttgatttatgtgctaattaggatactacgtaaacatatactccctccatttcgcaatgcaagtcattctagcattttccacattcatattgatgttaatgaatttaaacagatataaatgctagaatgacttacactgtgaaatggatgaagtgtatgagaaggttgctacttagacatacacatgttcaataaaaagatagaatgagatatagtgatgtagagaaagatataaaaaaaccgagcaatgatacaaggattagaaacaaacgaaattcaaaataaagtagagaacaaatttataaatatttatactcactatatgtatccacgccacatcttaatcaacatcagctatgtaaaattaaccttgccaagctattttagacctagttcgcacggatcagataagtttgtgtatcaaaacgagcattttgcaagttcatgtactaaattgcacctacctaataagtttgtgtaccaccaatacaatttactcttaattttttttatcccaatgtgaaatttaaatttttaaaaataatttttttatcgcagtttgaaatttaaatttttagaatacacttctctaggctttcgaaaactgcaactattttatttttaaaatccggatttttcaaccacacgataaaacgtgtgttatcttatatatatttattaatatgtatattttatcttaaagcatatgtaaatgagtaaatctaactctcacattgtaggatcgaacgtaaaatatcaaggcagccttggtagaaacaccaaaaactaaattcttttttccaaaattaaaaaaaccctcaaacttgatggagatgtgttggtcaaacagatcaaagccggtcaaaccgcaatgaagtcgtcacgaaaatgctcacccccggacgaccaacggggtggagaaaaatcggacactgtctgccactgcagcatgccagtatgcaaagaatcttttcttttcttatttcttcaaaagatttttttatcgtaaactatttatctaatctacgatctaattgcaccactaaattcgttacaattaaatctttataacaagaccacacatgattatatttcgacaaaaaaatattttaatttttttattgatttttttaatgttgcatgtggtctcttttgatgtttcaactaatagttttataatgtttcagctaatgtactcatgatgtttcactgtgtatggatcaaatgttgcagtggaacgcgccgttgcaataaatcacccacatattttggaaaccctatattaagggaatgtggtttattttttgttccacaaaaaatgtttcacctagtgcactaacaatgttccactatttatagatctaatgttgcagtgaactgaaatatttcattgcaataaaaaacccacatattttggaaattaagggaattcatttcattttttgtttcaccaaaaaatgttccacttagtgtacttataatgtttcactgtgtatagatctaatattgcagtgaactaaaacatttttccgctatttgctgaaacattgtttttatataaggtgaaacaacaccagatttaaacgagtgaaacattttcgatctacttagtgaaacaattccgatatacctggtggaacatcgtgcaacatttaaaaataattcaataataagcactaggcggtttcctattgctcgatccagtgacggtagtgcggaggaggagggaggaaggggtggtagaggctacgttttgggtcgccacctaaatctcttgcgcggggtgcacaaggttctagagatcctataatccaccactcaacctaatttacaaatttcaactcaaaagtgaagttttaatatgctcaactttttttttgctctttgcaaacctttatgtgttctcttaagaaacactttcaaattgctttgatatatttccgaacgaaactcaaacaaaattaaaactcgcactactagaaaaataatttatcacaaaaaaaatcgtagcatcaatgctaaaattgtggcaatagatacatgttgccacaatcttaaaatcgttactagccgtggtaataaatagcgtggtaataagttattgcaacgatttttatttagttgtaataaattttgatattgccataaaatggatgtggcaaaaaatatatattgcaacacttcacatcgttgcaataaataactatagccaccactccatgtgtggcattagttctacgtaccaaattaaatgtttcaatattaatttatcattctacctattttcttttgatatcttgtcatggctaggatttaaacccaagatctctctccctcacgcgcgctctccatgaccaactcacctacgcatcaattttgtttaaaaatgcatataattctatttgagacttcctaactgagatttgaatcatgaatttaagtatttaaaagatttcgaatgaaaaatttaagttgtagatctcatcgagagctataaatttcatataaaattcgtcctaatctgtatccatatgaaaagaataagttaaattatgatatgctaatttttttattgcaacgaatttgttgatcatggcaatagaaaatagtgaaaagtaccctgtactatgtaaattgccacaaaaattaaatttgtggcaatagaacatgttttttttgcaatagtaatgttttttgtggtgatagctcatttcctattacaacaaaaatactgaataaaacatgatcgtaaatcgttgcaataaagtatagttatttgccatagaaaaattatcattgtgatagtacaatatattgccacgaattattcggatcatgatttggataagtatcttaagagaaaaaccagtttaaaaatagttttgcacataaatcgggcgctgacgtcagcgtctgatttttccctaaagcatcggacgtccgacgcgtagccctctccaagtcgtcagtctcttcgccagcttgctgttgttgtcactgccttcggtctgcctgctcctatggtgtacgctagaccgttgggatgtaaagaaaaccacatttattgcatcaaattgtgtttgcaaagtgcatctaaagcacttctctctcaactcatgaattagaattgaaaccccgatatgaccggagaggtatcgatcttcgctagactaaggtgccttttctacgttgaaattgtcttcattagatgaaggggacctcaatattcgatggtgctgttatgattgaaagattcttctctaggtctttgatgatcaaacatgtctttaatggtcaggggttgggaacacatctccaacatccggcaaccaaattttctctaccagaaagtcgatgtattctagtcttaaaccctcatctatttataccacaatgtggcttcctctaaccatgaatccaactagaactattctagtcttaaaccctcatctatttataccacaatgtggcttcctctaaccatgaatccaactagaactagtacttctaatcaccagcaaacctactaaaccagggaagcagtatccccatacaactccacactccaatcttttcaaacttggactccaatccaaatttaattactctctccatacacacataacactatatgtatgccatatgaaaaacttcacctccacactcattgttctctagcttgagcatctagcgtgatattctcgatcgtctagacctcaacttctaccaagtgtagccttaatccatcaccgggtatactctcatagtctcaagcaacacctacacatggaaaaaaacttcatatgtgagtacaatctcgcaccaacttgacttacatcagcacacaataatatcacatatgaatataaaccatctataagtcacaaacatgaagaaaatctataaatttcacgaaatcaacccaaaatcgactccaaccttatctgactgtcggcaacacggtcagaccatccaatcaccactgacctgatcggcctcctagagctgattgaactattcaccgtccgaaaactcgacacaccatattttccaaaacactcaccttttgataatttgttcagcacatagattaaatcaacgccttaatttcacacgcatgacacataaaagtcagtacttcttatttttcttttatctattctctcgatatatgtctattttgccgtaatttatctactattaaaactgctcttgtagtaaaaatagagctgcgcggttggaaacttcagttatggtaaatcgaagacggcaactgtttagatttctaccacgaaacatgtcatacgcttggcaaaaatgtatagcaattgtttcgtaatctatctatctatcttctatctatctatcttctatctatctatctatcttctatctatctatctatcttctatctatctatctatcttctattatatactaaaggtccattaaacttcctataaacgctctcaagccgccacgtggcacttctacaaacgctcctaggccgccacgtgacaatgtctaatctcaccgtcgattttcacttaaatcggtggacccaattatttggaccattagattagattagatgtatttgatttaaaaagaaactaataccttactattcaccggaaaaagaaaacaaattaaactgattttagtcctcccccgtaccccacgcggacatatgcatccatccctgtatatacgtatgtacaggtaacgtactaacgtacatacgtaagaatagaaaacgatgaatcttaccttacattagatgtattttatttaaaaagaaactcataccttacttcaccggaaaaagaaaacaaagacacttacttcaccggaaaaacaaaacaaaaacacgagtactccatatgtacgtacatacgtaagaattaaaaaacaatgaatatattacctattgtttatttaaagaaaaaaactatgcacggacttactgtaaaaaaaacaaagaaaaaacatacgtgtgtagtaccataaaaaatcgattatatttaaaatagagttttctaatatttaaagaaaatctattactatataaatttaagcaaatatcaccgccgatttttaattaaattggtgaaccaaatagtttaaacaattagatatattttattttaaaaactaataacttattactctgtgtacgtatacgggagaactatataacaattaggctagaaaaagaaaaaaaacgtaagtaatccctacgtacatacgacttggaaaaataaataaaacttaaccgctatccatcgaaagttcggaacaaagaaaaatctactcacggtggtctttttaaatagtattttcgaaatcctttactataaaaacaaaaaaacaaaaaaaagcgtatcattcgaaaaagatcgatggtcttttgaaatagtattatctactatttaaagataaatatattactctacaaatttacgtaaatatacgtagttaaactaaatctatattataaatatgaaatgttcgatcttaacatacaaggctgatatatatatatatatataattaatgttttgataatttcttatttcacatcatattttagggtgtcaaatatcactcgacaaatatacaatactaatttaaatttacatttgtgaaaatgaaaacaacacaatttagttgtttcattttacaccgttagattaattgtttctcctatatacatatatatgagaaatatataactgttgaccggaaaaagtactccgtacttatatatggttgaaaaaaataataatgcttatattgtttgccggaataacataaaacgtatttatgataaaggccaaaaaatgggcagtccttaaaaaaaatttctacaatttaaagataaaaatataataatcttcaaatttacacaaatgtaaatataaaatattcaatcaatgcttttaagtattctatcttttaaattattttaaaattatatatccaatttgtgatccggttgtattcctttaaataaataaactactaatatctatagccataaatacatcacaaatatggagccggcatgtaataattaatgttatgataataatttcacatcatattttaagtgtgaataacacttgacaaatatacaacactaacttaaatgtacatatgtattctccaaattactaaaggtgtctcatgtgattagaaacaatagatgtggaaaacaaaccagacaccgaacgaacatgcactacagtatacatatttgtcaaaatatgatacggtactttggagattatcgtggtaatatttagaaaatcactgtcttggttacgtataaattcttctattgttttgggataaaatttacctccttcgatttatgtgacaggggaatataagtaatataagtctatctttgatcagatgaagaagtatcattagttatatttttaatagaaaatatatttcattaatatataataaaattaaaatgttacctaaagtcatctatagcatacaaaacaaaaaatgttatataaagtttggaaactccaaattttttttaaaaaaatcacacacaatataaatagatatgaactaactctattattgggacatattttttctaataaatttgaggatatacaggttcaagtaatatgcccaacagttattaatgaacatacgtttaaagtagagtaaaacaatatttcaaaaatatcatccacacataaacattcataataataaaatttcaaataagattaaacaacatgctcgcgcgtatgcgcaggctaccttctttcgtttaatagccaaacttaagtataatcaccatactataacaacaaggggtgagattacctccacaaccctatacatatattgaaaatactaattcaataaatattatattaaattaagcaagtactgaaaaacacaacttaacatatacatatctggatatattagtagtgagaaaactaaagcatatacacaatttacttgtattactatatactacttcttaaaaaaaagtcgtcaccaccaccaccaccaccactgacatgttaaccataataatatcaatataactcgtgagtactacgttgctttatcctgcaatggtgtggagtactctctccatcccaaaatataagcaatttttggtagatatgatacttcttaggagtctgtccagattcatagtcctaggagtgtcatatcccctcaaaatcccttatattttagggttaattggatccatgccatcgtaaatatgccttattgaaaatatgccactactcttcacattattagctgggtgccattgaaaatttataaaattggaaccatgccactcctgtcactttttttgtcctcctatctcacgtcgccatcctccccgtcaagtcgccatcctcatcatcacctttccacaccaaagtcggagctcctatccccgccattggagtcggagctcccgtcgctggagcagagaggtgcagggccgcggggcgacgaccttaggcacgccggcgtcaacatcggtgaagggaggaggggagagacatcaactccaccgcgccgccggccatcgactgtcgatttccccttgtagccgccggccaaccgccggatccgcgtcaccagagaagagctcgaggttgtccaccaccagatccacgccgtcgtggtgggtggtgttgatggtggtggtgggcctggtggcggcggtggcagagtgtgggtgctggcagggcaagatggcagtgatcgcggcggagaacgagagcagacgccggtggatgagacgaggagagctctgtgtccacagcctccagcagcgtcatgcggctcggcctcctccctggcatggaagaaagaagcggaggggaggttgtcgctgcgcctgggcagcagctcctcatctctcccgtcaccgccaccgcgccccatgctccaacctgttgtcgcttgagcctgtcgatgctgaacgggcaagcggcgggacagatgaacgacagtgggacctcagcggctcggtggtggcttctctctcaccagatctggacagagatcctagcccgtcatcgtcgcgctcatcgacgagctcgagcagatgcgcggcccgctcactgccgccctcaccgaggagctatcctcctatcccgttccttcaccatccgccgtgccctcctcctccggctccctcttcgacagtccacgatcaccgcgtggagtcgtcgccgtccacgaccaccagctagccttcccggagcttgctggccagcttctggcgtaggcgtgctgcttgcagtggcatctacccgaagtagatgaaggcaccattgatagaaaatatgacggagacgacagaaatcatgatggagtggcattgttctaattttagaagatcgcagtggcatctatccgatttcatgaatagtagtgacatttttttcaatatggtatatttacgatgatatggatccaattaacccattttaggacggagggagtaggtgtgtattaatagtgtttaactgctcttgctgcaagatagtcctttatttttccattaatttgcttcttgccatcatgattaaaaaaactcacaaactatttagtttcttttagtttaaaatgagatagacaacataatttagtaacaagtacatactttataatcatataacatctgaaaaaaaaatctagcaatgccttttttttttgccttttaagatcaagtcttgtttttaccaagttgaagctaatatttttttttcaacgaggatgcacgagatatgttttctattttgaataatccgttacaacatataaatatttggctagtacattatacgataagaaagatacttaaattgtgttctttccttccctttcccaacttctaccactcgtttttcgcacatatgcttcccaaaccgatgattttttttacaaaatttttctatagaaaagttgttttaaaaatcatattaatctattttataagttttttaagctaatacttaattaatcatatgctaatgtaatcctccatgttacataccgaaggattagttactaacctaccataccgaacacaacgttaggctgagtttgttctgacggtcactcaacacatgactaattaagtatattaaaatttttaaaaataaatcaatataattttccaagtaatttttctataattattttcacaaataatatatcgtttagcagttaaaaacctgtgtgtgaaaaaaagaataattaaaagttgagagaggggagaaacgaacacaatgtgtgtttagttcgtgccaaaattagaagtttggttgaaactggaacgatgtgatagaaaagttgaaaatttgtgtatgtatgaaaattttgatgtgatgaaaaagttgaaagtttgaagaaaaattttagaaataaactcggccttacatttggggccataaaattgcatgtttatccatcctccacaactcttctctctctcaccgatctgattgtgctgtgcgcttgttcagctgtgctgctcggtttttgctcgctatgtgcacgaaaaaaaatcccaaaaattatattggtccattttatatcttcaaccagttgtaaacactaaacagctgtagtaataagtgggcttaaacctcaaaaatggctacacaagcccaagcgatccgcatcccaaaccattcgaaattcaaattattcccctcttccgctccatctccttcccgtctttctctctccacacagacagcgcacgcatccaccaccccccaacacgggagcggagagctcgccgccggcgatcgccgcaggattctgagggcttcttccggcggccacgggagatggttctgctcgaacgcacgccgttggtggtgcccgaggcagcagcagcagccgccgccgcctccagcccgctccggaggccgtcgcctagggttctgagggaggtgcccccgccccccctcgatcccatcctcccctacctcaggtaatggctagatcagtatccatatcagcacctgttcccttcgatttaggtcctatttgggggcgtgggattccgccgtagcgctgcgtggaataatgcttggtttcgcctcaagttgtgtggcgtacgcatcgtactgggattctgtcccttcctctgagttatgtagttaattgggcgtgtgatttagattttgacacttcgcctctgcgattcctgttcaattgctcagtggcagtgtgcagttgaacttggacgaacggaaatgtgagaaatgggggcgtgtgtgttccgaaaaaaaaaaaagaaaagcaaagggtatgaccaccactgtttgagtgtctggcaacgacagaagtgcattttgccgagacattgtgactggtcactcgtaatgtccagtgttgggacttgggaaggatttagttttggagctgatttgttttgtgcagctaggttgatttttcttgtgaaggattagcttgttcatgtggagacggttctcttattcctttatcagttcttgaactgtcaagtaatgtaatgtgcccactttctgtgctccttctgtactaatgtgctgctttctgataggtccttttggtaaaaactttgcatatataacttatttttatgttcctggtactattatatctattttataaggtaaatctaatctttcatgcacatgctggtattcatgcataatttatctatgtatcactgcggtttgtttgtcctggtcagggccccagtcctggtgtatgcattcgtttatgttagtttctgacttggtattcaggtctatcaacaaggctatggatgagctcaggacaggcccaaaatttgaagcagcagcgcttgatcggctcaagatttgtgtaatggaatgcattgataagtatggtgacgattaccagtactccacagacccccgactcctcaagatctggatcctctatgtaattgtttggctttgaagtttcaattcttaccttatccattttctatccttttgctcatttcccccccactttgttctatgttaggcggatgcaataggtgattttgataaggcatataagcagttggaggagaaaagaatgtttttagagcatgcactgctctatgatgcatatgcactgtttctcttcagtaaggggaaagtgctggaggctggtaaggtgtatgaagttggtatttccaggttagtatgacactgaattatgtttttgttgaagtgaactttttgggcagcaacaatctgatgtcaaatttgtcatgttgatgtgatcgcaaatcatttccgtggaccagaaaagccgagccacttgatcatttgaagaagatgcatacgatatttttaaaacacttggagaagattgtagaagaagcagatgccgatgcccaggtatgataactgtgtggtggaatggacattagttgagtccttgaatatttgtcaaatgattcacatatttcatattcaattgcatttttagtaatcaggacattgtggctgtgttgtagatttgttagtattttagctatggtcagttggtcacaaggctgacaaacttgcagcagtaagaactaagaactgctttgatattgtttcttacatgatatttctctgtggtggaacatttgtttttccaaaaaaggttggcaagcaataggataattgtcttcacatttctgtgcatgtgaactgtgatacattctacataatttattcatttatttgcatgtttgcatgttgtgaacttaatatttatttggggctaatcacaatgatatctactttgtacttgccgatctttactagctcgaacatctataacatctatttcaactaaatacatgacggtttattttacattttcatggaaagagtttctgttctgtcattcctgcaactctatttatacaaaaatagcatgattctagttatttagagtggctttttttattatatgtttagggatatattttatttagtttaatcatagttgggaatgaatttcaggttgtactttccactgattcttgtggtgtatgtgttctattatgagtttgtctcggaaatatattatttatgctatgtggtacattgatagaatcgggagtgcatttgcacagctttaccatagtgaagtcagaacataaatatagggcactatcagcataacagtgccataccaaacaatcttcttatacggttcaattcataaataaatagagaaaatcgagcaaattgcaaaagcaaagaataaaatgaaatatcgggctgaagccacatgatgtgccattgaaagctacatccctgcccctgcttgagtggactaatcattactagataaagaaacatgagacatgcaatttctatatgttttcgaagaacaatatctatataaccctgttaagcttgtgaagtaacttatgcaaaaacctttttttgtttcttttacttgtcattactggccattattgtagccagcatatattatagtcgcctaatgctattcttctttgtggatgattcaccatactaactccatttttttttgttactgtctgctagccgaaaccatcgaaaatacaaaagaaagaacctattttgctggatccatggtctgagtctactatgaataatttattggagaacattaatgttgatctgaagaagttcgctgtaagttgcatttactctatatgattcgctagtgtttatcttagctctcatcttggacggttgcccgaatccttgacagggctatcataagagcaataaggtctatcatggaaaggtgccattaacttcgcctcagaatgttttaagaaacaaagtcattgaattaggtataaactataatttcttgcttgtcagtcttttaccaaaactataatcatttttgtagtttggctcctttatgatccatgctctgtaagtcacaatgaatacataataatgctccttgaaaaaaaggaagaaatatacccttttttatttagaaaaaggccatttatattgatgacataacaaaagtttagttacaaatcccttttgttgcaccaaggtggtagaaagtaccagatcaaaggttctcctggtactggtgcttttgcaaaagtttacaaagccagtgtcgatggtaatacagaagacctggttgctttaaaggtgagtcatacttccatttgtcttactgaagcctgcttttttcatcagattcctctactgaacttgcccgtttgcagattcagaaaccaccatttccttgggaattttacatgtatcgccagcttgatacgcgcgtatctgatattgaggtacagaaattatctttaagaagaccataacatttgtaattgtaaaattatgattcacactgcaaaataattttacttccagagaccaagctttggctacactcatgaagtgcatgtatacgctgatgtcagtgtgcttgtttgtgattacctgccatacggaactcttctggtaaaatactttatgtattaatttttttttttgagatcatgatcatgcaaaactagcattttgtgcccggattagtgaatctgtgtttgataagatgcaaatcttttgcaggatgttataaattctcatctagtacttgaacgccatatggatgaagttctatgcatatattacactatagagatgctgcgcatgttggaaacactgcacagcgttggcataattcatggtgatttcaagcctgacaatatgcttgtttgctacccaaggtaagtagaggtaaccagcttagctttcaagttagaacacttgatggagcttcctccctcttcctcttgtgatctctaactgaaatatgggcaaaacacacacacacacacacacacacactctctctctctctctcacacagacacacacaaaactatccagtgaccattgacatcttacttttcataaaatcgacagatttattctagttgcaatatttgtgtgccgtccatttgcccagtgcccatattctcttgctatttgttttggacagatcttgttaccatgtttgtgggtgatgatgtctgtgctgtaaatattttactccaagcttcacaaccatctacaacttttataaactagatgttatatttaaactgatctaataacatagttttcaatgaaaatatttgacatggatggtcataacaacaagcatgttggtaagtggtcaatttgttggccccagatgttgggtttggtgggggcaaagatccttgctgatttactactgtttcaattactttatatgagcggttactggaatcttgcttgatggctccatcctccatgtttccgctgagatgacgattttttttgtcatttttgttggccatttgctgctattggcttgtttcggccaaaactcaattataacccatctagtacatgttacgcctgaaaaaaaaagaaagagtaaacctaatgctagtgtctgttcctttttgttctcgctatccaagtcttcacctcttcaatctttagcccttgtctcgacatgtaattttcgttcacccgcatctttgttttgcgtgtggtggtctgtgcagtggagaaatcacagacgaaaccttcaaaggcgagacaagatccgagcggaatcaggtcagcttctcaatcccaagttcccaacacgccgagaaacttggttaagatgttctggatatctcctgatgcttataggattcccattccaggggctctgccttgttgactggggccgtggcatcgacctgaacctcttcccatccggtgcggagttctacggcgactgccgaacctccgggttcagctgcgtcgagatgcaggaacagagagcctggacgtttcaggtatctgtaccctcccaagctacttactcaaaacctcctctcacctagacatctctgaaagcaacccctgcctgacgctgccagtttgtttgttggttggttgattggtttcttcctgcaggctgacacttacggcctctgcgtcatcgcgcacatgatgctacatgggacgcagatgagcatccagaagacgcccaggcccgatggaagctacatgtaccagcccacatcgccgttcaaaaggtgctttgatgccattgcctatacacctctttgataatttcctctatcccaaaatatagctactatgagatatttttcagtactatgaatctgaacaggtttagaaaatatctcatcctatgctagttagttatattttaagataaaggtagtagtaattaccatgattcgcagtagcgtaaataaatcagagattagattagatggcatatgtaacaggagctgtttgctgccattttgccccttgacaggtactggaacgtggagctgtggaaaaacctcttctccacgctgctcaacgcgacctccaacggcagcgacgcggccgtgctccggagcctccggatgtccttccaggagtacctgtgcagcaaccggcagctcgtcggcaagctgaaccagcaactggccaagcagaagacctccctgtgcctatcctgaccgagacatatacgcatctcgcgtttcatcctcatcatttttcccgattccctcgtgttgcctgtgtgtaaagtggtggagtataagataccttccgtaacttcgtagcacttcctctgtgcgtgcgtgtgcagcagtaattaacgtgccacatctccactttgaaagctgaaacatctactattgggccagatggaaatttcgtacagtatcttcttctccaactagcggctactaggtaccatgcgtctgtcacgtctagaggagttttttctttctttcttttctttttttctttttttgccatggtggtcgagatcgagtgagatttgtgggcagtgggcgacgagcgagaccaaacggaaacggacgaagcaacgagcgtacggctcgtgaagtcaaagggcgcgatcagataagatgaggcggtgatggtgtgtagtaggccacaggggctgggcccaattccagccgtccccggcccaggctgacggtcgctgctggcagttctgtttcgtgtggtcgcggaggccgggccttcgtcggtcggggtatcgtggacgtgatcccgtcgtcggaggacgtaaggtggggagcgtcatgcgccgcaactagctattcttacgacgtgttctaaaccacactagtggaagtacaaattattcgtgtcacgtttttatatttacgatttccctaaaatcttctgggagtagctatatttatatttatggtgtcatatttttcatcaataaatagtcaacatgtatttacattgtaagtatctaaattacatatgtaatttcagtgtatatgtaacgtaagtcataaaattacatatgtaaatccgaaaattacatatgtaagttttaaaattacatatgtaattatagtgtaaatagtatgtaactatgatgtaaccaacgtgtcatcatccatacaggaaaaatccgatgctaataaaaaaaggcaaaggattaataacgataaaaaggaaagctgcatccctcaagcctttatccaccgtacatcaaaccatcaacggccagagatccgactgttttcagacaagaaaaacatgcgacacataactttttacctcggtattgcttaaaaatatactatttcctaattaagctatttgctagctttataatggttaacttgtcgatatgagcaatttccgtttggttataatctatctattcatgtcatccagttataacgctcaggttgggtgaatattgttgtgctggacggtttcttccaaaacaaaacgtactctgctaacaaaaagtggctatagaagaacgtagatggttcgcgtattgcaaccatgcatctactagtaacaagtacacaccattgtatttagtaacagatctctgtcctaagttaatttattccgggacactgattgtactacggaattacttgtaagtaccagctaccaggtgtagggtgtgttttcacgctaaaattgaaaatttgattgaaattgaaacgctgtgacgaaaaagttagaagtttatgtgtgtagaaaagtttcgatatattgaaaaaattaaaagtttaaagaaaaaaaatttgatactaaaccaagccgtagtacagatggctcggtttgacttgccggccggccaggccggttgaaggatcactggtatatatgcggcggtcgtgcacgggcgcgtgtggtgcggttcaaggagtggccgtcatcgtggctactactttccgtcaaaaaatcgtggctactactatagccgaagaatgataaggatgtttgctgtgtgtttgacgccccgttaatccaacaccgtttttgcatataattgcattgcacccatggaccatggtcgcgcgcttgtggcagtcgaaattttctgcgtctgtgactgacgatgagaggtactcctgtagctagctagaagcgtcggaaggggtgaaattaaagatcgatttctggtgttgtacgtacgtggtcgctagatctggttggtgcctcttgcttttctgggctcccctggaaaactgttactgctaattttagccccatttatcgatcggcccgagttccataccatgtctcagctcctgtagccgacctacctctgtcctagctctgacacgtcacagaaacgttaacatggtcagttagtcacgctgatacataggagtcgtagtacacagccgcgcgccgacccgaccgagccaaccaacctcccaccaacccgtccatcgcacggcgcggcccacgccaacgcaggcaagtcatcagtcaggcagccggccgcccgcgcgcgcccgcaccgtagcgtgcaccgaaggtgatccggttgtttccccgtgatcagctgtgcctgtgcacgctgcccctgctcgatctgcatgcgcgcgcgcgctgcagaggcagagcccgatcacatggccagcacggggcctgtagctctccacatgccgttgacgggatgacgggtcggcgcgcgcgatcgatcgatcgcggcgaaacgcatggtgatctctgatcaaaaacccgtacgcgcgatagggtttggtggtttgctgctgctgctggctgctgcggctgtgcaggggggcgcgaccacgcacgcaccggccacgcgcctgcggaccgatcgatcggtcgatcggcggcggtctcgcgcgcactcgagcgagcggcagagcgcgcggcaccgttggtttggttgggtgcgtgggtggttaacagcagctgggtggttgtgattggattggatggtccctgcagctggagctggggtttgtgcggggttgggtcgttggagttagctgggttcgctgctgttgtcgccacgcttgctggctactaggaggagtacgtactaggcgtggtcaccgtgggcgtattgtgcagcgagtagtagggttgtagggcatgcacgctctggacagtacgggtgtacgggtctgtaacacgcgcgcgcgtggtaataattaacagggaggaaccaaatagctatagatcgtaggggggaaatgagttacttgtcgtgataagagcgcaaaaaaaaaaaaacacgtacgactacgtacgccggtatgtaatttcaccttacgtatttttggctagatgatttggaccatcgaccaatcgatcgccgctaatatcaaacctcaagtataagagcacacgatcgattgaccacctccaattaatctccatgccaaagtagcaaaatatcacatcactcatcttcgaagattgtcctccttaaaaccaacaaatctaataagaaataatagaatgtgacatcctataatatctcagatctcatagtaggtatatttactttaggatgaaggtagtagccgtaaacggcgtgtgtccttgcgatgcttggttaataaaggaaaggaaattgataaagaattatgaatgatcaatggcactatttaattctcaggatcaaattaaccgaaattgtttattactctcaccgtcctaaaatatagcaacttttagcctttaaaatctatcccaaaattatatctacttctccaccgacattttttttcaaacaaatcacaaccttccaacattcaatttccctaccaaccttcacttctcatccaatcacaaccttcatcacatctaattctacctatttctcaatggttgtgtccaatctaaaaattcttatattctagatgaatagagtagcatattttagcgcggatcaactaggtggttgatcatctgtctgctagttagccaaaatggccgaaagtcatctgcgcgtacgtgggctgaccatggtttgcattaccatcggtaaccacacggttaccggccttaccgcagggtacggtaatagaaaaaccacaataactttcttaaatttaaataaatttaaaaataatttaaatttttgacaaattttacacggtttcgtacgatttttcacggttaccacagttatagcgtgttaactgtgcttaccgtctgataactgtgcttaccgtcgaggcgcagtaaccctggccggctagccccggcggtttaggaaaccatgtgaccgaccgggcgagtcgtgccggtgggatcgtcgactacacggccgcgcacgggcatgcagcgcacggcagcgcaggcaatttttgatcgatccctcccgcgcgcggttcgactgttggagatgagatgagtgcgtacgtacgtgcagtgcgcagtacgtacgtggtcgcgcgcgcgcgccatgtcaggctggtggtggttaacgcgcgcgcgcgggccggcatgcggcatgccccagtagcgatatagatctcgatgccgagaccgacctgcacagttgcctaggtttgcatgcagagtgcaggctgcacagtgctgtgcacatgcagctagctagctctagctacgggcgcgctcgctgatcagttggccgatcgaattagcgtttcgcgccgtcggccaacgattcagtttcgaaactcgcacttgtggagaaatcgtttttatacggttcgtaacccctatagtcccgatttgaaaatcgagactatgaatccgggactaaagatccatattttagtcccggttcaaatactcgggaataaagatgggagcgggcaatagttttttttttcatttacttactatttaatctctaatttattttctcccaaattaggtgggatgcatattccttaatcaaacccaaatacacaaatcaatcaatcatatacactacagattatacattccaaatcaaaccccaaatcaaagaaacatcccaaatacacaaatcatgtacatctcagatccatacaatgagattccaaaaaagaaattatacatctcaatccatacaatgaaccacagattcttcatctcaatctatacatggatcacaaattctttgaaaaaaaaagaaaaaaaacgaagcaaagccgtcggctggctgagccggctgctgcctcccctcctccccggccgccgccgcgccggcccccgcctcgcgtccctccgccggccgggccgcccaccccctcctgctgctcacacgggatcgagttgggaagggataagaaggaaaagagataaggaggaagggaaaggataaggattagagatggagggagagaggagttggtgtggatgagaaaagagtggatgagaaaagaggataagtaatatggattatatagtgcgttttgatctttaattccggtttgtaacaccaaccgggactaaagagatccgatctttacttcctgttcgtaactctaaccgggactaaagatcctggaggggcctgacaacacctgacagcatgtgaaccgggactaaagatcatgtagtctcgttctacttataaaccgggactaaaaaccatctttagtcccggtttttactgcatccgagactattgtggtttttagtcgaccggccaaagatggtttctttactagtgtcgatccaatatatccacgtgtacgtctcggtgggttattctttgcagtgttacgtactctctccgtcgaagttttagtgttgaacacggttattaagaaagcaggtagaagtgagtggtgaagggttgtcattggatgagtagtagaggtaggtgggaaaaatgaatggtggaggattgtgattggttgggaagagaatgttggtgaagttattatattttgggataaattctgaggaataaaatttgttatattttgggaccatagggatttttttttgaactgataactcgggaattaatcaatctgctagctagcatgcactatatgcttgtagcagcaacagactcgttctaattaaatacgtgaaaaataatcgaagtcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaaccgttcgtcttattcaaaaacttctgtgagatatgtaaaattatatgcctacataaaaatatatttaacaataaatcaaatgataggaaaataattaataattacttaaattttttgaataagacgaacggtcaaacatgtgataaaaagtcaacggcgtcaaacattttgaaacggagggagtattatgccaactttggagatgattgattattctctacggctagctagttccaattacttagtactccctccgtcccataaaaaaaccaacatagtattgaatgagatattttctagtacaacgaatttagacatgctcttgtccgtattcattatactagaagatgttatatctatagaattggttttttttaggatggcgagagtacagtagtacgcatgcaagggtggcaaatgtaagaagcagcagctagctagcaaggccgggttcaatttcaatcgatcgatcgaccgactgcatggaaatttcgagttggaatctgaatgtgatgatgggccgtgcgcagggtgcagtggggtgcatcgctcgcgcgcgtgccgacattcctttctcgagttccgagccaacggatcgatcgatcggggaatcagggaatcagatgcccctgcccccctagctaccttctctcctttagtttgttcttcccatcatactctccatggccatcaccatgatcgatccctctcctctctccacaagctaccttaatcagcttagcttagctatccctggaccaggaataatattagtttacgtgctactggtgaccaagtattggagcactactactactctagtatgtagctactactaattactctatcactctgttaatcgatgctgtcgtttcctccttttaaggccggccggccagccagccaaatccatccatctctaactctagttaatttaatctcgaaacatgaacatgagaataaggttttttatcactataaacactgacatggtcactgtgacacttgctatttgatgttaattactatgtataacagagaaaagttataagagacattaacaatctcttataagtataaaaactacaaaaatatatagtagaaaagttataatccattttctaaagttgcatgaattgaaatactaaaagagatattaacaatcaaaattcaaacatattgactgcacttatttagactagaggagtacataaaaaaaatatatgtatgcatcctaaacgtagagaccgaggatataattcatctttccttatataaaaaggtcagaaccgatgacactagctagctaaacaacatagtacaaatttggctagaggttttcctggtctcacttggatgtacatcatggtatggattcttagtacactagctcgtagtactatactactactattcttatatgtgataactccagcccatacagagaggaacatggatgcatgcttgctagctaggtatacatatggtcccagcaatcaaatattggaagtacgtatactagcttatcaacaagcactaagtaataataatactagtatagttgagaattttgacctgatacattcgcatgcttacccaaaaaaaattgtatatatccagctaacacgaccaatgcaagtcattattcacgagtcttaaatatatctccatgagtatgacttgtgagacgacaactaaaagacaaggccaagctttcttaatttgaaagctcacctaattaattaactaccaccgatcgatgtatccccagccttcttaattagtgcatcaaatgtggctatgtaggcgatgaagggtcgacaaataacgtaacacccaattaatgcaactttcacacacatgaatgtgtgtaggtatgcatgtgtgggctacttaactactccatttcaactctacgtatggtactccctccgtttcatattataaggctttctagcattaatatctagatttattaacaactatataaatgtggctaatgctagaaagtctaataatgtgaaacggaggaagtatatagtactagtagtacctactactatcacatatgaatacattgtgtataaaacatctcaattcatttagacacacatgcaagctaaaccctctagctgcttcaattccttcatcatcaataaagttcaggaataacacagcaatgatacaaagtgcaaagagacaagaacagaatgcttaaaccaaacacccacacagcccaatgcatgctgaagccggccggccatgtaaccctacccatgattgctagacaaggcatccttctccaagaagcaaagccacagacagcagtcaaaatcaaaaatcccagaggcctttaagaaaagtctggttaattaggtttactacctctctctatccatccatctctatctctcttgtctctcccaatagctggagttactagaagaatagatgatcatatatattctacttgcaacagtaaccacttcaactacgacaacaagatcactcttttcaaaaaaaaaacaagatcaagacacatgcatatgcttccctgaaatttcttaactgaatttgcccatcctgtttacagatctggtgcccactgatagatgatcatgtagctggcccattaatatttcatttcaattcaattctggtctatattattttctactctctatggcatctttgtttcatcatcaggtcatggagttggcaaattggcataccccatgtgatggatgcaaccatccaattatatatgcggcatatgcatagctagctagcttagggatgcgtgtgagattcttggcaggagccaatcctttgtttgggccatccatttttgcttgcaagatgaggatgacgcatcactcgcctataaataaattaagcccctgtcaagtagatttgcctgctgtcctctaattagtgtacttttaataataaacatagcattatgtattgttgtgcgattatattctctttccacaatattctaagttcttctaaagtttaaaacaaactaaattattgttaacacgacacctaacactgtcctggaatatgtctgcagtaaaccttgactgaccaccgactgaaatgacaatattcatatatttatgtcacaatttaattactaattaataaaaacagtgtgttacgaagaactttcatggccggccatgcatgtcccatgcccgtcctgtatatttctatgaaactgaagaccacctaattaaacaacacatacagactagataaatggatcagatcgatttcaacttgctcttttattcggatagaatcgtcagcattactgacatgttttccttttaaaaaaaaaggaattagatttcatggttatttattacatttatattaggttagatagattcaattaaacacatatagattgagaataagtgctgcagctagcatccatgcttggaattttacacatactctctctttctataaaagttacacctattacttttgtcactaagatcaaggagtgtatgcacgcatacaaccaataagtaataatatgacttctggggtctgatcaaatatttaatttacctctccatttaagtcttggatgcataaagactacaaatatgattaacttatttgaaaataaaataaaatataaaatatgtctaactcttgtggatggagggagtacaagctagtgcgcccagcattttctgctgaagaacatcaataaattctaagcatttattttacacaacatttcaaaaccagcagtctcaggtggatggccccaaactgattgtgatttccaataaacattccactagaaaaacaaaaggaacagacagacattcccctccgatcaaacaagaagaaaacaagcaacaagtgaccgacattcccctgggattccgtgccggtttaattccacaaataatatataacaaaactatacatatccgtgcatgcaatttgcacccaagaacagcctaaacaatgcaatccgcgtaatacaattcccacataaactattagcacgcgtaggtgcccctcatgtgattgtgcgtacatgttcttcgatctcttcctacctaatcttttgcagtattttggctgtcgattagtacccgttggtttgtttattgcttcacacagcgcatgcacactgccccagcactgatctaatccctgccatgacagggcaagagagataattaatcatttgcatcgatttggattggaacgttaggggtgagatatgatagagggagggattaaacaaatgtgcttagtttgatgatggaatgtttttgcaggatttgtgtgtgtatggtggttgcgaggaagatccacctgttcttcacctacattcgattcttttactctccatccgctctgcagctagcgttgtggccgccatggagaccgagatagagagagaaattaagtcccatgcattgtttactccgatgtgttaggccgggctgcactgacattccatgggtcccatagagacagccagctgctctatctcaccttctcccttcacaatctctccctcttttcaccctcttcgatcatgcgtttggtcaaactaatcggttgtatatatgcactcttgatataatgcagaggtcggatgcattatactctttcattgttaactaaaagaaatacgctattaagtgctgtcccttttacatgcctaaaaaaaactacatttgactcttataagggtgtatattggcttggtctaaactctagaattagagacgtattcgcctctgccaagtgtattgatgtggacagtttcatctccttttgggctatagtttcacaatttgtgtataatttttgtctcggtttagtggtcacatcgccaattgtgaaacacgatggatggtggaatgacaaagacagttggagcatgccatgtcgtttgttgctccacacagatgaggctgcattgtgtggtttgcaacagagaggaggttaaagaacacacatcgtcctttgagtttagagtgacatggaacacgtacaaattatgctttagccacctctacgaccatgcatgtcttttatgaagtgatcagtggcagagccagcgacaccgtcgagcccgggtgggtaattaatggtgtttctccatgatctaccaatttttttatacgtcgatcgtaatccgtagtgaagatggcagtgacggagcatgggcggtcgcccaacctgttcaggagatgtccccgccgctagaagcaattgaaacgaaccagagctttgagatatttaaataagaaattatcgaagaaaaaacatatgagagtagtcgcgtacacatgctgctcagtttcaacttttaacatgttttgtttcatcataaaagtatagccaaattcgcaattatttttaacatctgaatatctagcttagatgttatacatacagatctgtatgtataacatcatggtatactacgtacgctactgttttatcaagtcaatatatgtgagacgtgcccctttatttagcaggcgccttttaccttcagtaaacaacaagtgatcagccatcacaatgatttgcatggttgaatcaacattatattcatctctgtactctgcattattactgttttacagagtactaattccactagaggatgcatcagaattattgcatgctgcctgcacgcaggaggaggtgcggatgagaacaaacaatgcatgcattgcatgctcaataatcatccacattttatatatatgcgtcgacaaaaaccgcacacatctccatcctagtacaacgtaggctagcccatgcatgcatgcaagcagcatcctcacatgccaatcgatcgatcgatcgatcgagctgatgtctcttgtacaaaagagtggaccgatcgatcgatctagcttagatggagccaccgtgttttgtatttctgcgacagcaattcaatcagaaaaaaaaatttcatcagagcagatcaagaagcagcagctacgagacacacaccttaacgaaaaagccatatcacgcatcgccatcctctacgtactttgcatccatatattttcgtcagaaacaacatatatactactctagctagcttctctctctctaaccatagccttgttccatccatccatgcatgcattgtctgccctatctagctttgttagctagaggtggaccatgcaaattgcaagcaacaacaagcacaatgagagagagagagagagagagagagagagagagattccaaggagacaagcatggcagatgggggaaggaggagagggagaagaaggagaggagatagatgcaaaatgtggtcctcaaagtactagtgctggtccacattctggcagcagcactttgggggtggtggggtggggaggagttggtcctcactcctcactcagtagtagtgggtgcccagtgcatggatgcatggatggaggtctggaggaggaagaagctaagccaaaggccggtgcatgctgtaacagtagtacaaatatgttgaaaattcagtacaccacaccacagtgacagtaccaccactgattatcagctggatgctgctgctagctgctcctagctactacatggatgcccaattgcccatggaccagagagagagagagagagagcaagaggggtcctggaattaatctggttaaatcaggggagccatcatggctaatgaggctgattattatgatgacattgaccatgatgatggctttggggcaactaatccacatgcatgcatggccagccagccagggcatcatatcatggcgggctatagtacgtggacggccgtgcatatgggtcagaggccggactgtgttgggagagcatgcatgactaatttgctctgattagctagctaggtatagcagctctgacccctgcaagtctgacacctcaacctaatcaataattattcagtgatcaatatgagctcgatcgatcaagcagcgcggtgggggtgcactggtctaggatattgttgttcttgttcgaccgaacctccccctttttcttcgctcggagatgattgatgctgcgaaacacagacagaaatcttcgggcagttaacacggttgctttcgcgttaagaatgggattagttataagggtctatttaaaaatatggtgacaaatataattatagcataaatgtaatataattacagatgtgattagtgtaattacatatataatttaggaacttaaatatgtaattttcaaacttagacttacattgtaaatacagtaaaattacgtatgtaatttagagatttacaatgaaaatacattttttcatgaaaaatatggtgtcacatttatagcaaatccgtagttataattgattgagtgatactatggttcctgagaaggcatatttttgtaacgtaaaatttaataatatctcggtatacctcttaaatcacaatttttttaattgatttggtcatttttcattgtcgctagcttggacaaatgtactttaggccgggttaaattaaatattttccccagaggtctctgtagttcaattcactgttcttgtgctacagtgtactactatatatgcttcaattaattccgagtcatggggaaaaaggccaaaaaagaagaaaaatattacttgagcagaattgaatttactcggttattgattatttacacgcacacggatgcgtgcgcatgaatggtgacaaattttagtacgtaaaattataacagtatacaatcatgcagcgtgcatgcatgcaggcgtatgtatataccactgtagaaccctagctacatcgatgttgccaaatcattgctggcccatgcccgcttggcttggtcctagttgccctgtcactatatgctgagactgttgctgtcgacgactacgacgaatatgtactctctacatactccctccatactttaatttatgacgccgtagacattttaatcaatgtttaaccattcatcttattcaaaaaaaattatgtaattatcatctattttattgtcacttgatttatcatcaaatattctttaagtatggcatgaatatttttatatttgcacaaaaattttaaataaaacgaatagtcaaacgttgttcaaaaagtcaacagcgtcatacattaaaatacggaggaagtacgttacagagacatggatgcatatatgcatgacatgccttgtacgcattcatacacgtagtaatacgtacatggtgcagtacacgtatgcatgcatacactggcgacaggtaggagtgaacagtgccttgaacggcgatcgatcgagggactttcgatcgtacgtttggaaagaatccggccctgcagctttttaaattttatttaaaacttaattacattatttttaatgtggattttcacccgctcagaatatatgtataaaaattttatctataaattatttttttattgctaataaaccgtgttagcttatattagctctcggtaatcaatggaatgtaatgactggttcggcgtagagatgaaaaagtgatccacgccttgctagctcgaacctaccactacagaaacgatttttatctccgatcaaaattgactttgttaggcgggtggatgtcccgtctgcacctaggtgtatgtggaaattgatattttttatgcgggtagagcaaccgcatgcgatgtgggtgtttaagccgtccgaagataaaaagaaaagttagtaaaaaaattccaaaaaagtccgaaaccctagcaggtcccgcgtccagtggtcgtcaccaccattcttgtgcccgggcttcgtcctcgccgtcgccaaagcactccttgctgtcagagtcaagcgttgtatccatgcgcgtaggaagccgaggcggtgggatccgcgtgggagagggacagcccgccgggtccaccgttgccgagctcaccgccgaatccaccgtcgcgtcctccacaccactggatccaccgccgtcgtcccttccctccactgacctccccaccaccagatccagcgccgctgccctccccaccgtccgctagttccccgccactcccgctctcgcccaccgccgatggagagatgaggaggaaagaagaggtggagaggaagcagtggaggagatggaggaagtggagggtgaggatgaggagagagaggggtgacttgatattttaagggtgagctcgatctggtagactggtagcaggcgggcctattaacatgttactttcactattaacatgttactttcacaagtgaacttttaacaaacacacttgcaaaaattgtcttttgcatgcaatttttgaaccattctcaagggaacaatttttgtaggaggtagtagttatggcatatggatggttattgatttttttaagtagaaatattgatctatatgtgatatttcgtttttgcaagtttcagatctcatctaaaaaatcgcacgtactgccgagtagatcatcgaccggcgccggtcggcaagattattatacgatcgaataatgtttcgatcatgcgtgcatgtgatctgtgtacgagctactggctacgcatgcaataatctggtacgtaccaataagcaagtaagctagaggctggccgactgtgtgtggccagactggttagatttgtggctatgtggcctactgtagatgacgtacatgcatactacattacgtgtacaatactattaaacacatgggattgtctggttttttaggcacataaaaacactcacaaattgtagtcacgcctaaatcataccaatatttttggataaagaataattttatatcatgcaattctttctccccacaacgtgccatgttagtgtgaactcgcctcacacacctcaccccatagcgctgtcaccaagcttgccagggccggaagctctccagcggctcttccccacctcctaataacctctcctgatttgacgctctctgccgtcgaccctgcccatctcccccctctagccccatagacccaactacgtacactactgtcacctcgctacatgctcttgtttgccatccaccatgaatccaccgtctccctgcccatccctttaagcctatgggagttgaaccactctcttccaccagccaaaatccccacccccaaaaccttaagtctaatccgtgggtcctctatcatagttaggtgtcactcatgatgcggaagatgaaaagatcgtaaagaagtttgatgttgtcatcgttgttaagccatggctaccatctccctttatctcacctcttttcttgcctccccttattctagatgctgcaggtgactgaaatttctcataaatttgaccacctgaaacaagcaattcactaagtaaatttaccatttctacggacacgttttttaacatgttagagttcagtctcacattggtggtgaaagtacaatatatcttgtttaaaagttatcccctcaactcgtaagctagctattaaaaatgtgtaaggtattttaagtccttcaattagtatcagaatatggctagttcaatgcatttaacccaatgaacattattagtatgagtgcaagcggtgccctgatggtacaggtgcatataaaatacaatcgtttctatataaacaaggtttatgagatgtatatcaaatatagttctagtgcttgtggtgcctaacagtatatatagttatatataaaaggaaaaaaaagaattacccctaaactatcgaggtcaattgaattaacccactgaactcaaacaccagacattttacaccattagctatgcaaaccggataaataaccccctttttcaaaccggagtatagttttggtcctatgtggcaatccagttagcaattttatttttaaaatccatgggccccgcatgtcatactctccccttctctatctctttaatccccatcctctctctcttctcccttccctcacctccatctctctctctctctctccccaaactgagcagggaggactaggccgacgacgctgcttagcggccggtggcaggaggggctcgagcccgtgtgggcatagccgtggccagtgatagaggcagcaggcgacgcatgaaccggcgggtcagcggcgggcgacacttggcagtgtgataggtcgcgatggcgcgcggcttgggcgacaccgtaggtgttgcccctctctgcgtcaccttgttcccatcggaaaaatcggtgctagcggtggagaaattaaggatgtggttgcggcgttggcatggttgccgagcttacacctgaggatggtgccgccaccactagctgaagcgctccaccttgaagcaaatccggtctccgccctcatgccgagcccgcctccctcacgccaagcccgcctccttcacaccattcccatccatggagagagcagagagggaggggagagagggagagagcagagatgaaatgacaggtggaccctacaaatctattactattatttttctgactggattgccacgttgacaccacgtgtgtaagctcttggtcaaaaccgcccaaaacagtcctggagggtaattcgtacggtttagaaagtccagggttaaaaatatatggtatttgagttctaattcgatcatcctcgatagttagagggttattcgtagtttttctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactaacgaccccatcgtggaataagccaaacggtatttttacaaatgaaaagtaatggtaatttgtaaataaaattttttatatacgtgttcttagagatccaaaagcaacaactgaaaaataaacttcgatgaaaaaaaaccttaaaatcaacatcaaatttaaattttggctgataagtaggagtatgagcataagcaaacagacgagatcgtaagctaagagcaggtacaatagcatagcagactataaacctgctataaacatattttaagaagataaaagatgatatataaaagcagtggactacagatttgtagtcagctgcagcacggactataagacgtatgtgtgtatgataggtgataccagatattgattgtgtagtatatttttatataactattgtatgaattgactattaagttgactatagataatttgaagccagcggtgagctataatattaaacttgctctaattaagcaataactcgcgctttcaactgacggagtgggtgcgtgtggtgggtgtgcgcgggcgaggcacacggctttgacccccgccccgccgggcgcggcggcgtgggtgcgtgttgcaatcaacaacggcaatttcttcggccgctgccgctgccgcttccgtccacacacgccacgccgcccggccgcgtgcgcgcgtcgacgtcgtacgtcgatcgaccgcgcgccgatcggccaaagccggtctactctcgaatcgaataatattacgcatggttcgatcgatcgatcgatcggtcggtcgtcggtcgattcttttcttctcagcaaagacacggcaggcagatgcacacaccgaccgaacaagaaaaaaacaaagacacgacacgacacgacagatgcagagatgctactactataggagagtaccctctcccccatgtgcacgctcgtgtccacacatgcgtgtaagttaattattggacgcgacttgtcagttgccatgcacggccaccagtagtactcgatcgatcgatccctcaggtactaccacgtttcaattcgcgcgcattctcgtagacgccgagaggccggccggcggccggatcatccatccatgtttcgacagtttgaacatcatccatcacaccagtagcttagctagcgagcgcgacgacacacaacgtgacaagaggcaacgacacatgagctagcgcgcgcgcgcgcgcgcgtgcgtgcctgcgagatggctgcgccgccatattcgcgcgcgcgtgtgtgggtgcaggcgcattggcactgtgcataggtcgtcgccggctggaaaagagtagtagagtaccggccggtgggtcgttgcccagctcgttggctcgtgagaaaatttgctatattgtgccgtctccagacacgggtttcatcggaatgttattctgcggtttggattcgttaagttgtattgatgtatagcgagctagtgaaaggtatgtaaatttgcaattgcctcaaaggtatttggtgttgggggcgacgagtacgtgtagtacgtgtgcctacatgttgcactgcgcgcgcgcgcccacggtacgtacggacacgcagagaccctggctggtagggactagggacggagagccggagtacctaattacgtatacgtacggaggggctctacgtacccgacaggtgggtccccgttatgtatgcgggccgatcgtcagttcgtcaccggaggtagagcgatgatcattcacgtactacataatgactcagtctcagtctcataaaaaaccaacataatatcggatatgatacttttaatactatgaatctgaatatatacattatattcggttctagattcgtttttttttataggagggagtgagtacgtacgtgcgcgtcgctgggtggccgggttgttgggttgtggtttgtccgccaccacgctggacattttccggccggacggggacggccggccgccgggcaatggctcctcggaccggcttaattgcgttgtcggccgcctctatcggcacaaacatatgcgcgtacatgacacactctgcctctcactctctctttctgctgccctctcttctcctcgcagtggaactaatcattctctttttgaaacaaagtggagctaatcattgctggtttggcgaggtgttggccttgcttgggaaacccccccaatctcgggatgcgctcagatcgaccctcgatccatgcttgcttgcttgatggttccttgcatctctctgtctgtccactactctgtctctctggtgttcctctcgttaatttctctgttttcttgttgacacctcgcaatgtagtgtagtactactagtagtagtacagtacagtacagtacagctagtatatttgttggtgacacgtttaacttaacggatgggagcacatagctttgcttttggtaattagtagtacctccgtcctaaaatgtagctatttctagcacaatactttgtcctaaaatgaagttatttttctacctaccttctcctctcaaccaatcacaactattctttttcacctattttctcttttcaaccaatcacacaccttcttcaatcattctcacctacttttttaatacccgtgtcaatctcaaaaatacttacatttagggacggatgaagtaattagagagcttgatatgtaagtacatgtaattgtataacggatatggaccgaattaagacggcggagtgtggattggtggacggacagtggtcaacatagtacgcgcgtccgttgtccttgtcttaagatatgcattgttgattgatgaactgcaatataatggactgtgactgaactgagatatgctcggatttgatcgggtacatgaacgaatttaaaagactttttgctgcgcctttaatttcgagtcataatgtagttgcattgcagctcgttttcgtcatgttcttttcgtgtattaggaccacagttttcatccattacactctagggtcttaaaatatatatgtccttttttacttttcaaagtatacagttctttcgcataactaattaaaaaaacagtttaaattgcaaccagtaaacagttttaaaccagacgagttttgctcctgcatacacgtggcactgatgatgttatctttgatatccagctctttatgaaggcgtctatcctggcatgcacaaagactgtctttatgaagaccatttcctagactctgcttgtgtaagcgtaatccctggaatgttcatctgtctttaaaagactatgtgtaatgggaacatatatccaaatatccaatcacatctaaaacgactagttttttaaatgacatgagtaatttattgacgatcaactatactcggtgataggttattgtttggagcagagttaccgttgtacgagttttttttttctttttcttccttgttttttaatctttgttttttcctctcttgacataggtcggtctggctgagtgtgtcgggtaaaaaaaactctattcttctaatatattcagggctggccctaactttttggtggcccggtgcggaaaaaaattcaccattaaaaaaaagataatatttaaaaactcattgtcattaacgaatttcacactaataagtttaaaatacaatcaagcagtcacgatatactcgatcgtcgatcggtcttctgtttttttctctaagcccatcaagtctaataccatagtattaatattttggaggcccctaatttttggaggcccagtgcgatcctgtactgccctaaggccggccctgaatatattggcgtacaattttttttgcgcgttcgtgaaaaagataggttgttgtttggctacataaattgtttaatttcgcgcgcgcacctctcggtacgttcaacctgcaggaccaaaggcgtgcgtgaaacaggtcgtggtaagctcgtagtggtgtcgatgcgcggttcctgaaagtacgcacgtacgtacgcaggctcggtgctttgcgaattgcgagcggcgtccggttcccatctcgttcgtacgtgcacgcacgcaagagaggacgacagtgttacgtactggcactggctatatctatatagtacagtatatattttgtacagggactgtgtgttgcatgcatatatgcacgcacgcacatatgtaagtgtatcattacatatttatttacatgcgctagctacgcaactggatacgcacgtacacaatgcgctactagaaaaaaaacatttttatatgtggctgtcggtgaaaagggctcgggggtacgcacagtcgagggaagtatccttctaatctaagtcgcgtgaccacgtggcctcgttttcccccgcccctcgggtagcgctgaagtggccagagggcctcggggtgtcacgtcacacccctcgggccttcggggcgtgctaccccgaggcccttgcccggcaaccacgtggcggggagagcaggcggggcgagaaacgctgctccgtgccttcaatgcgcggcgtcccaaccgtcctgcgccgcatttaatgcagcgtgggaggacgtgcggcgccgctcgattgactcatgtcaatcaagcttgaccggtccgtgactagtcgcaggcgatgggacgggtggaagtgcccccacgttccgccctgtgtcaagcggagtaggggcaggtacgccccgtcccattgataacaatctggtccaggtggggttggccgaggcccaacaaattaaggttgtccggaccccaacagttcttcggcacacgcactcggggaaaggcccagtatccctaaaagactagtccaataggggaagggtggctctcccttttaaggtggcttcatcctcccaagctaagtaaggtgggattattcaaagactcacagggttgccgcccgactttggcgtctttgccagcgggtaatagtggaggatgtcctcatcattcccacccccttaacaagggcctagctctgataccaaatgataacaatccggcccaggtggggttgaccgaggcccaacaaattaaggttgcccggaccccaacagttcttcggtacacccactcgaggaaaggcccaatctccctaaaagactagtctaataggggaagggtggctctcccttttaaggtggcttcctcctcccaagctaagcaaggtgggattattcaaaggcttacacggtcgccgcccgactttggcgtctttgccagcgggtaatagtggaggatgtcctcatcacccatcgacacactaccaggggcgcccctcacgcgcatggtgagccgccaaagtctctatgcatttaagagggaatgacagggatgtcccccgtatcaggcggagaatggtgctgggccccacctgggggcgctgaaccatcttgcttccggttgaaggcacggagggcggtctgatccaggataggtggatccccctcccatggaggagtaggtatggacggtgcatgtggtatccccttgaactataaaaggaggaccgtcaccaccgaaaaaggggatgactctcagataacttgagctcgaaaggaagaacagttgggtttcccttaaagctcaaaacctcttgtaaaagttaaccacaattctacacacaggagtagggtgttacgctcgatagcggcccgaacctgtataatctcctgtctttcacagaggctaggtagtgatctagcagctagactgcaagcggaagtacgctcttgatcatcgtgccatcttccccggccgaactaataaaggggggtctcacgaccgcccgctagagaggatctctcctcgacaatggccaaaacatatttttgcaggcggccataacctccgcctgcatccaaacgccggcggaaatcaatgatttttgcaggcagctaaatctacccgcatgcgaaaatattttcagcgtaaaaaaaattggctgcccccagccctacccgccgccgccctcccctccgaccaccaccaccacgagctgtgccaccacgatggttttgagagggagagggagggaaagggagctgcgcgcgccacaagctcaccgcgccagcccgccgccgccgctggccctccccacgacgtagttggatccgagaggggaggggaggggaggggagggaagccgccgtccgaatctgggagtgggagtgccatcgccgccgccaatgatcgcgtcgcctcagccgccgccctccccacaacgtagccggatcatatccgtgagggaaggggaacgccgatgacctcccgcctccgccgacaacctccggcgcctccaccgctgcatgcagccatcgctgcccttcctcacaatgctactggatccgggatgggaggggaagggccgccagccggatctaggaggtgggaacgccgccgccgacctcccgcgtccaccgctgcatgcgtacgttgtcgccgcacggccgtgcctcgccgccgtccgccccgcgccgccggccataggcctccccctgcccccttcaaccggatctaggagggataggggaggcaaggcgcgtcaggggtggatgtcaccgcccccgagcgtcactgtccccgtgccttgtcgtcgtcgacgccaacccagcgcctcgccgtcgtggatcccgccgcccccacgcgtcgccgtcgtcggttcccgccgcccccgtcgccgaatgcccacggtcgctgagggagaggagagctgagggctgagggagaggagaggtgagggagacgagaggataggacttagaaaaaaaatctagtgatgtcgcgtctatttatatttcacgccaatttttgcagtggtctgcctgcgaaaatagattttcacaagcggatagcgagcttcacctcgtttacatttttgtaggtggtcatttaattccgagggttatgtccgcctggaaaaaaaactcacgtctacaaaaatgctttttctaagtagtgatgcaaacgctaggcgatgcttagctttcgagctagcgcattgtccattggattcacatttatacgtgcacggtgaaaattagaactagctgatgatgctcactcgacacatgtcattgcagattattgcaccggccggccgatcgccggccgtgcgaggaagaagatgagatcagaatgaacgagccggacgtacaccgttgccgccatcgccggcgaggagagatctagagagagagagagggaggcaggcggatgaggaggtacgaatgttactgtgctggagcagcgtcatgggagatgtgaaggtgctcgcaccgacgtaccaaccacacacgcacagtgccccgatcgattcatcgctgcagtatagtactataccactgccgccatgctgcgcccccccagtagtgcgtactacgccgtccgtcctgatctcaacacacacgcacagtctctctctctctctctctctctctctctctcggtcagtgctacctcgagggctataagctaagccccatgcatgcattcatgcatacgcgcaacaagacttccacgcaccaggtgcgtcaacaggacgatattgtgtgatctagagagagagagagagagaggggccgggccggccgaccgatcggtcccggccttcttacaatctgtcagcgacaaaactggtagataccaaactcactgttccttcactttcacctctctctcctcatcctctctctagcttgctaaacggcctattgcagctagctagcagctattgcctgcatgcagcgtgagatcgatcatcgacagataggtagagctggacgagtacagatagatagatagatagatagatagccagtgcactcactcactgactcactcatcgaaagagaaacagagaggcttacctgcacgcatccatccatcgatccatgcaatggcatccatgcgttgcatagtgcgcggccggtagaagggagtagtagtggagctgtgagctgtccgtccacatgccctgtcgtcgtcgtgcacaagcacagcccacgcacgcctgttgcatgcaccaccaccaccaccccgtacgtaggacaccaacggcctcaaccggcctctctctaggcacgaactctctgtacgtgtgtggatcgagactatagtcacgtgaggactgatcgaaccgtgagtttgctatatggtaaacttatcgtccgtgttcaatccaaagcattagtttgaatcaattttcgttgttaagcctctcagccacaaaaaaaaaaagcatgtctacttgatacaaattagaattattaacaacatatttaaacttggcggctgtttttttactgccaagaaatcagttggccgttaaaaaaattacggatgcttgtagtgattgttcttggttttgcatgcatcacacatttggcaagataaagaaaaagctaggctaagctagcttgctcacactgagatttttcttttatttacctcgagggataatctggcgctcttggtagtacggaacgttcgatcggacggttctggctggccaatagatcgatcgatcaggcagacaccgttcgcagcacagaggcaacgctagctgcacccggctggccggctcccccaccgtggggcccacaggcaaggtgggtccacgtgtcaatctgccctgccgaccgatgagcagtggacggccgatcgacgccttgtcgttttccctccggggaattcttactcgtgcatctaatctactagtagtacgtactccgtccatctaattgattttggccttttccatttctccgtaaatatattatagggttttaaagtactgctttatcaatctatacaaccactacatttattgcttctttgctcggcataatcttttccagtgagtaaattttcaaggaaatcaaaataatttcagtttaaatcttaaatttcggtaaaataatatgcatggttaaatccctcgtatttatggacggagtattatgcagtcgcactgcttaattccgtgcgtcttttcctggggccaatctcacgggggacccccagcgaaattatgcaaaagtaccagcagtgtagtataaaacgagagcaagaggggacacacgagtaaaaagaaaagaaaagggaagtgactgcaacaacagcgggcaattgttcttctcgggggacgcgaaaaactttgggggcctcgggattctcactgtctacctcagcaaatttcttaattttagctatagctagctagagctaagcatagatggatgagctagaggtagctagctagccagtatctttgttcggtttgttgctactcctacatcgactggtcatttggttgagataatcacagataatataggggtgctgtggtgtgtatatacacccttcgttctaaaataaaccaacttaaaaaacgtaactcctattacaacaaatttagataaatattaaatatttgtacaaattcgttatactgaagagcaacgaatctgaataaatattaaaattttattcagatttattatattaaaatgaatatgaacaaatatcaaaattttatttagattttttatattcgaatgtgacacatatccttctggtttgagttttttttatgaaggaagtgtagcactgtgcgagttgatgctttactgtttggggacttgtagtctatcaggagcggccgggtcctaccgtgggattgtacattgatctgacagcgtcatttatgcacatcgatctaagattgacgtttctagaaatcgagttttacgttggttaatgaaattaacactgtggtgtgttttctccatcccctaaaaactaatctaagatgaacatgacgatttctagtataataaatttaaacaaaccttcgtacaaactgcagcgtagtttagatgtataagttgtatattcaccgagcttgagaagtgagtttactaaacaaagaaaatgatgttagggaaactaacatggtgtactgcaattctctgggacaggaaaaatatcttgaccaagattgaaatgtttatcaacagtaactttttttaatacagtatgtcattacagtgcatttctctttttaagtacagctccagccaacttaaagaaacatagaagttgggtacctctaacttaaaaaaacaaatatcatggagttggagttgcggctaaattaggggaatgagacattttgttcatgttgataatgatattatattgtcaatcacttagttttaagttacaaactccattttctgcaaaagtccaggacctttttatatacattcatttgtacttaacgataacaataaccaaataataaatcatgtatatgattatatatagtcaaattgataatagagttggatcccggagggcaattaagaaaccatagacatatcaaattgatatttgaaaaccaatggcacaagatagggctacgttgattttatggtcttattagtcatcaatgaagtcttgagcaggggtttgcaatttcgtttttcattttccaaaattcagggacgaaagaaatatggagtttaaaattcagggacgaaagaaatatgaaattcagggacgaaagaaatataatgttagtgagatacttctacataaaatggcgcccacaaatatttcatgtttgaattgtctaagatgacatctaatttggaattgatttagtacaaaacacaaatattcgaggctttttctgaatctatgatgtaagaataaagtagtcgcaatccaaattctacttttgtgcgtaacaattagtaatacacaaaaaataactaccctcacatgccaccgacaccaagtatatataaccatagtgcaaattaattaattaattaatataattattaatatatatatatatatatatatgtgtgtgtgtgtgtgtgtgtgtgtgtgtgtgtgtgtgtgtgtgtgtgtgtgtatatgtactcaacataatgctgcacttaatacgaacacaaaaaggggagtcccttgcatcacaaaccagtgatattttggactatgatgcttcctcaagggattgccaagaccacaaattaacctttgtaacaaaattggtagttacatgtcaaactttacctgctatatatgtaaaacaacctcccattttatcatttgcgtgcttccgacacaacgcatgtccatatacacacacgtaccctcacactcgatataacgctatcaaagttaacacggctcgacgccacgcacatacgcaccacacaaaaattcgctactagctagcacagtactagtagcagttagtacaagctaaaacacacttgatcaataacccaagcccccccaggctagctaagctaagctaaccagggaccacggcacacacacttgcataccgtcagtttgttgacaagctagcacgcacaaatggtttgtagcaaccgcggcgggcatggccagatgctatcacgactcgaccaccacaccactggtgctatatacaaatatatactaactccaactccgctcgatcaatccccgttatcgatcgaccacgctttctacgacgacggcatcgctatataactaggttttaaggctacctctcaatcttcctcttcttcttgttcgtctccccctcctcacccaccctgttcatctcgcgtgtgtggcggtggtggtggtattctctctctctctctctctctctctctctacttggtgaggaggaggaggagagtggtggtatcgccatcagagctcaataatactagtgcacgctcgccttgttttctagctcttgtcagcgaaccttcccccctgaaaaccccacccaccccctcccctcctcctcgtctgcttctcgctaccctctgtgtttgtgtttgggtttgtttgtttctctctctaggcctcgcgcgccgtgatcgatcgatttctggagtgatctgttgtttttttgtggagttgtgtgatctgggagatggctggagcggggggtgcggctacggctgcagcgggaggaggaggtgggggaggggtggcggcggggaggagtggaggtggtggtggtggtggcgcggcggcggcggcgggggcgggggcgccggacccgagggcggaggcgctgcggtgcccgcggtgcgactcggcgaacaccaagttctgctactacaacaactactcgctgtcgcagccgcggcacttctgcaaggcgtgcaagcgctactggacgcgcggcggcacgctgcggaacgtccccgtcggcggcgggtgccggaagaacaagcggtcgaggagcggcggcgcggcgcctggtggcggcgtggggaggggcgggcctggaggcggggcggcggcggccgtctcgtcggctggcggcggtgcagctgggacttcgcccgcgtcgtcgctggcgctgccgcagccagggtcgctgccgtcgctgtcgtcggcgctggggctcaccgggggaacctcgctggcgtcgctgctgctcgggagcggcggctccgggggtgaccacctcgggctcttccaggccatgcagtcggtggtgtccgacgcggccgcgttcgagatgcaccagcagcatcagtcgcaggtggatcacctgctcggcctcggctacggcgccgcgggggcgcagatccaggcggccaagccgtggctgcatgacggcggcgccaccggtggcctcctcgacggcttctacgcgccgctcctgtccggctccatcgtgccggggctcgaggagctccaagtcaaggcggaggccaccaccggcgaccaccagcagaagtcatcggcggcggcggccggtgagcagagctgggacctgccgacgccgtcgtcgtccaacgtcgaggcgagcatcatcgcgtcggacgcgctcatggccgccgcggccgcgtcgatgaacccggcggtcagcgccgccgccgcctccacggcgccgtccgcgcagtcgctcctctactggggcaacggcggcattggcgccgccgccgcggcatggccggacctcgccaactgcggatcctccatagcgacgctcttctagctagcccagcctgccgcgcgcgccgcctccacgccgccgactgtgctagctagctagctagctcgtcgccgttcgccgtcgtcgttaactctattttttttccaccttaattttccctgagttaatttcccgatctcttgactaaaaaataacatgtaatttgtggggaaaaaaaaagctgagatgagagagagagcacactgtggagagagatagagagaagagaagagaagagatcatcatcatctcataggcagaaaaatagctagctagagcagccaattcaacaaccaaacgaagaacccaaaaaaaattcctgcaagatttcatcgccggtggtcgatcaagaaggagatcaagaacacagatcgactaccgaccgcgttcttcctcgtctccggccggtcgatgatcttggaaaggcggcggcgagcggaagatcaatttgggatgcattgatgaacaagaaggaaggagagatcaacaaaatcatgggaggagaagagaagcaaagaaagtgtaagtgcactagctagtgttgctactacttgatttgctagctagctagctctacttggcttcttggcttcttgatctccttccttgggtggtatgtagtagcttattttgtatatagggcatacggtgtggggggatagatacatgagaagagcttgaagttcttgcggcatatccatggcggtgtggtggtgcaagaacatatatgggggaccttttctctctctctcatctcggcattttaatcggtgtgtttaattggttaattaccctaccttggctttgggaagtactctagatgtataagttataatagtactctttagatcaccaccttgcagcataattagagaactgtttttgagttctcatgcattggacttgttaagggtcgtccaattccttgttcctcttctagagtgaattttttctcttctttcttttctcattctcttgggggtttcctttgttcaaaactttgcttgtatcattgatgactttgtgagctatgagaaattaaaacttctgtttgttcattctgatggatatatattgtgaatttcttttcacagattaattaatttgctcatatatacatccctcctctgtgtgtacctaggattatagttctcttcacacatggatactccagatacatatatgtatatatgtagtgtgatagctagctagttactccatcacttttagtgcatggatggatgcatgtctcactttagtgatgctcttgcagctttaacacctttgttagctctctttttcatggcgacggtgttgcgtgatctgatctttgaattctgcgctggctggcttcttctcatggatgtgtttctttctctcctttttttttctgccatggatcataggattctccagtagtggtgatgtactcaaatttagtgctagtatcatggaggtgttgctagcttctggtcagaatctttttttgtgcatgctcttggctgctggagaggccaaaaacatggctgctttgcttgttcttacctgcatgtctcgtagcaactcggagacgcattttgatgcatgctggctatgttcacaccaactgctaggtaattacatatatatagtacatatcactcaggaaagggaaaggtagatagaaacaaaacaattaaatggggggacaaatggagacaatttatgtggagatgcatgcatatgggggaaatgggaaaacgatttgatttggaatttcgtttttttttaaatattgttgcttcagctatatatgtgttttaacttaattatagtagttatattaattatgaattctcatctgagtttagtttgttccttttttttaaaaaaaatactttgatgcttgttccaatgtgctaaatttctttacttctaggctaacatttgtcaaaaatgactttgcatttttttaaaaaatccaaaatacaaaggaacttgatgtcgccgaatttaagtatctcctttctgggccaacacctattaccttaaaaatcaccctttttttttacatatgagtgaaagaaattaattatttgacactgaaagaaaattagccttctgaaataggatgggttttgcattactaattaattaattactgacatggttttaaaattaatgttgaacttcatctagtatatataacagatcttacatggttgagaaattattttaggaacatataaccggtataagctatctatacgtctagcacatatatgtacgtactatataagctctagctagtgagaacatatatctatctatgtatcaaattaatttatttaattagcatgaaggtcggatatgtgatggacttattcagaacctagctagctaggtgatggaataatgtcgtgttctaggaatttgctttgctttgctttcctaattggctagctagctatagtttatttgtcatggctctccatctttttcgagaacacttgtcccattgatctcgcatccatcttattattacaaaaatcaccatatgcatgtctttctacctctgtagctcgcatgagttctggtaggacagttgtacaatcactcaaaatctaggtgtataatccgtacctactcatccatatcattttgattgttgaatgacactgtttgatgttgttgcaacagcttaaaacccataaatgccattaatccttttgttagaaccgtacggttgtataagtatatatgtcggttccacgtcaccaaaaatgtaagaactgacctattaactgtagatgggtacaacagtaatagtactcggaatacgcatatatcctaccttcgataattaatattatgcattttgatgcgtacttaatattacagtccttgctagcttggttgtttctacacatgaagattactctcataagtcataatatatgcgtgtgacatatacttgcatgcaacacgcacatattcattctgaaatcggcattatatttgtaattaatcatcgatccaagatctgcttaaactaaaagtacaatataattaaagttgaaatttatgcatagggataaaaaaaatatagtcacacatacaggccctgcaaaactacagtactggtgtgcatgcatgagccaatttatattagctaagcttaattaccagtggtactgtgtactactgtctatgtgctttacaaccaatgccattactcgatcgtgtactgaaaagacataagtagacaataaaatgtttgcttttctgctatagcagtgaggaatatatatatgtatttccttgattgatgatacgcatgcatggaacagcggaacaattatatatagtcggtgaaaaactagctatagctagtaaaattgttccatatataattaagtcaataatgtgtatatattaattgtaggcatgcattttctcttttatatacagaaaatgttgacaagatatatagagatccatgacgttttctctggttgaaatgtttttttttaagtaggatctgcacttcgtactaacaaattaaatcagtatcacaaaatatgtgaattggataattttactatccttagaaggtacctagaggtaccatattttcaaatgtaaaaatttgtacctctaaatattaagtatctcaagataccaaaaattttagtgtaacatttaggtacctcaaaattattttcttaacgactgtaaaattcctcatatgaattggtctctgtgtgtgtctatacacacaccattctcttcttaaggacacaatatatatggtctactccatatatatataatccatgtgtgtgagcattccatttctatcccttttgttctgtgatctcagctcgcaattatcatatttattaattatgcatatcatgcctaatagtaaaccataagaaggctgtttcgtatcacgtcaccacgaggactattcacaactatccacatctcacgattagtcaacaattagggcttttctgcagtggtgaatggttgtatatgcatccatatgcatgcatttctattttccatcaattgtgttagcatcagtagtgtttacttttagtgtatatatattcgacgtggcacatgcgttgttcagtattgttgtctaacagtgagagtgatcgataaatgattttgaattgtataattaaaacgggggtatttaaatttaaataaagtataactgtgaacagaatttattatgaagttctaggccgggtttgagtacgtacgtaagaaaaaacggcacatttatttatgatgaaaggagaacataaatagatttaatttgtatacatttacaaagtactctccaccactgcaatacacacgtactggaattagaatattgatgtataccaactttcatatatagactactaccttcatcccaaaatatttatcgttctaggttatttagcatatatgtactaaggtttaaagataaaaactataataccccttaattaataatgcatagttggatataggatgatggttggggggtaaaatggggagaaattttaggacaatttttaaatgctagaaagactgggacggaggaagtatttaagaaggatctcaccaacatgtccatcctaagtattttcctagaatatacatgcatatatacgtaggagctacacatctttgttcatcactaagtacaataattaagggtatttgatgaatctgacatgttgcaccacaacatacgtactgtagaagtcatgcttattcagtccaatgtttcttgccatcaatttggatcgatcaatgctcactatgcatggaatacagtactacacacagtaataattaaccctaccgaattcatcaccattctacgccacccctgcaggcttcgactgaataacacttttaaaaaaaatacacaagaacatattgcaaaataaaaaaaaccaaaactaatccttaaacttcatacaaatccttcattagaagtgtgacttgagctttcaattaatccttgtccaaatatatcaacaatccttcgttagaattcaacattgtttaattatacatgtagatcataagaataattcatataagtccactgactgtaaaaaatagatactcccgatggtttcatgctcacaactttgccccgaaggttgcgatcgaaagagatgtgggcttcagctttttcattgcacacaaaataaaataagtcattaggttaatcaattacttcatccgtcccatcatataaggaattttgggtggatgtgacacatccttatgtgacgtctgtacagattattatactagaatatgtcatatccacctataatctcttatattatgggacggacggagcaagcagcaactattacaagcttcaaaactagatttatataatttttaaaaaaacgtttttgtattatttttttacacatagcagttcataaaacgtacggtgagcaagaaaatggggtggtgatcgtctgatcgaacgagaatcaaagccatcgccgaagaaaaaccgcctagccgatgagagcgcacgcgcgcgcgcgcacacacacacaagcgcacaaagggaaagcaacagaggatcgatgtagttggaaagatcggcttggttgcaccggttaaaaatgagaaagaaattaggagtagcaagagaggaaagttgaatcgtctgacgcgggcagcagcggccgcatttgcagcaggcagcgagagattggaacgcgatccttgcggggtacggcggagtaactgggggctctgaattggatgaccgcattcacatcgtgctagtagtagtacatgatagctagcccttgctcccatcaataggtaactgtgctatctacaggagccactgctgccaaagaagcttatcatcccttcactcccatcttctgaaaatgcctgtagcatgcaagaacgaccatatattagtgtgtgtgtgtgtgcgtgggtgggggggggggggtgttaacgttttggatactgttatttgcaagatcaagacgggatacagttttctacaggacgttgttgattaaagaaaatgaagaaattacggacgaaaaaagatgagtagtaagaccgccctcgcagtgatcgcaattaatttttggtttctttaaatttgattaaatttattactgtaaaatttagtcaaaatttgttaatttaaataatttcatgacaaaaaaaaaatctgacccccaaatttcgatggaaacgaaagtatagaccctgcactctcgtgtcgctcccgtgggacgtcatgggaggtgaccaaagcgtttctccatcgctatccaacctcccacctttcgttccctcgttgccaccgaagtataccgatggagctctatgcggttgtgatgacgacaacaacagagccttcatgcatcttcctcggtggccctcgttctccaagaagggccgacggtgacacagtcatgcttaaaaaggatggcaacaagcggatgggaacaaacagatccaacgcttcctcaactggatctggcgtcctcctagctagatatgacgcccttcaatcggatatgtgcatggtgaccagagatgcccgcaaggcgcggttggtggtctaatgcgtggagaggcgggttgttgtatctagggataggcaaataaggcgcactcagtgggcaagttggctagacccgtgtagttcggcgaaccacgatggcggtcgtgtgctcgacggttgtgcagtgcggacaagcaaacgtagaggaaggacaacaacctctatgaagctagttgtccatggccaatggtaggagaggaagtgggagggagagacggccactgcggagtggttcgctcgatggagggacgctgatatggcggaggcacggggcagtgctcatggaggcagaggtctgatctggccaaataacgacatggatggtagtggcatggatgtcataggctcagtcaatgggttagatgacaatctacctccctttattggctaggcttatttttcctccttaggcttatttcttcggttgtacggagcgccatcagggaggaggcattggctttcatggcagagagatgctcggcataggggtgatggactattgtgtctaggtgacccatgcctcccccaatgcagtgtggtggcagctgcggagtggctgtgcgtttgttgattaggcgaagtcagagctactatcactactatagaaaaggtttttgcatacagtcaaaatggatctttgcagacggttgggtgcatggcccccttacacgcagctctgtgaaaatcaacattttcacatgcgagcggcctaaccgcgtgtgaagatcaattaccacaagtgggcctaatgtggccgcctgctataatatattttcgcaagtggatgagttatatggtccgcctagaaagacatttttttccgtatgaatgatttagaatgcctacatgctataacagttttcgctcaaaaaaataaatttcaaaaagaattttgaaatccctagcacttcttggaaccctaaaatcggcatccacatgacaacattcagagatccatccacattcacacaccacaaacaaagattcatccacatccacaaactacaacaaacaagaacaaacatgaaaaactagagcttcaatcaaaacatagtagaaggagtagcagaaccgagttcgcagaggagatgaggtggggaaggagacgaaaaggcagaggggtggaggtcccgcgaagcagaggaagagtgggtggagaagaggctagcggttagacccagggtgcgcagcgacgatttagaggcagaggagcctgccctctcgaggtcacccacgccggagcaggcctcccgttgctgcaggcgagaagaggcgggggaggggaagcctccccgccgcaccgccttatgggggttggttcgtgctagccgaagaaaattttgtcttttgcaagcacgaggtggaggtttaaacccatgatctactggtcacacgaagagcatactactgatgcgctacctccatttttcaaacggaaacaaacatacactcaagatacattgtagtaatgctaatattataatttaattagttacatttgaaagtatttgacaaaataatataaaattttttgtgataatctcaaagagtacccgtattttttctccttcatgtcgataacaaggtactctctctgtcaaaaaaaccaacctgtctataacaatgaatttggacaatcctctatccatattcgttgtattaggagttaaagtttgttttttttagatggatggagtatactataaagcatgcccgaccggccagcccagacacacgtacgtactggcacgcatgcatgcaaaatgcgcttgtgtttctccctgctcgtcgattaccgggttgactcggccgcgccctgcttgcgcacgcgcgtgtacgtgctgtgttaatttgctgctgccatcgatccgatccagcgtcgatcgatcgaacgatacacggatcgatgttttccttgtcgtgaatgatggcagccggagacgacacgtacgccggccggccgcgtttttcctccttgctgatgatctcacgttggaaggagagtagccaccacgccccccgtcagacaaaaatgacatcagaaactgcaacttcgggatttccccaagtgtgcctgtgtgtgacggcactgacaagcggggtcccatgatgtttttccaaacaaattaattaaggacgaagcggcaccagtctcggatcggataaacatttgcaactttttgcaaggttaacattttatcatgttcctcgtaataaaaaatggtcatgttttatttaacgttcgaaatctctcattatagatggttcatatggagtaatcttcggtaaaattatgacatacgtatagttccacacaaaagacactctaagttaatcttaccagaaaaggaagatttgtctgcaatgtagcctttgcatggtctctcacgtggaactgaataacacagccatcatttcctcagcaatttactctctccatccaaaaaaacctaagggtgtgttttagtagaaggggattgaggagaatgggaaaagcgtattgagtattaaatattttatttaatactcatgattaattgagtattaaatattttaaattttaaaaatagattaatataattttttaaagcaactttactatagaattttttttcaaaaaacacaccgtttaatagtttgaaaagcgtgcgcacggaaaacgagactcaatctcccctatctccccagaacgaacgatgccttaatttaggtgaggatgatcgttcatagtataacgaatctagacaatttgtttaaattcattgtactaagttgagttttttttttaacagtgggagtacactatgactctatgactggtaaatcgtgaaagaaaataaacatagcaacttaaaaaaaataaggtaaaacttttatatttatgtcttaattaaacaatttgaatttaaaggcaatactaaaaataaactacgagaaaaatcatcaaaattaattttaactagcatggtggcccgcgcagattgcacggctagcaccattatattttctgtcatataataacatactccatatgttttctcaatgtattattcagatatattaaaattatatatgtcatataattttaaattttgtactaccctgacgaaactactaatatataatatttatattgtattttatatacgtgttagttattaatttaatatcaaactttagttatttgtaaattatattcctatatggactctaggctcttcttccaatattatttatttttaattctgaatttttattatttctaattgtatttctatgtggactctaaactcatctttcaatactctttaatttagaagtattaattctaaattgtattcttatattgactttagactcttcttccaatgtttttataattttgaattttagttattgtaaattatatttttatacgaactctaaactctacttataattttattatgtttattcagaattttagttagttttaaattcttatatggactctatactctacttctaatatttcttatttttaattctgaattttagttatttcctaattgtatttctatatggactctagtctcctcttctaatatttcttattttttaattccgaatttcagctatttctaaattgtatttctatatagactctagtctcctcttctaatatttcttattttttaattccgaatttcagctatttctaaattgtatttctatatggactctgttttttctttttcttcgattaatgtgagaatttctagaccatgagagcgaacgtgaaggtttttttttctattcctttaataatataatagatttgtttttaaaattgtaactttggttgtggtaaaattgcaaacgatgccagttggggtatagttttacttttgacagtttttctaaaccatctaggataggatgcctggaataaccattcagtagcacagctctatcttaattacggccgagaagtatgacagggagagacaaaaatctcaccgcagattactagagtaaaaaccaagcttaactttgctgcgcggccatggtgaggacaaggtacgtgttcttagtactctattgaccagagggggagctgcatgctcgctgaacgctgaggcagagagcccagaggcgctggcttggctgccactgcatgcgcccaactgaatttgttaggttcccagggcggtagcgccaggccgtgcagatgcagatgagcgccgcacgcagcatctacaggacctgccggccggctgcggtgaaaattccaatttactgcacactactacccggtgaaaactctcgtcatcgatccatacataaacctaataatttagtaatagaaaaatagcaaacactgtttcagggattgctccctccgtgccaaaaacacttttatctgtaacgtttaaaatttttggcttaaaaatgcatgttcatttaattggaccttagaaattgtgaccaaaagtattgatgagggaaaacggtaatcatttcttctcactattctatccatcccaaaatataagaaacaatcacttttttttaaaagaaacacacattttacaacctttcataacaaaagatgtgcattcatacatgtattgcactagcaccttcctcctctttaatttgttttttatatcctttatcctcaaaatctctattcgtatggggtatacacattgttattatttggcaaattttactacaggacactgctattgtgtagttttagctgtgggacactgccaaaactcacttttgggggaaaacacttcataaatgtggtaatttgccaatgaacacgatgtcgattaaaataataatttctaattgagtaggagtgagaaatcgcgtaaaatatcaaaaatgcccttggccccatgtcagctctccatctctctctttcttttctttctctcttctcccggtcgctgtttcctcggtgacaccgcccgacgaagcatcgccacgacgacctcctcttcctcccatgccgcctcccttcgttccaccttcgagccagccagcactcaagcacggccacgccgcaccatcaccacccaccacccgcgcgtcgtcggcccgccccccctgcacgagaccactctgccgcgccggccttcccgcttccccagccgagccaccggtgcccccttctttttccccaccgctaccggccaccacctacgccacccctttcctcggcgccgcctccctcccatgccaccgtgccgccttcgttcttcctccgccaccacaccatggcaccgtcgccctccccagcgcgtggccaagccaccgccacgccacctcacaccggccacgcgccgagccacacccggccgccggcccgccgtgcacgccccgaccctccattcctcctctccaccaccgccggccctctccctaccgctgccagtctgctcctccttttttccccgtgccgcctccttctcccccccggtggctgccgagcccctgccgagctcgacccggccacatgctccgccgcaccagctgcaccgccgtcgtcgtcgccgccaccgccgtgcttgtgtgctcggtgccgccgcttgcacctcgtcgtcgttggcattgggtacccggcggtgcgccgctgcttccccggccgcacgctgggccgtcccggctcgggccgtcgtgccgactgtgcgttgcgcaactgctcacccgccgcgggaggaagaagaagaagggagaaagaaaagaaagaaagagaggaagagagatggagagctgtcatgtaggcgcaagggtatttttgacatttcacgtgatttctctctcctccttaactgaaaattattattttaatcgacacggtgtccattggtaaattaccacgtttatgaagtgtttccaccaaaagtgagtttggtcagtgtcccatagctaaaaccacacaataacagtgttttgtagcaaaatttgccttattgttttcattagagtgattcaaacgaggtgataataattctttcatgtctttacgtcagaggtatttgctgggatggaacaaggagggaatattagtttatcaagaatggctataaatatattctttatgaaacggaggaagaagtaggtaataataatctccctcaaagggaatgattagcgtaagtaacactcctggtttgattggttaattcctctctctctctctctaaacagtacacagctgagaaccaggcaaaagaaccggaggattagttgattgattccatggacgccatgatatgatgcacccactcctagcgacatcatacacgcatgttcctccccactaagctgtgggccacattgcatcacacgtgcccttcccgccttctctctctgccatcactaactacaccaaatggcttcaccaatcaccaatgtcttaatccatggaatgtcactcctgtccatcgatcgatcagccaatagtagtaacaaggatcatcagtacgctcatcaccattagttactaactgcaattaatcatgaggggatgaggacaactgtccttttcttattcactcacctcagactcagaggtaggataaacgtacgtactacgtactcatcacgtacacaagcattgcactatattcctagctatatgcaccatagagatgtgtactccttctgtccaaaaagattcaaattttagggatgaatctagacattcaaataacgtgcaaagtatgtgcttgtgaccctgaagccacaaggtaataacacttgggtttttaaagcgggatttttaatatagaaaaaaaatacaagattagattatcttagcactttaaatcctatgattaaaaaatacaagaaaacttcgaaaatgaccatttagatatagcacagaatacactggaatcacaagagcgataggcataggattttttttcaaaaggttagacctcatgtgaaaattcttctaacattcaaatttctatgttttgaaccaatccaaagaaacttcaacggcttgtttggtaactggatgaaatgggattgggagtttgatgataggattaagatgagaatttgatttttaatcccaatatcttgtttggtagaggtgatggaaattgatagagagtttagttgaagattaggtcattaataaaaacggatggctgagatttgcttagataaagtaaaggaggaattccctcccaattacctgccctacccaggtattgaaaaggtgggagttctttcctcaattctccatcctcattccaccaaaattctcatgtctcccaaccaaacaaaacacttaataatctcatccctctaaactctcaatccctcctaaaaactctctccaaccaaacgggctgcaaaggaatttaggacggctatttctttgatcggaaaatattttcattggattgagttcctccaaaaatttcaaaacaccctttgttccaaagaagcccttgattgtgaacaccctcgattgggaaaaggccgaaagttatcaccgcgtagcggtataagaaaacttaccaggcatggtaaggactctgtaaaattcagttactgtaaaattcctctgtaaatcctcttacccaaaaagagctaccagggtcttgtttggatccttcaggctattaaatagccctccggaatcttgttatttaggagtattaaacgtagattattgacaaaatttattccataacccctaggctattttgcgagacgaatctaacgagatatttaatacatgatttgctaccatgctgctacagtaatcaaccgctaaccatggatcagaagtagctgtgaaagagctactagaagtagctgtgaaagaaatggacgtgacaccatggtaaacgacacgtcttaaggcgtcgaaactgtcaacaagacccggcctggctcgctcacgcagggcttggatggatggacgccggtcactccaggctccagtgcccgtatctcgcattccggagattctcggttccacccatccatcaatctttccttcccaattccaaacagccaatcaatctcttcacgcttatcgcgacgcgcaccacggccgtgagctgagctgacacccaacacacgctgccgcaatcgcgcgaaccatcgacacgcagcaacacaacatcgtcgtgactggagacaaacgctcccgatgcttcaggtttcgagtgttaatactccagtgatcatcaagagcgcctgattaaatactgagctctgagccagtagtagtggtaagcagtacactgaaggagaacgaccgatctgatctggggagccattgatttagagcgggcaggaggaggggcgtacggcgtgtacaaggatactcggtgattcgagtgattggcgcagccgtgcagctgtgacaattgatagctctgccctgtctccgattcttctaaacacaagcggacaagcaaaagccgccagggcaggttttgtgttggctgggacatgacaaggcttgcattcagcagattcaggctccagtgccttcaccccaggaggacagcgtcttggtgaattacagcaaggagacattcagacataaagatgagtgtaggtaaaagtgaccttttgttaatgtcgctgaatggactagttcttttttctcattggcttcggttaaacagtagtattagctttgttagtgttttgatgattctgttggtggtaagcagcctgtttgaaaacctcttgccactctatccaatgggagttaaagtgcccttaccaccgaagtacaaaatggtatgcagaacagctgaaggcccttaaaccatgtattgcatagcgacctgcatcatccgggagggcggtatgctcagcgccgcgattcctctcctgcagttcctcctcaagaaggcgtagaaatagttgatcaccagcttcttgacaaagaaggactccttccgagctctgatgtcgccgtggcccaggaggtacaccacgccggactccttggccttgtggatgaacgagagctcgtcgtcgaggcttcccctcccatcgatcgcctcatccagcgatccgtcgaacgacatgctcgatccaatggttgggtgctcggtagtaccagccgcctcggcaggtggaacaccgagagaattgatactgccattgggaccgacgagagctcttgacgaggctgatgcaacctcctcttctgagtctgtaccgtcgtattggtcactctctagggagcgctcttgggcttcccgccgcatgaacttctcgagactctctatcagaagctgctgaaatgatatgtagtcctccttgcgtatgtccttgtacccatacctgcaaccatccatgaatgattaacatgcaacaagaagaagaagattacacaaggaatggctcaatcagtgcttaaaaaaggatagatcatagctacgtaaccggctcaatcatcacacactgcatcattttattcaagacagcagattacatattcaatatttcaatatccagctatatggatggggtctatcaggccagcttcttgacatataactactgatacgaactgctgggggtagatatgcatgggtagaaagttgcaacagctatatttgccaggacgaataaaacaaatgttaatcaacagacatagaatcactgctagtaaatattagcactatcatactttggtacggatatgcataaagggactccacaaaacaaagtagttcaatagctacagacaagtaactgaagataagtttttaaagaaatcaattttcattcactgaagttagtggcagagatagaccccatggcccaaaggaatcatttcatgtcagggactagaaccaaagctcaatagaacctctgacaagaatttaaaggagtatcaaaacatcagagatatagaggaaggcatagtccatctctggctcccccactgtgacaacagtatgatactatatcaaacatattacagctttaaggggataccagccccagctgcacattgacaaaactgtcagatgccaacaaagcaagctgtttttagcagattcaacgcattacgtgaaacacaaacagatggacacagcataaaacacaagtacctacatttattatctccaaccttcaatggagcacaaagagagaatgcaaggcaaatattacttcattttaggagatacttcctctgtttcatattataagactttctagcattgctcatattcatatatatgttaatgaatctagacatatatgtgtgcctagattcattaacatctatatgaatgtgggcaacgctagaaagtcttataacctgaaatggaggtagtagaaacatttgtagttactatcaagtctggaaaagaattgacatacatacctagcaatgcagcgaaacatatgatagctctttggacagacccgacgaaagagaaatctttcattctgaggtacaacaggaactggaacccacttgatgcagacaaaaataatcattgaatgaatggctggcattgtggcgaggaattgaccaaagattccaggaactcccctcgcaagttcgttataaagtaatccaattccagggactctgactgtacccagattacaacctagctccatcaacaaatccattgaaagtttttgcttaacctcagtttcgtacttcaacttggttccgtagttccatatgtacattatcaaatacagtacagcagcaaataccaaaagaacccaactcccatctgctacactgcccaatactgaagaaaagaaaattaactccagccccagggagagggtgagaaaacacagaactacaatgatgttgatctgccatatcaaaagcattatgatggtcaccaagactgtagtcatcatcatgaccccaagttcagctatgcctgcaatagttaccaggcattagaaagattatgcggtagcaactgtggcactggtttcagtagaaaacaggttacttagcagccagctctccatgttaaaaatcatttgttgacaatcttaagacagtgttgttaatataaaaggaaaaatcatacaaataacaattcagtgcttaatgatatagggcatcactttctagttagaaaattaaaaaaaatgatgaatttgctgtatattttatttttgtatggagcaattcacgtaccatatgcatttccaatctcattgatgctcccaaacattgtaacaaatgcaaggcaagaaaccagcaaaaaccagttcatcattgggatatatatttgacccatgaagcttctagaagtgtgaataatcttgaggcggggaaaacagccgagagctgtggcctgctttattgttgagaatatagcagttgtcattgtgcgactagcaattatggctgctagaattgctatgaataccactggccaaaatgcctgatctgcgacacggaatgaaactatttagaatttaggggataatagattccatttcattttgtgtgaaaacaatccatagcaatcagaaaatcagatttaaaagaggtacatagatgaaccagtttatcttactcgggatagataaaaagaagacctgctgattttctgttagattttccataagaaatgcagcttgccctaggtaacccagtagcaggcatggaagaacaagaaacacaaaggtaagctgcaacacattagacatagtaagtacaaggatatgaagtgcaacattgactcttaaaacaacagaaaggactacctgaacagatttgacagagaaatagcataaatcagcaaacattgcctcagatcctgtaagaagacaaacttgttaacatctttactgttcaagtcaaaagaacagcactgctcttttacataagctataaaataaaaggacagcagcttcaataggtttagttatgacctactacgaaataaaagggcaaagacagggtatatcaagtctatatagctcgaacaaaaggaactcaacaaagagtaaagtgcacgggtggtccctaaacttgtgtgggtgtcaactaggtccctggggtaccgagctcaaaatgaattattaggtccctcaacttgtctcgggtgtcatataggtccaaacgggttccaacccgctccgtgtgctgacgtggcatgccatggtggcacctacgtgtcagtagaacccatatgtcagccacatatagaaaaaactaagaacatatttttttctcctctctttttcatttatttttcaaaattaaaaacatcattttctcctctctttttaaattttatttttttctacatgattgacatgtggatcccactgtgtggacgtcatctcacggagcgggttggagcccgtttggatctatatgacacccatgaaaagtttggggacccaaaaatgcattttgagagtttaaggacctagatgacacatctatacaagtttaaggaccggccgcacttcactcaggaacaaataaggaaaaaagacatgcgctagaagtaagcacattcttagataatttagcattcaataatatatcacaaatagcattaacaacatggctaaaacacataccagtagcacatagaagacagcctccaagggacatccaagcttgggttgggttcctttcaaaataatagtatatatacataggattaaatgcctgtaatacagctgaaccatatgtcttcatgttataaattcctattccagcaaggcagcaaaaccatatgaacaaggcaggtccaacagcaagcgccactttgcttgacccaaatcgttgtagagtgaacaggacaataagaactgccacagttatcatgacaacttcacctgccaaagtttcacattaatagtaagtatgatgtactcgtagacagtacagacttaattcttttcctgaatcaattagtgctatgtgtcaataaactgaaattctgaggtcaccttcattaacactagatattccaacctttaagccattgacagcagacatcactgcagatttttaccaatagaaagaactggaattagttctacaggaaagagaaaacctggtctagcacaatatcactcataaaagcatatataatgatcattaaacacggtgaagagaaattcaatgagcaacgcatcagaaatatgtgaacctgacattgctggtgtgacaacaccatccgctatcaccatagaagtaccaaaaagaacaagcatcaaaagcagcttctttagcatagatgaagtctcaagacgctccttgatcttcaaagacctctccagttctactgaaggcacctggagttggaagcttgatatacgagtatcagagcgtagttggttaggaagcagactaacccttgcattcctgcatattagcgagtataaagcaaatgtccctcctgccatagatacagaacacggtttcattaaataaaaagattaaccaaaagtgctgtgttttagtctactcgtagtgacctagtagtacataatgagatataccttctccatcatcgtttccccataaagcaatgagagtatacttcagcaatggtattagaatcagagtgtatattacaagtgagagtgccccaagtacatcctccttcgaagtaatagggtacttgttgaacattacatcgaaagcatacaatggactggtaccaacgtcaccgaagacgacacctagtgtctgaacagccagcacaatactcctgcctacggtaatttcctgaaagaaaatgcatgattgagaaatcagtagagttcagatactcatgcatttagaatgaggcttgcacctcatcgtccaagcatcatatgaagtgatgatgtttggatttggagtatcaatgtccaatgagaggtacttatcaaacaacttgcatgacaacatagaaaccaaaatactgccttcattcatttctagatgttgttttagaataagtgaacctcaaaatttaattcacaaactaatttgtatttaatatgtgaaaatagcattagtagatttcacatgaaaactactttcatttagttatttgttaatacatagtgatttttgtaaatataaaagcaaaaagggcaatgataaaacaagtgcattggagattgtgtcgatgccctaaatgacaagaaaaaaagaacagagggagcagtaatcaaaattgacaaagtctctaaaatactactttggcagataatttctagtgtgataaatttgaaaaatctatgaacactatcatataatgatagacagttttcagcataaatgtactggtaatacatgtggttaattcaatttgactacattaatggtgaagaaagaaagagaaataaaataactcgtctcgctcattcatcaccagtagtttcacttaggtgactcaatgcaccacatgctgttctttccacagcatttagtttcacagaacaatttaactctgaaaagccaaaccaggagatgaaacaaaacttttcatgtcacggctccttattcacatccctaaggttctaacttctgatctcgagtagaagacgaacaatgaattgcaatagaaatcatgctccggcacatggcgaggtatgcgtccattcatggaaaaaggctcagaattttgtcacatcaattatgcatgttttcgtggtgttttttgcaatattgtagtatacattttgtgttgggttcacttagactgcagaaaatggctaaataaaagaatgtctgggacagaaatagaataacagtccatgtgatctgataagcattcacaataaactaaaagccatgactgaacaaatattatatcgctaggtcgcaatatcacatcaacacggccatcgtgatattcctgtggatattgtagcttataaacttctcacatcacaacaaagaataagacatagatatgctatgctgctacaagtatcaacaaaaaatggagactagggtagtaattacaattcttcaaactgtccacaatctgcatgtaacacttacatcctcagatgtgtcacctacaaacaacaagattacgccgcaaaccaagaatttcactcatcgatcaataacccaaccatcaagagcatgcgtgtagcttgtggaccgaattgcactggttcatcagaaaagcattgcaaacacgttgcatccatacacagatggatacaacctagaagaaccacggtacatgctataaactagtatgattttgctaattcactaaccagaccaaccgaatgaaattacgcagtccacaccacaagcatatagtgagctcagtatgatgttcttacagcccaaaacccaataataccttatcggctccaaggctgcaatctcaattgagcagcagcgcaaagccgcctaatctaacactatcactagagtactagaccacgattgataagtgtcaggaacacgcaggcaatacatcgaacagttggcgcgcacaaaagtagaggcagccaattttaagcaaggccccgtgtttcccgtgggggctcgggcgggtgcgcgcacctggtggcggttcatgcctgcgacgtcctgcgcctcgacgtccagcgagtcggcgcgcgggccggtgcgcacgagccgctggcggagcatctccgcctcctcgtagttgtcgtcggagtccgagcagccgccgcgggagcccgaggcggccgccggggtgccgcccccgccgtcggagctctcgatctcgtcctcctcgtaggcgccgccagacaccacccaccgcatctccgccgactccgtcttccgcagcctcatcctgccgccgccgccgccgccgctggcgctgccgctgccgccgcttcgggtctccatttgggtcggcgcgggaggcgccggtggccggcgcgtgggtgtggggcactggctccgtgaagcggaggagaacggcagaaggggaggatcggagcgggggagaagaagacgctggagagtgatgaaacggaaactgcagtagcaggagatagctgccgtcttcgtcttttcccctcctcatttttcacccctcatttcagtgcacttaatagtcggttaatttatgtttttattttctcccacttcttttgaaaaatactccctctgtattatcttttttgttctcaaattttttaagaaaatactgccttcgtattaaattttaatgtatgtcgtcgtttacttttttatccacgtttttaccattcgtcttatttaaaatatttatgtaattatgatttattttattgtgacttcatttatcattaaatgttctttaaacatcacatataaatactcttgtatttgcacaaaaaatttgaataagatgaatggtcaaacgttggtcaagaagttaacaacgtcatacattaaaaaatgaagggagtagtttctttataaaaatataccctacactggctccggtgaaacgaaggagaacgacagaacagagggtcggagcgggagagaagaagatttaagagacttggacacctgagtgatgaaatggaaactgcagtggtaggagacagctgtcgtcttcgtcttttccccctctttctctctctatttttcacccttctttaacttttctttaacacaacagtcggttaacttatctttttttcctacattttttttaaaaaaaatactccctccatattaaatttaaatgtatgtcgtcgtttactttttatcaacgtttgaccatttgtattatttaaaatatttatgtaattataatttattttattgtgagttgatttatcatcaattgttctttaagcatgacataaatacttttgtatttgcacaaaaattttgaataagatgaatggtcaaatgttgctcaagaagttaacaacgtcatacattaaaacattaagggagtagtttctttataaaatgtactccatattggctccggtgaaacggaggagaacgacagaagtgagggttggagcaggggagaagaggacgttggagagtgatgaaacggaaactgcagtggtaggagacagttgccgccttcgtcttttccccctctttctccctctccattattcacccttcgtaagcttttcttcagcgcacttaacagctggttacctttcttttgtccatttttttttaaaaaaatagacctttcatattatctttttttgtccaatttgtttttttataaaataccccctctgtattaaattttaatgtacatcgacgtttactttttatcagcgtttgaccattcgtatgatttaaaatagttatgtaattatgatttattttattgtgacttgatttatcatcaattgttctttaagcatgacataaatacttttatatttacactaaaattttgaataagataaatggctaaacgttggaagtcaacaatgtcatacattaaaacatgaagggagtagtttttttataaaatataccccacactggcttcgctgaaacggaggagagcggcagaaggaaggatcggagcggggagtggggggagaagaagatttgagagagttagacacttgagcgacgaaacggaaactgcagtggtaggagacagctgacgtcttcatcttttcccccctctttctctctttatttttcacccttctttagcttttcttcacggactgttaacacttaacagtcggttaatttatcctttttccctctatttttttaaatactcccttcgtattaaatattaatgtatgtcgtcgtttactttttatcaacgtttgaccattcggtttatttaaaatatttatgtaattatcatttattttattgtgacttgatttatcatcaaattttctttaagcatgacataaatacttttgtgtttgcacaaaaatttcgaataggatgaatggtcaaacgttgctcaagaagttaagaacgtcatacattaaaacatgaagggagtagtttctttataaaatatatcccacactagctccagtgaaacagaggagaatgacacaagggagggtcagaataggggagaagaagatttttgagacttggacactagagtgatgaaacagaaactgcagtggtaggagacaactgtcgtcttcgtcttttccccctcttactctctctctccatttttcacccttttttagattttcttcactgaccgttaacacttaacagacggttaacttatctttttttgcctccattttttttagaaaaatactccctccgtattaaattttaatgcaagtcgtcgtttactttttatcaacgtttgaccattcgtcttatttaaaaaatttatgtaattatcatttattttattgtgacataatttatcatcaaatgttcttaaaacatgacataaatacttttgtatttgcacaaaaattttgcataagctgaatggtcaaacgttgctcaggaagtcaacaacgtcacaaattaaaacatgaagggagtagtttctttgtaaaatgtatcccacactggctccggtgaaagagaagagaacgacggaacggagggtcggagaaggggagaagaagatttgagagacttggacactggagtgatgaaacggaaactgcggtggtaggagacagttgccgtcttcgtcttttccccctcttcctctctctccatttttcacccatctttagcttttcttcacttactgttaacataacagtcggttaactaatttttttcctccagtt

SEQ ID NO: 75291 - DNA, 45186 bp, Oryza sativa
gttatgcgacggccttcagcagtgtattcactataaaacaatcagaggatcatgaaacaacaaacattagactataatttcatattgaacatatacatatgctaaatgtgcaagtgaaaaaaactaataaacatcagtatggttttgctaagtgatttcctagatgatacattagtttggcaagggtgatggtggtaacttcatattcagctaataggaataaattccaccattaggtccagcattttattaggggactagtgaaacattgcacatcaacagatcatatagatttcagtcatggtatataatcagatgacacaaactctaaaacacgctcacttcagccccttctgcaagatggctcaacaaccatcattatgttgcagtatatgtttgtgatattttttgttgttaggaaatacctctctttttaagaacatagttacaacatccacatgtgcattctacaaactactaagatactgaatatgaatatttctagaactaattcaggtataatagaacattgtaatatcggggaaaacaaagtaatacatcaacacctgggaggactagtataaacttaatgcaacaattgtgaagagctagcacaaaatacatgatgcatcagtataacactcatggaaacctactgccaccatctgctaaatatctttagtcatttttacatgaccaattccctcctagctatcaactatcattctgtcctataccacaaataaataaccatataaatcatgatgaaaagagcttgtcttcccttccgcgagaaataatattcccaaacaagacaatactaactacaacgatgaacatgttactgcagcagaaatcctacaaaacagtgtgttccactgctgcagcttctttggaatcaagcgttcatatcagttgatcttagaacagacagactagtgattgcgttacaccttaagtactaaacaacaaataaaatcttcagttatattaagtatactgaattactgataagagcagcaaatgttataattatgtaacttcatgaaaccaagtctgtgtgagttaaattgaagcacacaatgggttaacaatcatgacatgagtactgaaaggatcaaaaatagcttgcactataccaactatgatgattggtagtataatacaaactcatgttatacgaaatctgcctgatgacatggaggaaagtaaccaacaaagcaacaaggtaggagcaatctggcataaggtgggcaatatttctgtacttcagttctcagaaaatcaaacaatgttttctaaatattttagctaattccaatatcagcacactgagacacaaatgtgagaaactgagctaaactaatctaagaatctaatcagaagaaaccgaaattaccctacgactgtgacaccaaaattaccctacaagaaaaaaacctggcgcggaaagtagaaaaataaatagggttgagaattggaagatttttcacatactactcagtaacgtcctcgagcaccatgttgacgtacacatcgaacccacagagagtgccgacgagctccttgtcacccttcataatcacccaaatcttggacccgatgcagcggtcaatcagctctgcacaaaccaaagcccgcaagaactgaatcaagaactcgaaccccaaaaaacaaaatctatctggaacaaagttagcaagctaggatgcgagatttataagaaactaaagcgaagcttcttccgcgcacctgaggggaggagctgggaggggttgttctgagacatggcggcggacgccctctccggcggagatcgaggtggaagcggcgacgggaagggcgcgcgcggctacggcggaggcgatgcaagagtagcggcgctgcggcggcggaggcttctgctttgggtggaggattccaactgcgaacgctgcgccctagccgactccacccacgagacgtattctccaccgtccgatcgagcaatcagccgtcgattagatatcacactttttttttcttttgctaggtttcaagcaccataggaataggtcaactttaacttccttataagtgactcgaatctaatccataaccctcaaccgtaaaatcagatagggtgactctccgaactattaaaaccagtgcaatttgattcccttcgtggttttggaaggcgattttgctgatgtggcgctgacgtggcaatgttgacatagtcttcgtcccacgtggcgcttacgtggcttagaattaaaaaaaattatttgtggaacccatatgtgattcaaacaaaaaaaatgacatgtgggaatcggctggtacgacggcgcggcgagcctccgaccaagcggctgggatgccgagaggcggagcgaccggcatcccgtagagcaccaacccattctccggcgaccctccatccgtcctcgcctgcaagagcgagtgcacacattaaaacactcttcgactgagctcgtgcagaaccgagctacgggaggatgatcaccttgatgtcctgcacaatgaacgagttcgtctccacgagcctcgagcaacctgagccgacgacgactagctccggcgagtcgtggtagtaccccaacatcaacgccgccggcgctgttccatcaatgtaaaggatcaaagcgagttatagcactgagatatagtatgtgttgtcaacaaagacgatcttaatcagagattcagagtaactaacccaaaaaacagaaggcgaggagggtgacaaagccgagcgccgccaccgccatgactgtaagtcatgtacccttcaccggcgctggactgacagcaagacgacgcgtaagagaagctatgaatccttgaacgggtcacggccaagggggattttgtggaatcggtatcttagctgatgtctcccccttttctcttcaccttctctctcgtggagcaatcgacgggcagggacggcgacagtgggtgggagccgaagcggcggcggcggtgacaggcgggagggctagggggagggcgctggagtgtgtggcgtggaagctacccccttcagcggcggggtgcgcgggggaggcgtgcgagcacgctaacatccctccggttcttctcgaaagtcggagcagggttcctccctatctctaccatcttcggcggaatcctgtcggtcaattggttgtcagccagagcaagctgctacagttccgccgctaccgtcgcttcagctctcgccggccaccaccactctagcccccgccactgccactccagcccgtgctccccgtggccgaccgaaggggggagaagagaaagagaaagaaagagagaagggaggaagaggggaggaagaagaaagagagagcaggacatgtgggtggccccacaatttttttatgtgtgtgaatgacaaacgggtcccacatatacgtttttaattcaaatgccacctaagcaccacgtcagcgaaaccgccctcaaaaccacaaagggagtcaaattacaccggttttaatagttcgggggccgagatatccggttttgcgatttatgatcatggattagatttaggtcacttttaggggagacaaagtggacttattccacgaaaataatattattgattagttgggcttattcattccaaagaaatataagttgggcctaaattcaaaagatataaattaggctcaatttcgaacagaatttattagtcggcctctctgacagccttggcccaattgaattattggacaaagcggtgggcccactgaaaacccagcccagatggccgaccaccgatgtggtgatgtggccagcaccagcacgacaccgcacctgaccaaaaagcccagtcacatccgcccatggcttaggccagcccgcgccgacgagctcctcttctcctcccatctccaccacgcgcctacccgcacgccgagctgtcgccgcgtgtgcccccgcctcgttccatcgccttcgcgtcgcgctgtgcccactaaaacaatccggccagttaacacttcacacccccgcgccctctcgtcccccttcctacgtgtccccctccctgatcaagaacggatcaccggctcggcgccccactctcttcttggatcggggagcgggagagggggaggaagaggcggcggatcagaagatttgggcggcggcggcggcggcggcggcggcggcggaggtggtgtgggtgggtgagtgagtgaggagtgatggagaaggagaggaagatggagggggagaggagggtggaggcgacgcggcggtgggtgatcgcggtggggttctgggtgcaggggttccggctgttcccatggctgggcgtcaacttcttcctcaaggacggcatgggcgtcgccgcctcctcgctgcagatcctccaggcgtccgccaacctccccatggtcgccaagccgcttctcggcctcctctccgacgccgtccccatccgcggccaccgccgcctcccctacgtcgccatcggcggtatgtatatgctcccactcccactcccactcgttcctctcctcccttccccccctgaatttcccgtcccagatccagaattcctctcacatctcaactttgcgcggaacccgtgtcgccgaattgtgatgcggaattataataatctcaaatctgttcgtcttgcctgggcgcgcctggccatccaatgcagcatttcgttagagcagtatgtgaataactgaatatgcatagcatctccatctttagcattaacctcactgcacattcttttcttgcatttgtttggaggcgcatcacctaatcctgtggcagctggcgacaatggcatcgccgcaaaggatatgctctgatgctcacggactttgtcctcttgattcttctcaccctttccctttgtttcggtttacttttcatttttgtgcataatttgtagtatctgtcagtcatcttttcccgtattaacctttgacagcaacaacttttatctaatgctccaccaaatttgtcctcctgttagtatcacacattcgcaaagcaacaagcaagtaatcccttgccaaccagctcacgcacggcatgaatatttcatctactttaggactttgggtgtggccctttcggtccactttaattaaagctgtgttgaaaaacaagcacagaggaatgtcatgatgaaattcttcaaggatgaatggatagtgaaccatctcactccaacatcacataacttgggattttatatgtgcaaattctgtgtttttatcacaaactttttgaatgccatcaagttagtttaacctcagtgaggcctttaaactctagcttgcgttaagaagtttgctaaccggaaatatgacataaggataggcccgctatggaagttcagggacctaagtggcatgttaagcaatgaacagttgaatgtaaatgactgaaccaaatagggatggacataattgacaagatcatatgcctaaggacgttgctataatttacaaaatgaagtatacaaaattgggatatgcttactgtgcattgcaatgcctttttcttcttttgcgcttgtattagactatgatactaacctgacttgttattgctatctgtgcagctctcttgcaggcaatttcatggttagcaattgccctctggccagctatttctcttccagttcttaccatttttctcctcttgagcaactttggtgcatccatatgtgaggttgccaatgatgccattgtagcagaagctgggaagcaagcaaccttgtcctcagggtcaggtcagcttcaatcctttgcttggatgtttggttcatctgctggcgctttaggaaatcttgttggtggcattgcactcagttacttttctccaaaaatcatgtttctgttttttgcaatccttctcgtgctccagttctgcactactgtggctatacctgaaagctccctccaactcccaaaggcagatactaatctatcagctgtctccagcgtccgtaagcaaatcaaagagctgtcatatgcgctgtgtatgcctgaaatattttggtcagtcatttggttttcattgtcctatgctgccataccatttctacttgggaccatgttcttctatcagactgaagtgttaagacttgactcatcagttatcggtttgtccaaggtttttggacaagtaactctattagcttggagtgtggcatacaacaagtacttcaaaacaacacctgcacagaaggttttatcagttctgcagtttcttacagcactcgtaatgctgtcagatgtactatttgttcagggaatatacagaaacttcggaataccggattccatgtacacaattgttttctcagggttgttggagggtcttatgttgttcaaggtgctgcccttcagtgttcttgttgcaaaactttgcccttctgggtgtgagggatcacttatggcttttgtcatgtctgcacttgccctcgcaactatcatcagcggttatcttggggttgcacttgctgaattcatgggagtatctggaggtgatttctcagcgctgccgacttgtctgttgattgaggctgcatgcacaatgctaccactctttttctcctcattgataaaagagaggagagaaaaggagaagaaagaagaatagaattcacctataggattcgatgaggttgtactggtgctcgttatactttacagtcatctttgggatcatatggatttgccgatagttcggtttcataatcagaacatagctggtggacacaatttaaaagactaggttcctcgagaggttttcagtgtttgtcgagaatcatgttcagtgtagatggcatatttgtacctatatttgtgttaccattcttctatagatcaagtcttgtttcatgtaactagtattctttttgtgtatgctaatctgttttttgtagatgaaacaatataaatgttttgtgcatcttaaaagtgttattggctcctacctttgtgtccacacgactaactaaaattagcacatttctttatgattcccaagttgacgagtgttgccagaagaaatgatatggtgcaagatccatcctccatctggtctgctatctgagcccttcactaccataactccataaggaacttaaggtctagctacaaactttagtcctatgaaatcctggtagtgaaactttaaagataataataacaaataccctccaatgtgtagaccatgtaacaaaaattctggttgatattaataaatttgctactgtttctacaataaatccaaacaaatcacggggaacgatcccaggggacatttgttgctgccgtgcaaaatgcaatcagccttcgctgccgagtacctgaaaatcggcaccgattggcaaatgatcgctaggatggtgaaagttgggtagccctccttggacttcggcagaatcccctcgtggtatacgaagtagactggtaggttttactgaactgccgtccgacaagaatatgtagtccagtgttcctgtaaaaccaggagtgcagttggtgaactctggctcccctccattcgcagcataaaggctgcgtaatttgatcggagcttcgtccgtagaatcggagttggctgatacgaggtagttgtatacctgcaaatgattagtgacatattatagaggtggaacaaccaagaaatttcggcggagctgggaattaaggtcaggtaatatttttcctaattggagggcctgaagttttgaatatcgttcagtaaagcatgaacctagaagaatgcagaatgtgcatatcggaagttacatcacccactatggtttgatgagtcgtttgcatacaagttcacagtatttgatattgacatcagcctacgtctatccagaatattgtactgagagtaaagttcaaaaaaacaccatgttcatagccatttgtaaacacaaaacaccatgtgatggtttcggaagtctgttaagcttgaaagaacaaaatgtagcagacgcagaccataccttgtcaccaggagttgagttgaagtcaccagcaatcatgactgaaggtttacagttaaatttattcgagataagtttctcaaactgagtaactcttgaaagaatatactttgcttgagccaattttacatcaatccattcaggatccctacaaaatcagaatagtatgaacaggggatccaatacagatatacaaaataaaacagacagatggcttaaaaaacatcttcaaaacgagaataatagagaactctggccattttacttgccaataaatatgtgtgttcgccataattaaaatatgatcacaaggatcattaagcttgaaagcggcaagtaaaccaacacagtcacgtttcaatctgaaacgtggatcatttggatctccatgcttgttattatccaccttcttgcttgcttctgaaagagcataatactgaattaacccaattaacttaggtagagcatcatactagccacagatacagcagacataaaataagtacggaatgcaattggacaaatctatgtcctagctagaatatgattaatgataaaggtccaaaggtagaatcataatagtggaggcccaaagaatttgtacttcatgagtttggatgtggagtttgaatatttgtctactttctttgttttcaagatatgacagaatagtttgtatgttgtaacttgtaagtagtttgtttagcctggctcactactttaccttttgtcgcctccaatgaaagaagtcattatgattcacaggataatatcaagttgagcagctgatccattaccttctgttggtgaagaattatttgatgtatcactatttacatgatcagtatgaacatatttttccactaaatcattgtaatgtagtacttccttctggaccagttccatgctgtaaaagtaagaatagcccaaaagggggatattgagaagttaatttgcaagtcaatcgaaacattcatgcatactataatttccattcttgtcttctcattgttaatcatcacttatttgaaacaatatggatacctttttggtttatagaatatgccacatccatcccgtttgtccccagatcgttgaatgtaaatacttgaatatccagaattctccatgtttttcttgtagaaggtatcatactcatccaactcctgagcaaaccacatattaaaaataagcagacaaaaatgttccaaagaacgaaaaaagcagacaaaaatattccaaagaagaaaaaaaagggtcaaaagtacacattaatataggtcatgactaaatattgaaacaatacaatcatatgtaatatgtaaccctcccaatatttatttctgaatgagtagaacactaattaatttgtgttgggcataatggaggaagactacataatttttttgagaaacagtaatagccaaaactttctactatccaccattgtgttgtgttttggcactaggaaccttgtgtatcaggttccaatctgtcacgttgagaacttgggattaatgctccctttatcctaggatccaatcaatgttgcagttttttcttggagggtatttttcaatccactaaatacaaacttggggaatgttacataaaccatatatagaaccaaataaggatataatatgatttaaaaacgttcacattctatatttatcaatgacaagtacatgaccacatgaaaaaaatgagttgcttaaaaagtcataagtctgtccaacctgtatgcacatgaggtcagcttcgaagctcttgagttctgatagaacagctttagaccgagttttccacctgtttctcaaacatgaggggaagcatacagtccacaaatgaatgattgaagagcagggactagaacagaaatggaaaattgtttacagtcacaaaacgaaactagcacactgatgcaccaatcctttgatagttttatactttgttcttgggctgggtctactcatggtgagaactgagaatggaactcaagtttgtccgaaaatataaatgtacaaacatcatatcgtaaagcttactgttgacaaataaatctattcgtacaacctgaatgctactaaggctgcgctcattgctgctagttgggaaccaatgtgcaatgcacacaaaacatagtatttatgtaatgtctttctttcatagtaaattatttggcattcaccgcagtgtgttgccactgctctaatgcttagtagaatcactaaagtggtcgcaagaaaatattgaaacccaaaagaattctaggaagaagcttgtcagtcaagagcttacttgagacaggcagatggagaatgcgggaaaaacgcactcttcacataaacctgcaacacagatcaaatagttagatgcagctagttttctttcctctgtgaatactgtaatccactcatcgtcaccaaagaaaataccgaaccataagcagctcaacagaacaaaacagcatattgccagcctacctgggccaagatgttgtaggaaaccagccggaactggtacccagctgcccctgtaacccaaacactaaaacagttttaatacaaattaccctgggcctgcgcgatttgcaagtaatactagcaatcaaccaccaatcaaaatcgtattactcgcttcttaagattgaccaagaaaagaaaaaacacaacctgcatcggattcggattgcgccgtggggagaggggcgaaactgggctgcgcctgggtgctcatccgccgcttgcaaattctgactcgtcggtgtcacgatccattagaacagtagaaagggggggaaggggtttggaatcggggatcagcgtgtgcttacgggacgaaggggagacgggggccgcagggaggaggggagctggggcggggacggaggcggaagagagggagggaagcttggagctttagcatcggcggattcgttgggctctccggcgccggaacacgcgcatctggccgcgaggagatggtcgcgccgccgccgccgccgccgacggctgtacggctgtggctccaccgctcaagcgttttgattcaaacctgataactgggcccgatctgtcggtgagaagcgccggtgtacagtatatttgaagtaatacccttttcttttctttttttttccttttccttttcagagatggccacggatgggataagaaaagggatttcagccaaattatgttttcgtcggcacttttaactctagtcggattggaatgtgcttgctaccaccataagttatcgagtcagtcaggacacattataaacaggtaatgaattattcatgctgcgttttcaaaagggtgatttttaaaaaactttttatacataagtaatattccctccgttactaaatatttgacatcgttgactttttcaaatatgttgaccgtttgtcttattaaaaaatttaagtaattattaattctttttctattatctaattcattgttaaatatacttatatgtagacatattgttttacatattttacagaagtttttaataagacgaatagtcaaacatgtgcttaaaatttaactgtgtcaaatatttagaaatggagggagtagtatttaactcatccatacaaataatttcccttttccctttgactattatctatttatcactcagttaaactgtgatgttagtaatttaggacacgattgtttcgatttacattaagctttgtcaatgattttgttttgtagtatacaacgtatgagattttgagccgaaagtttaatttacagtataagtatatccagacaaacacataactttgttatgtcaaagggtatcactttttgttttggattttgacatgggcaatggtggatcctaatgttctttttcttaaactcgagaaaccttaataatggataaccagttccactggctgtgttcgaccgtttgggtttccaactcatctctctcgtattccacaaacatattttttaaattgctaaataatttttttttacaaaaagtttcttgttttaaaaaataatattaatccatttttttaaaaaaagtaattacttaattaatcataagaaaatgtgccgctttgttcttaacctcacctcccgaacacagcctaagagcaagtactctaatgcttaatatgttgcccctaaaaatactatatatgattagatatgaggtggaaaaaataagtgaagaaagagaaggtgagtcacccctcatgcaaggggcaacctccccacaatgacacaaaccccaaggagatgaaagaaagaggggattagacaaacaaataaaataaaattatttgggttagtatgctggaggtagtgtagatgtggtgtgttgtttatatcacctcctatcttatagggataaaattagatgtgacaactactcttactataaaacttgcagtaagacccgttctaaactcctctaaatttcgactttcctgttttccattagcacgttccccaactgttaaacgatgtatttttttaaaaaaaagttttatataaaagttcctttaaaaattcaaatggacccatttttcaaagttatgataattataactaattagtcatatgttaattgcttgttccggttttcgtgccgcttaaaagttcatggtgtgtttagttctttgggcgtaaagtttttgaagtatacggatacatatttaaagtattaaatataaactaataacaaaacaaattacagattccgcatgtaaactacgagacgaatttattaagcctaattaatccgtcattagcaaatatttactgtagcatcacattgtcaaatcatagcgtaattatgctcaaaagattcgtcttgcaatttacatgtaaactgtgtaattagtttttttcccacatttaatgtcccatgcatgtgtccaaatatttgatgtgatgtttttggccaaaactttttgggatctaaataaggcctcagtccctatgcagaaactaactaagcctagcctaattcatagtataactttacaaattatttactattggtacgaacacatctgaatatgtgatttagcaaggcttaattgctttgctagtttgcttgctagtatggtcttagttaacttgtatatgagcttgattagctaatgaggtaaaaaaaattactccctccatcccataatataaggcgcacatgtatttcaagattcaacatttaaaacatttgaccaacacttagtgtaatatgaaataaattttatttgttaaaaattatatcattagattgagattttaatttactttcatatgattataatgttgttgctacaaaccttatatatgagaaattagaagctaaagactagttttggagatcgtgacagttttgaccatgccttatattatgggatagagggagtatgaagtattaagtactacacaagtagttgcatgcagtggagagtggagcccagacaccttcctatggtggctctgctttggttccaacgctggatctgggtgatcttgggccttgttagttgggaaaaaaaattgggtttggttgtcacatcggatatacggacacacatttgaaatattaaacatagtctaataacaaaacaaattacatattccgccaggaaactgtgagacgaatttattaagcctaattaatccgtcattagcaaatgtttactatagcaccacattgtcaaatcatggcgcaattgggcttgaaagattcgtctcgcaatttacacgcaatttgtgtaattggttttttttcctatatttaatacttcatgtctgtgtccaaacattcgatttgacagcgtgaaaatttttgttttgggaactaaacagggcattaggtcgtattagctaaaaagtgtgacgtgcttttcccgggcatattgctcatgatgtgccaatgctaccaaataaatctcactgccacaatatcactcactcaacatgtgagttcaccaccgcaaaggccattctcttccacctatatttatggctgctaccttttcgcgatattgtgtccagggttcaccgttgttattttcttctcccataagttctatgtttgttactgatcatccttccctcccatagcttactaatccttgtgcaattttgtggcacatactagaggcaatcacagtgacacttgatcaaagggtcctttttttagtgagtgtgtttttcgaaaagaacaaacggtaagtgtggctaatgtgtaatgtgagtgttgatacactgagtgcttgggaatttatgttcttttatgagaaagaatgtactaacccgtgaagtttagctcatgaaagtggatgtttttccttttagatagtggacagtttgacctttacttcaatagaagctatagtcacctattacaatgttcttaactgaatcaaatgcaaatgtacataataaagaaacatgacgagaaaacgttgtaaaactcaccaactaaacaaaaggaaatacatagcgtttagaaagccatcctattactgattctccattggaaattggtgaagatatgaaagtcattatttggggaacattttttagtagtttgctcattttcgctatgtgggttgatgaatgatgtctagaccatattctagttggttgtatgctcattttggctgtgtagtcgtggagaacgactaaaacgtgtagttagatggttgttggttttgtaacttgactgggtgttactataatgtaattcctccactaaactaatatttgaatatcttgcactagactccaaccttttggaatggtactatttcaatgaatataaagtctattgtgcttgtaatattattcaaacatatgtatcttgttgctggaatgtgacatcctggctcaattaggatttggcatgtgcgaccatgaaagatgtgtgcgcatgtttatattgctagcttagcaagagttgaacaaacttacaagggcttgtccctctaaccatatcactctcgggttaatccttttatatgaaacaagaacgaaggtgtaagtgagcctgctcatcagatgggctgggctgcgcggttttgaagagtgtgttgtacgtacactaagagggggtgtgttctcggacatttagatatgcgggtaagttggactgatagagacatcaggtcttttctttgggtgggggatgtgacattctaacccaattaggatttgtcctgtgttatccatgatttgtgtgtatatctttagtaccatatttcaattaggatctgacatgtgttacccatgagagctgtgtgtacatgtttagaaccacattactagtttagcaagggcaaagcctacttataagggctagcccctccaaccatattactcatgggttaacccttttacacgaaatgaaaacaaaaatgtaagtggggtggtatgtgtaagtgggtccgctcgtccaatgtaggttgggctgcacggttctggatggtggtctgttacatgaaatgtgattgtttcgttagaaggcactatggtatcaagatgtttttactaacgtgtggtagcaattcaaacaactaccacaacttacttccaaacattttttgtggcaatccaaacaacaaacggattgattttgtcacaccttagttgcgaaacaaacaatctaattttgcaaaaaaaatatggctagccacaacttagctaatacttaaccttagacatggaaatacatatctcaaaatcaaaatgacccgatattcgagaggtgggtgtaatatttttttatttaaggtgggggtgtattaattgttagatattaatccacgtcatttgatagccggatcatcaatcttgttctttactaaatgatggttatgttatggccaaatttgtcacaataaatattgactttgtggatttagtttctagacatggcagaactcaatctttgggaaaagacactcttaaaatgcggctatttgctatcggacacaatggtcactaaaatattaatttttggttgagtaggtgataaaaatagagtgaaatatcctcaattatgaccttcatgtgagcaaatcatagaaaaaaactgaataaattggtttgaacaaatgaactagtatcttcagatccaacacatccatctggtgcatttaatcaacaaattacttccaaacccaaagagtaatatatgctcaatcaactcattaacttcagatctgatgtgaccatggctaccacagatgcaaccattgctcacatcatggatgaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctctttccaatggatccagcctcattgcgaaattccatcttattgagctgcaattgaagcaacaaggtgatgcgtcacctataatgggcctatgggcttgtaacttcgtctgggaccccggcccaggtggggcccatgtggggtgcgccccagccaggtggagcacgaccctaggcaccctaggtcgtcctccccacccctatttatatagttaggtaccccttcagggtttcttgggttttgttagattaaagtttagccattgctacttgctagcagcgcgcgtgtcggctagaccgtccgtctacttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtagggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgttgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagattgttttggaaagatatagtagattggattggttaaaaatcagttccctttttatcccatacaccaaattcggctgccatccactccacctcctggccgagtcccactcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattttaattttgggtttagacttttacatttgagtccctgtaaattttatatttatgtttgagtccctgtaatcttacattaaggtccttgagtcagtttttgttaaaaaaaatcaagaaaaaagtgaaaaaaaggcagaaaggtgcaaaaaaaaagaaaaaaaaagccacacaaaaaaaaaacagaaaagaaaaggaaaaaaaagaaaagaagaaagaagaaagaaagaaaagagaaaatactgttatgtttgagctaaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatattttagatatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaattcgtccactttttatgctatagcagagcaaccattagtggaaccaactgctggaattcctttgtcacaagttgatttactcgctgttctttgtgataaagaagagttgtgtgataatgcttcacttattatatccattccacaactagtgaatgaacatgctatttctagtgtttctttatgtgctgattttaagcatgttgttcatattgctaatgaagtacaggaacgtgaattgctatcttctttaaatactttgggctatgttcagtttgatgatttttgtgagctcgataatttgaagaagaaattatttgctaagtctgatttgccttgtccaactactgctatttttcatatatttggcgaatctgatgatagaggaatatatttggtgcatagagtttacatatgttcagatttagaacctcctatacatgtggataaaacatgcaagctagagcgaaatgttattgctaaccaaattgtctcgagtttgccttgttttgactggaagaaacaggttgttgtaaatggactacgcaaagagcaccatatggaaaaaccgaggacggttttccgtgaagaaggggaggatgatgtgaccatggctaccacagatgcaaccattgctcacatcatggatgaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctctttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagttaggtaccccttcagggtttcttgggttttgttagattaaagtttagccattgctatttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccgcggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaagatctagtgggaaatcgagggaatcgatgatggggcgaaactcgatctttagatggtgcggtggggctgagctcgagaaccaagtagtacttgggaacgtgaacgacaacgacgtggggcttagcacgtagttggaggacgaattacgacgaaccacaatatctctcggacccacaaaccacaactgtcaactgatgatcaacttgttcttgattgagctagaggcggctggcaatttaaaattgggtgaaaatggcctaaagtgaaatttaggccctgtttgattcagcttaggattattataatatggattactatgagtaagctgaaacagacaaatagattattatgatagattattataatctataagccagattactataatctaataatctccttggaggagctttttccagattattgggtggctaaaaacccactaccctaagatgccttcaataatccagagaaacaaacaactcgtagcttattttatgttagcttattataatccagtttagagtaatctgatttaataatctagattacaataatcttaagctgcaacaaacaatcccttagtcaatactttctccgtcccaaaataaatgtagccatggttttccacgcccaacttttaccgttcgtcttatttgaaaactttttgaaaaaaaattaaaaacataagtcacgagcaaaatactattcatgttttatcatctcataataacaaaaacgctaattataaaaaaattttaaataagacggacgatcaaagttaggcgtgaaaactcatggctgcacttattttgggatggaggtagtaaaagatagcctaaatgcaaatcactcaaatttaaacgctgaaatattaaattaaattgcatggataatctacgaataattaaacaattcaaaagttttgaaaatacagcatcaaggctaattaaagcggccgaacccaacaaaacaagctagccgttctgctgtcatcagactacgccggcacgatccggtcaaaccgaaaaccaccaccaccagaggtgtccgtaccgcgcgccacagtgcctaacgaaacacggacgcagacggcagacggcagacgagacacccacaacgacaattcgaaatcaaaaaccggcgcccccgccgcgagagaccccacgccccccgcccggatccacccatccgccgcgcggccgcggacaccaaccacacgcccacccacccacccacccgaggcatcggcgggttggccgggttgctgccgcgccgcgcgtcgcgtggtgcgtgtgcgcgcgggcgggcggcaaaagcggacggggaacgtgggcgatgtatcgccgcgctccgctccgttgtgcggtcgcggtctcggtctcggactctctctcggctagtagggcggtctcggtctcggtctcgtctgccatcctgtgcctcgtgcctccacatgcggacaagtcgcgcggggtgggggcggaggagtttttcgatcggcacgacgagcgaagctacagcaccgcctgccccccaggcagctgactgctccgctggattttgtgttgcgggtggcccccaccatccccgccccggccgcgcatctgccaccatcaattatcctctcgtctcgactcacatcacctactatactacattgtactccttccctaaaaaaaacttggtttccgtgcctaatatttgaccgtccgtcttatttaaaaaaattataaaaaaaaattaaaaagacaagtcacccataaaatattaatcatgttttatcatctaacaataataaaaatacgaattataaaaaatttcatataagacgtacagttaaagttgcacacgaaaagtagggtttgtaaacagagagagtagtacacagtttacaggacgggactcttgtattacgttttcccacaatcctattaccagcgcaagcatagtactgtaccactcttacgagtgtactcctgctactacgagcgtactgtactagtcactccgtctcctaatataatataagggattttaacttgttatttgtactgtttgaccatttatcttatttaaaaaatttgtgcaaatataaaaatttaaaagttatgcttaaagtattttgggtaataaagtaagtcacagataaaataaataataatttcaattttttttgagtaagacgaatgatcaaatagtgcaaataaaatatcaaaatccctcgtattaggggatgaagggagtacactgtactagtacttcctccgttccataaaaaatcaatctaataccggatacgacatatactagtactacgaatctgaacgtagatatgttacatccgattttagattcgttttttttatagaacagagggagtatactatgtaccgctgcccttaccagcatcctcttggatttatactgacgtgaacagtgcatgaaacgatccttaattccttattgaatcaagattgtgattcacgctcataagaaccgtagtatacgtatctcatgagaaactgaacattttcgtagtgcggtagctgtaaaatttagggttaattcgatcgtaccattgcaaatttgattgactgaaaaaaaaaaccatttggtattcctttgaaatttgaattgtgccattatgttgtcttcaatcgtcagcgagctcatttttttctctaccgtatttttatatggacacgtttgcccctgcctgaatgacctaagacgtatgaataggatgatacgttagagataaaaaaaagaagctcgatggcaattcaaggcaatgtaattgcatgattcaaatttcagatgtataccgatgatggcactcaactagtttaacgaataataaagatattttttcaatcgttcaaaatcacaatgatatggatctgattaacctcaaatgtagtaagggtgtgcataaaaaagagagtaaatttgagagtagaaaaatggaaattctcggtgaaaggaagcgaggagttgtctcggagagagaggagagtgcattattgcacactcatcgtaaggctgaagtccacgaggacgccattattggtaactatccaatccaatcaaatcgaagagagagaggcattagttaattttaccgaaccctctcttctcctctctctctctctctctctgactgcctcgcaagcctcgcctcgcctcgctaggaaggaaggagagagtggttgctaggctagcagcaggagcgaggcggagcggagctactcctactagcttccctttcgcggccatccatgcgcgcacgcgcgagcgaggcgtgaaatccgagcaatgccgatggtgatggcgcgcggcctgccccgatccgctcatctgtagtagaggtgggagtggggttggtggtggtggtggtgtggtggcgcgagatgggatctggaagcagcaaggccggcgcctcgtcggcgtcatcttcgtcgtcggcgtcggcgtcggcgtcggcgtccggcggcgacgaggcgagtaaggggaatgggaaggggcagcggagggggagggggagggggagaggcctgctgcagcggctgccgagctcctcctcctcctgcttccgcggccacggcacgccgtcgcgcgacgacgcttcctcggcgtcttcgccaccgccaccgccacggccgccgcggcggccgttcgaggtaaggaggacaccgccgtcccgcgcttcctttgactgagccgggaatgctgcctgtgcaaacgtcgtgtgatgatgaagtggtgtgcgtatgcgtgcatttccatcgatggactggggctagatctcgtgtttgttgagcgattgccttgtttttcatgtcgagtcgtggttggggggagtttgtggtttccaccgttttcgctgcagagcattcgagttagtacttgggtggggatgggagattgcccaatgcgatttcactgagtgctgcatgatttggctacagtggctttgacagtgagtggagcttgatgaatagtgagagtttcctaatccatactcatagtatgaatcagtgtataatgaaattgattaaatttgttgggatcagacaagtctgttcatatgtaagcaatatgtggttttatgaattagatgccctgctaataacagaatgatgcatttgtgtgtttccagtctagcaagggagaggagaatggaagcctgccttcaatcgctcaaatggacaaatcagaagaggatgctcccacaatccctaaatctcatccaggtgaaggggcaacattgccttcatcacatataaacagggatcaggatgttgatgtattgcagaatgccactgccgtcaacaacagggtggaggtcaaccagtcaccaaatcattctgacagttcacggccacgttttggtgtcaacttcgggttgagtagagctgtcagcttgggatcatcggtagcctgctccattctctcatcggacctctccacttcagctaatcctgatggaggccatggaaatgtggacaattcttctgatgcaaacatctcccagcaaggtggtgcatcaactgctgggattgattcgactctggatatgcttagagatagtgtaaccgcacaagctagagcagcccatcaggctaggagaaatttgctagaatccgacaatgctaacttgagatattccaacagaaggatgggacctcaggaaccttttgaaggcagtgttcgattcagccgaacgttgagtgttggacgtcttcgtgacagagttcttaggaggactccattctcagatgggttattcaccccttcacttctttacgatagggcaatatggccatcaggaaatgctagtgccaggcaaaattcagcaatcatgcaaaggactaattcagagagaaattctgaactgcaattggattcttcaaccgactctgcaactctaagagaggccaataatcgggatctactggagcgcagatcagcttttcttgagaggaggaggatacgatctcaggtgatctgtgtttcaactattttgagcctttagttttcagctatacatactaatgtgtttgctttcttaacaggtccgagctctccaaagattgggcagcaggtatgaaaatctatcaggactatcaggacatgagagatcatgcatactatctggtcagcatagaacgggaaattgtaattgcagaacgagcagtcgaccaggaaattctgatgaagaaacaaacacaagagctagcatatcaagaatcgttatgttagcagaagcactttttgaggtaagtagtacaattgtttgtagttattgccgctttcttttactggagaaaaatgttaaattgcatccataattccatatggttatacacatcaggttctggatgagatccaccaacagtctgctgccttatcctcaaggccatcgttttcttcaattgggtccgttcctgctccaaaggaggttgtcgagcgtcttcctgtaaaagtatacaggagatcattaaaacaccaaactgaggaggctgcacagtaagccactgagcttgtatagaaattatttaacatttttagttcaatatttgaacttctacccatgctcaatttatagccattattatttgcccacaaagttcagagtctaaaactaaatcttgaggacaagtgaagcagaggcaagtaaaaaactgtgaatgtctagagtgattaagatcttatgtcttttaattgcataggcataagattatttgtgctatttgatcacccatcaagtgcttggatgaagacatgagcggtattgagttgctatcaacgctctatctagccacaaacacatgccatttttaagtcaacatttaagtgcatggtctatggatgcaacctttttccactgaaatttgcttttatttatttataaaattctataaaactatggtaccatgaatgtagtttatgagacatttcttcacatctacttttttactcatccaaactaaatagaactggtgttagtactcaaaagttttgatactttgactagatgttgtgatgtatcatgcgtggtccgaaattccaaattttaagctgagtataagaaagggcccatggatgctaattcttggcttctcgcaatataacagaattgctattctcttcatagggcatttgagctgctagttcatttccagcttaggctgttgcgtctgtaaatttttctactgtagaattatttagtactatcgttgaataaatctaaagaaaagtgtgtcattttgcaacttctcatcttttccttgctatgcagatgctacatttgccttgttgaatatgccgagggagactgtgtccgtattcttccatgcaatcatgaatttcatctaacatgcgtagataaatggttgaaagagatacacaggtatgatggattaatctaaataatttataatttgcataagtaaatgaacagaactgcggtcaacatgctattgttacctctttatgtcagagctctatagctgttccttgataagtgttctaacataacttgagtaaatgacagttaagaaagcaacattatgtactgaaaagacctacatgcttcgtgtttttcaggggtgcgtgtggggaattgggtgccaattctttttagactacaaaatccaatcataaacgaaaaaataattcccaaccccatgtcttcttttgcaattttgttatcttcctgttaagtgagttttcaactgaacaccatgcgatcgaatactcattttctctttgacatggttctgccagtatagtaatataggttaattacaatacaaaaagatttcaatttttcagcaaagtagatttatacatgtacgtttataaattcttagttgagatcattggttgtatagatattttaaatatttttctttgcatcaagatgtgtactcgaaatagttcttgattgccacatttgtagtactttttttttagataatggaagctttattaagactcagtcaaataaaccaagatgatacatttcaactaagcccacccccggcctctgcataaaatgcacacagccaataaaaggacgaaacatacttggcttaaatattttaaactttggtatcctaacctagatatactttctccaataaagctaagagctacgtagtagaaccatatgagtttttctctgaatttagtttctcaatttgctcaaaacatctggcttcatatatatgtgtgataagagtagatgtcaggttagcattttatattttagagctaccaagatatgccatcctgctaatatgaacataacccttttctttcagggtttgtccactttgtcgtggtgatgtctgcagatccaatgcatcaggcattggaaaaaccacatgatcttctcttctgtgagaaaaatggagcttctgacattgtttctgatccaatcccaacagaatttgtaatacacgtgtttcaggtgtaatttcacatattctttccctccttcgatcaggacaactcagagtgctccttcatgtggtggcaaatttgcatcgcagtcatccctgttataaaatcgatgaactgccatgtgaatttggaattcttgtatggcaagggaagtttgttgatattaggatttcattatacgttttctttgagtgttgtttgaacttgttgagacgatgactgtctttttagatgcatcagccaacgacaactttcaaaattgtgttgtcatgctgaagcaatcaatagatttttcatgctatatgggtttgatgaggcaaagaggcagtttgtggctacctggcagtgcaggagtatcttatgattataatgcgcttagtatcttcttaaggataaatgaagtataactcttatagtcttgttgtatacacgtatacaatcatcggctaaatgtaagtatagacaaaactgccatcagctaaatgtttattgtacaaccaaacggaggaaaacgaaaaaaatggttatatacaccaattaccatgctatgagctcatagtcttgctatatttaatctattagactcgctctaacgtggaatacaactcatgttatgattgccaaacccaacttagataaaaacttccaatttgggatgttgggcgatgccacttggattaatgcgaaaatccacgtggaatacaactcatgttatgattgccaaacccaacttagataaaaacttccaatctgtcgtcaccagcaagcacaaattgggggagggggagggagaattaaagatgggaaagaagggtattttggtttaagaaaatattttgtcaatgatgagcgtttgagagtagtaaattaacgaaaccaatctatagagtgatatattaacgagacttacattttttacaatggcataatttcaaatttctctacaaggacatgtacgtcccctaaccttctcttccctcgtcttgcactctagcggttacaatggtattgctagattacaatggtattgccgtaccctagctcctttgaggccggagcctgacattattgatgaggaatacaatttaccgcaactttaaaataggtcaaatgtacagttgacccaaaagaaaaatactgagaagatacataacgagatgagccattaacacacgattaatttaagtattaattacttaaaacttaaaaagtaaattaatatgatttttttgaagcaaatttatataactttttaaagaaactatcattcaacagtttggcccgtgaaaatgtatgaaaattttcactcgattgtatcagtagcgacgcaccctattttttagcattttgttgtttacccatatacccagtgggtatgggtaagattcggtgagggctgggctaccatgggtatgggtatgggtatgggctgccgtgggtatacccataccctctgcaacggctgatccgtacgcgaaaaggaaaagaaaaaggaaagaaaaacctaaaaaaaatagctgataattaaaagagaggaaaaaaaaaactcgccccgtcgttccctcctcagctcctctcccctcggaagtcgaaaccctaagaaacgcgtagcgaaggcgaggctcccgagagagagagagagagccatggcggtggcggcgccggggcagctgaacctcgacgagtcgccgtcgtggggctcccgcagcgtcgattgcttcgagaagctcgagcagatcggcgagggcacatacgggtaagccccgaacctatcgattctccccccaatctcaattcgatttctaatcccttgaaaaacgccgttccaatccggctgcgttgttcgtaggcaagtgtacatggcgagggagacggagacgcaggagatcgtcgcgctcaagaagatccgcatggataacgagcgcgagggcgtaagtatccgtgcccctgtttccggcgattttgtgtctctctctctttttttttggtttgattgatgtattcttcatcgttacggtatctggcgtagttccccatcactgcaatccgcgaaatcaaaatcctcaagaagctgcaccaccagaacgtcatccagctcaaggagatcgtcacctcgccaggtttaaccaatgattcgacatagtagaacatcttgtgatttactgaaaaatcatcctctgtatccagaggaattgatggatttggttaattgttgcaggaccggagagagatgagcaggggaaaccaagtacggctttttaaaagaacgataaatattgatattcttgggttgctgcatatatttttttttatgttgaagttgttatgtcgttgtatagtccatggtaacaagtacaaggggagcatttacatggtcttcgagtacatggaccatgacttgactgggttggcagataggcctgggatgcgtttcaccgtgccgcagattaaggtaaaaccatccattatgttatgatggctcttggtttgctaggaggtagttcttgatccaatgatggcaagataactggtataacctcttgtaccagtgttacatgaagcaactccttacaggccttcattattgtcacattaatcaagttctgcatcgtgatattaaaggtatacaacactaagcttcgttacattttattcatctcatagtgatcatgattttgtggtttttatgctaaaatattcctgattcaaaatctactcttgcaggatccaatctcttgatagacaatgaaggtaacttgaagctggctgattttggcctagcaagatcattttcaaatgatcataacggaaatctcactaatcgtgtgatcactttgtggtacaggtattgcagaattatgaacttgccattgaattttgcatattgtgttatggtatttagtttttgcttggatcatgctgaccatttgccaatgattttcagacctccagagttgctgctcggaagcaccaagtatggaccagcagttgacatgtggtctgtcggttgtatttttgcagagcttctcaatggaaagccaattctgccaggaaagaatgaggtacgatttcttcaggatttgagctagtaacatcactatcttaggattagcaattcatatggtaagttttttactagtcttggtatcttggagttggatgtgttctgaactaatatcttattgtgctaccgttgaggaaatttatgattctacctcatgttgaccaaaagaaatacggattctttgttgtcataatttgtttaaatgctattaacagctgtttctgtttattactatgattatcgacaaaacttatgtttaagaatgctttctgatgaagtgatgtgacttctgcatacatgtgaaagtgaaaccagagtgtatagataatggaacaaattgatagatttgtgcaatttagaaggtagaatgaaactttaggaagttccctatatttagtgtactgccttcagtcataaattaaactttgctgctgcagccaccagggaaaaacatgattcatcctgcagccctgtacacgaaaaatgatttgcacctagtgcatgctcatttactgaatttgttttagaagttgagaaatgcctttatgctttcccaagaggaacatgaacttaacacattcactgtgggtcagctttatgaatcttaatttgtttcaagacctgtggggttactttgtacatgacatgaactctgaacacggtaactccctgtctgacctagctctccctcaccttagacaaatgcaatcagtctcttgaattgtttcattgctgtcatacattcgaagcttgaatatgtaacttaatctagttaataatgcacatttgtgagtgaacttttgtcgctctgcctttttatgcagccagagcaactgagcaaaatatttgatgtttgtggcacacctgatgaatcaaactggccgggtgtcacaaaaatgccttggtacaacaatttcaagcctccccgccaactgaagagacgtgtaaaggagtactttaagcagtaagtattatactcgtattgtttgaaacttgcttggctactcttccaggttacttaacctttatttgttttcagttttgacaggcttgctctggatctgcttgaaaagatgttaacactagatccagcacaggtatattttcttcttttagtttgcttactctgttgacataggaaatgcccgtacctgcgtatttcctcagctgtcattgcatttcattactgagctgtaagttgacatgattttgcgctgttcagaggatatcagcacaagatgcacttgatgcagagtatttctggtctgatcccctaccatgtgatcctaaaaggtagtgatcatggccttctctcctgttcttgccatctaaggttgctattttggatctcttctttctttatttgatcatatccttttcatttggaataatgcagcttgccaaagtatgaatcttcacacgagttccagaccaagaaaaaacgccaacaaatgcgtcaagccgatgaagctgcgaagaggcaaaagacacaacatcctcaaccacatggccgtttgcctccaattcaacaaacaggacagccccatcctcaaatcagaccaggccagccgatgaacaacccccatgcgccgatggctgctgggccaggccatcactatgcaaaacccagagggccaggaggctcaagcaggtatccacagggtgggaaccaaggtggaggatatccgaaccgcggcggacaaggtggtggtggcagctatggaaatgccccttaccctcaacaaggtcgagggccgccgccaccgtaccctggcagtggaatggccggaacaggtggcccaaggggtggcgttggtggtggctatggaggaggatcaaattatccccagcaaggcggcccatatggtccttctggcccaggccgagggtcaaattatccccaacaaggtggttctcgcaaccagcagcagtacggaaactggcagtagtacgttacctaaactcagcaacactatgccaattgtcttaaactctgatgttgatgctaacttgtgcttaatctattctattgggcattacattttgttagagcgtgtattgccctgaatccagtaggaattgtagcaatgttgttcgttttgattaaagaatgataagagatacacaaattgagcaacaagcaaattgtcttgaattttcactagttggtttggtaattacagctattttacaagttaaaatggtactttacacgtcgaagaaattaatgtgttctattaggcattacgtttgttagagcgtgtattgcctgaatccagtagggattgtagcaatgtttttcgttttgattaaagcatgataagtcacaagttgagcaacaaacaaattgtcttgaacttttcacttgttagtttggtataattacagctatttacaagttccaatggcactctttacacgtcgaagaaactattcagattcggagtctgcttcgttggtgtagagccggccgtcgtctgctcttgcggcgtagtcgccgccgccgtcttcttgggctcaggctcgtcgacgtccttgcgctcgtagtagtgcggcgcgatctccaccagccactccggcttgagctccgtcacctgcctcatgtactccttggtcgtgagcaccagctcgtggtacaacgcccaccgcggcggcgcctgcgccaccccggagctcgggtggacgaacaccgtctgccggctcttcacggcgcggtacgacccgtccctctgcagccgcgcagcgtggcggaagtagcccgccgtgaccgccttcctgaccgcgtcgaggtcgccgccgccggcggaggagcacggcgcgatctccacccgctcaagcagcgcccccagctggtcccgcacgtcccgcgcgcgccgcatggtgcggtgctgcacgaagctctcgcggcaccactgcggcgagtagccggactccgcccacgcgttgtacacgttgagcagcgcgacgtggtcgccggcgttgccggcgtggaacgcccgccgtgcggcgtcggcgtggacccgcttgtcccttgggcggtagaagacggcgttcccggcggacagcatggccgcgatggtgatcacctcctcggagcacccgtacctctccgacgcgacgatggccttggagagcatggggtccagggggaactccgccatcctcctcccggtcttggtgagctcgccgcggctgttgagcgcgccgagggcgaagagctcctccagcgccctgagcagcgactccgccggcggcgggtccatgaagtcgaagccgacgaggtcgttgatcccgagcgccttgagcgccagcacgacgctggcgaggttgctccgctggatctccggcaccgcgtcgtcgtcgaggtcgctgacgaagttgtactccgtgtagagccggaagcactcgcccggcccggtgcgccccgaccggccggcgcgctgctccgccgacgccctcgacaccggcgccaccaacagcgactccatcccggtgcgcgggttgtacgacttcaccttgcagaaccccgggtcgaccacgtacttgatcccgtcgatggttttttacgtctcggcgatgttggtggcgagcaccaccttgcgcgcgcccgccggcgccggctcgaagatcttggcctgcagctcggcggggaggttggcgtagatggggcagatcaccagctccgccaccttgccgccgagcacccgcagccgatgcctcaggatctcctccaccgtctcgatctcctcctgccccgtgaggaacagcaggatgtcgccgccgccggggggctccgtgacgtgcagctgcagcaccgtcacgacggcggcgtcgatgtagtccgcctccggcgccacggtgtagtggatgcccacctcgaaccgccgcccggggatccggaagacgggcgccgcgtcgaagaagtcgctgaacttgtcggcgttgagcgtcgcgctggagatgagcagcttcatgtcagggcggaggcgggcgatgtccttgacgaggccgaagaggatgtcggtggcgagcgtccgctcgtgggcctcgtcgacgacgacgacgctgtagctgcccaggtcgggctcgccgaggaactcgcggaggagcatcccgtcggtcatgtacttgatcaccgtcttctccgacgtgcagtcctcgaaccggatggagtagccgacctcgtgcccgagcttgacgcccatctcctccgccaccctcgccgccacgctcatcgccgccacgcgccgcggctgcgtgcacgccaccttcttcctcccccccgccgtgtacccgacctcgtggaggtactgcggtatctgcgtcgtcttgccggagccggtctcgccgacgacgatcaggaccttgtgctcgtcgatggccttgagcaggtcgtccttgagcttgtacaccgggagagtcttcctctcgtcttgcaacgtggccttggcatccatggcctcggcatggtactcgtcggccgccgccgccgccgccgtgtcgtcgtcgtctgcaggcgcggtgcccgccatcaccgtcgacctgacgaactcgacgccgtcgtcgaacaggagctcgtactcgtcgccgcgccggccgcgatccatggatccgaactgcagcctcgacttccgtatctgctgctcctcccaggcctcctgctcggacaaggcgttcgccgtcttgccgtccctcgccgcctcagctggctcctcgtaccgccgccgcgccaccgagaacctcttctcctgatcgacgttcgcggcggcgtcgtaggcgtccggcattctgtagtagtcgtcgcgatcgtgcacgaggccgtagacttgcttcttgtgcctcatgtccctctcctcggcggccgtcagctggacgccggggaagaggaactcgtggtcgacgatctcgtcgcgcatctcctcgaccttcttctccttccgcctctgcaggtacgcgcgccgggagagcctcctgagccccgaggtgtcgttcttgtccatggcgtccgaccggcgcgcgagctcgccctgctcccgcttggtcgtcttccgatccgtcagcctcctcgtgctcgccgcgtcgcgctccctgatgttccgctcgagctgcgccctctcgatctgatcccgctccatctcttcttcctcgccggcgtcgccgtcctcctcctcgtcgtccgggctacgccgccgtcgcgcgttccgtccggcatcgtcatcgtcttcgcccacggccttcctcctgaaacgcttcctgccgccgctggagggcgacgcggaaacgccgatctcgccgtcgtcgtcgagcagcttgatggtgctctgcttcttggccatcgccgcagcctcctgcatctgcctctggtactcgctgaccccggcgtcgtcgccgccgccgccgcaactgcggggcaccctcccgtacacgtcctcggcgaacgcggcggtgtcgggggaaggcgggaacccggcgaggtcgacgagccgcgccgcgaggtcacccgcggaggcgcactcccgcgcgaggcggacgacaagccgcgccacgaggccctgggagtatccgaggagcgccatgaggcggtcggagacccacgtcctgagctggccatcatcgctcgccgccatggcctcggcctccgtagcctcgtttgcggcggcggcgcggcggtgccgcgagaggcggtatcgaagggggttacgggcttgggctttgtggtcgccggtcggtggtgcggccaaggccgctttatccgtgcgtgaccgtgtttgtgtttgacgtattcgacgtggaggtggctccgctatggcggttcgtgtcagtgctgggaaaccgggaaccgacgcaaaccgactttgagtttggcgcatgttttttttttaataaccccgagcataagtcaaatacacgtgcatacgtcacacttgtgctacacacatttgagtgcgactcaactggcgtatttgtctctggtcaaaattttggtaatgaactggtagggtgtagccagttcaaaatttatgtcactactaaattaccatttttcatatcaccgtccgtttattttattgacgggttaaaaaaacacacgcttgtgaaaatacattttggagattatggtcatgaaccgctagtgagaatcgactttcgctaacagtcacttaaaaggtccacttgtaaaaatagagtgtttttacaaacgggtctattaagtcatcgttgcgaaaaaatcaattttcattggataaagaggatcgtaaggaaaaaaaatcgacataataaaagaggagtccttgaccaatccaccagctgagtccctctccttcatcctctcccttacctctccttcctccctctcccttcagcttctgggtcatttaactttttgtcacttttaaaatgtggcaattaggaatttgttattcacaatctatgtgagccctcacatgtctatgatatgtgggtccaatagcaaatccttaattgtcacaagtaatagtggcaaatagttaaatatttctccaccttatgtaccagtctccttctccctcctcctttctagaaaattgtgatttttctatcgcaaaagaatggtttcgctggaatactatcccttcaaagtgattcattaaaatgctattctaaactaaggctgcattctatacccatggttcccaactttcctccatcgttttacgcacacacgcttttcaaactgctagacggtgtgttttttgcaaaaaaaaaattctatacgaaagttgctcaaaaaatcatattaatccatttttgaaaaaaaaatagcaaatactaaattaatcgcgtgctaatcgctactccgttttccgtgctaggaagtgaggttcccaaccctcactcccgaacacagcctaagaggtgttcactgaaatgctattttggatctttttggttagtactaatgtttttactctcttttagtttttctccggaccaaaatgccctcgcctctatgtcctcctttcgcccaggataatggctggttgacacatgctttgctctagcaaaatatattgctatatatttgtgaaacctatgcacggctcacgctccgctgcgtgatatatatatactaattgatcattaacactaatacaaaagctctagtgcactggtttgaaagtcaaacagcacttctctggttttgacacatgctttgctatagcaatatattttgctttcacattttgtacaattaaaaatggtgtgtagtccagttcagccacaagcgcgcatacacatcaagatttttctcactccaagttataaagatataatggagaagctagcttaacccataaaatttgggcatgaaaaaattgtaaaaacaaaatagaacaaatttggacagcatgtagacataatattgaatagcatgtggttcacaaaatacctcacataacaatggttcacaacataacagtagttcacaacataccagtggttcacatgcaccatggttcacaacgtaataaagacaaggacacaagggtattttggtcagaacaaaacttaaaatagagtaaaatcatttctagcaatcaaaaagatctaaaatagcatttcagtgaacacccttagtttatgatagcatttaatgaatcactttgaagggatagcattccagcgaaaccattcttttgcgatagcaaaatcacaattttctccctcctttcgcctccttccctaccggcgtcgcttggattccacaggtgtgtgcccctctcctcgtccttccccatgggtggtggtgagcttgggcgagcctcgcaggctgtatgtggtggtgactcaggcgaggcgcgcgggtgaagctagggtgaggcgtgtgggtgacagatctggtagcggcgacttggttcgatagtggattcgtcggcggacctcgcgcgaggcacatgggcggcggatccggtggcagcgactccgttcagcggcggatccgatggcatcgagtctcgcgggcggtggagctcgagctgggcatgcgggcggcggatgcgacgacgacgacgacttgtgcgggatggtggatccgatggcaaggcattagcggtagtccggtggcagcaacttgcgtgggtgggaaggtacaagcggtagttcggctgatccagtgacaacaaaccgtgctccaacgaggcgtgcgtcctctgcctctcttttttttttctcttttctatttgttctttccgttctcttccggatccatgttggtatgatgcaaatgatttgatttgtattttgtgtttgatctatggaaatgggcagggagctagggttcctaggagagcaatgatgcagatgatttgttttgttttttgtgtttgatatgtgaaagtgggcagggagttatgggggagcagggtttctaaaagttttatttttttcactgaaaatctatgttgctggcttaacctcaccatttgcaaaaatgattttcacaagtggtcggcttaacatagctgcttctggaaatcaattttcactgacattgtaggacccgctcgcgaagattgtcgattttcactggcttttgatctcacggtattaccagccgaccgactgtaaaaacctattttgaccgcctgcgaaaatcatttctattttgtagcggcttttaagtgccgctacgaaagaggcagcaatcgtagccaatcaatgccgatgtgtagtttgctatcaatatgtttggtatagcaaagaaagttaagtgttgttaaattgagtatggagcaatgggagattaaaaaaaagattgagtatgggaattatccatgctttgactctaatccaacccaatcacattatcattagagttgccaaataatcgtcatggcacattttgacacagatccaaaatggcccaacactcatctaaacaggattggaggccctagcccacaagcgccaattttttttgagaactttgacatctattcttcacgtcttgcaccatagttgttcctatttatttgagcttacatttttaataagttcataatattgtaagacgtaaagatttttagtaaccaacgcggctggaaatatgttgactcattcatcatttatcatttataaacgaaaaacccatccgaaagctaacttgatctgcaagaacaattgacttgtgaacccagaagtcaaagtagatactccaacatcgtccgaactcgtaagattttccaggatttgcagataccgacatacgtcgtttggatgaaacggttgctagggcagcttccgagaaaatcactgtaaaatagtactagcccatagctccaacgaatgatggcagtagccagatgagctagctgttgaccaacaaggttcagttgcccagattgcatcgtgctgctacgcaaatgggctgcgtgcccctcatggtgggctgcacacgttcggaatgctcatcatgaattccgaacctggaaaaagttcactttaggtacatcatcttgacgtcgagtttaacttgcatacttaaaccacaataccagatataatgcatccctaaatttacaaaaccagtgtaccaattacctgaagcagtataatacctgttttggttgacttagcgagtagatcccatatgctagcaactcactcttcttccttctccctccccctctcccctctttcccatccctcttcagaataggtggcgagagatggggagaaggaaggctattggcgggaggcagtggtagggagacgcgagctagtgagcgcgagtccgtgagcacgggagcctagaggaggaagaacacgacccttccagtccgctgcaaccatcgctcctctccaagaccgtccttctccacgctgcttgccacctctagtaggtcaccgtgcaccaccccctcccccttgtcgacaacccttttcccagccgcttgctaccctcccgttggctgcctctccctattagccgccacccttctccccaccactcaaagccctcccatcaacttctgctcaaaggcttggtgagaatctaagagaaggggaagtgagggaagaggtgggaggaggaagatttagccactgacatgtgaggcccgtgcaatataccgctctgggacctcgggcaaaccagttttataagttgagggacacgttatatccggtattgcggataaaggaaataattcaaacttgacaccaagataagagatctaaagtgaacttattccttctggactttcgctagcgttgacggctcagtaactttaatagtaaaattcatcgttttttattagcacgttttctgtactgctaaaccatgtattttgtgtaaaatttatctatataaaagtaaaacaaattaaataaacctaatttttaaatttataataattaatattcgataaattatacgttcatgggctttcacttcccgtcaaaattctaagttcaattcctcaaagcaccctcagcttattctcttctctgattttaatacaagaaaagatgacacggaacaagcatctggacgaccttggacaatgcgcagagataagggagcatcgcatcgcatctcgcaagttcacaacgcgttttggtcgatgaatcaacaggaacaggttcttccatgtacatgccgacaccgatgcacgtttttacactttgcatactctccgcgaaccagatctccccattctccccgcccacccacccgcgcgcgctgaggctgtggctgtgactgcgactgcgactgcttttccgcccggcaacgggccggggccgcgtgcgctgcggctaattaggctggcgccggacgaggcggatgtggctgctgtggcggtggtgcgcgccgtcgacggcgccgtcgtgcccgtgttgcccctcaccgtggtggtcgtcgtggtcgtcgaggtgccagctgtggcggtcgggctggacccagcggccgtcgggggcgcggaccatgcccttgttctcgtcctggcgccagcacgggggcacgcagtggtggtccttgaggaagtcgcacgccttgttcaccagcgccgggtcgcgcccgctcgccagcacgaaccgctccccgcgcccgtggtacctgcatgcaccaacgccatcgcgcacatgtacacaccgtcaccgaccgatcgatacagaaaacgcaggactagtagtagtactcggaacgatgatataacctctatccagaatacttgtcaagtttttttttaacttttaatccatcatcttatttaaaaaattatagatttattttttattttttatttactttattgtcaaaagtactttatgatttctctgtttttatatttgtattaattttttaaataaaacgaatggtcaaagaaaaaaaaaagtcaaagcaactactaatttactaatttatgacggagggacggaggtagtatatgctaatctatctatctatctatctactattatatactaaaagtccattaaacgtcctacaaacgctcctaagccgtcatgtggcatcctataaacactatcgagtcgccacgtgacaaatcataaaaaatctatctattatatacttaaaagtccattaaactttctacaaacgctcctaagccgctatatgtcatcctataaacactcttgagtcgcattgattttccgttaaatcagtggacccatatattttaaccattagatctcttccggaaaaaaaatccggtagccccatccctatcatgcgcaggtactccctctgacctctcttttcctctcctattttctaggtaactactcctattttttagctaattacaattagatctatctaagatttcctagctatgtttatctttgtaagatttgcacgtacaaaaagttccacatacgtacgtacatacgtactctcactttttttcccttgatgagatagaaaaccaaattaataattcaatacacatattaactgttaatattttaagttgtaaaaatacacattagtaaattagaaaatatttctagaaaaatacgaggaaaaaagcaaaacatctggtcatcgatttttatttaaattagtggatatgttatctcggatcattaaattaaatatattaataaccttacacctaatctctctcagcgcaccgacgagagaaaggtacttacacacagctaataaaaaaaccaaaaaatacatatataactgtaatgtgtgattaaaaaggataaaatggaaaaaaacataaatttttattccatgtatcattaaaaattacatccgcttccatctcctcctctcttttctccatgcatgtatagatgagattgtaactataattagtgatattaaattttaaagaactataactttataaacatagattatatatatcataatatatacgtaaataaattagatccataatctttggaaataaaatttattggactctgttatttcacccattatattaacaatataatataattttatttcgaaccattattttaaaaacacacggtttaaaataaaggttacagaactatgttttgtaccattaaattaccaatttatgatctatattaactaatttatacttcaattagtggactcactattttaaattatttttaataaaatattttgccatcgatttttacttaaactgacggacctattaattaattaggcagacatatctatcttacgtaaaaaaagaaaaaaaaagcttctaaagacctatcttcaatcctctgcacaacacacgtgttcatatttgccttctgcagatataacaaagcttcgtagctgaggtagctaaaagtgattgccaaagtgatcatgattgtcgataaacactacacatactaattaaatttatataatttctctcttatttcaaacaaatattattttgaagaaaacaattgaacatgtgaaaaacaaaaaaaaatagcttcaaataattgctgatatttttgcactactaaaccaagcatttgtgcactactaaaccaagcaattgtgtaggtgatttgtgccctaacataaaaagcctttaattctttaaaagtgtggaaaaatatgaacattttgaacttctacgaagggaagaacaatgcaaccgttaatctatccttaatttggttgttactaaatcatgcatcttcatgaggcgattcaatcacaataactttaaatttcttactatttatagtaatattgtacagtatgtgttcagatggtatacatattatttacttactatttacttactagatccaatagtcgacctcatataaccttgatttatcttctaagtcgataaatgatatttagacatgcccaacctataatttacctttataaggtacaatttccaaaaaaactataatatcacgttttaataatacgaatgtccacggaccacctttctagttaatatacagattgccaatggcaaaatatacgtctcagccaacgatagaaaacgacaaatattgactagaccaatgacacgccgtacgtgtgttttggtccgcctttggtagttgcagccgctggctggccggctggttgatgtggctcaggcagtcaggctcacgttggtttcgtagagtaaatggggagctatgccccccgtctggcatgacaacttgatgattgctccggtacaagggacccggtttcttgaaaactctagtatagcaccatgacagtagccacaccaccatggtgtggtagtattcattaatcaggtcgcattgtgcattgatcctaccgtattgatcaacatttattgagctgtcaaacaggctggcatcccacttaaataaacccgaccttgctgaacccccttgataggagtagacaaccttaacagaacctcaaaccgcaaactttcagcgaggcctggtttagttcctagtaacttttttttcaaacttttaacttttccatcccatcaaaactttcctacacacataaacttctaacttt

SEQ ID NO: 75292 - DNA, 15199 bp, Oryza sativa
aaactgaaaaccgagtgggtgtcggtttagcatattgttttgtttagttctttctgtcccataattgtttgggttgaattatgaattgattgggatttaaatttttgagattttgtttaccggccaagctaccgaagtactacaggatgaggtgacacatctgactgtttaccgctgaaattattctcatgggtcgtgtgatttctcccggatgcctatataggaaattgagttcaataaaaaacgatatttaatcattagcgaatgactaattaattgttaataattgtgacttaaaatataaattggagtatgatttaaaataactttcttttttaaaaaaaaaaacgagcgaaaggttgcttacaaaccttcttcctcctttgtaccgggctatacaggcatgggagaggaactatggacgagggcatgactctagttgtgtgctacctcggcgtcagcaacacgagagggagagctcgtcatctttataggccgaggaggtcggttactgggaatggatagaggaagaggacgactatgccgcgacgggtctagtgatgatgaaccgatggcaacaccggacatcggccttcaactggccaacgacatttgtttgtgcggcggcaatggcttgcaggtaacacgcaactagtgaggtgtagaagggagttggattggtggagggaaggaaaaaagaatgcatgggccaaatataagggatttctgcccatattaatagggactttgtaatttttgaagggatggtttgaatatgatttaaaagaaatgggatttgggataaattgtttagggactatatgagtttggaggatgaatttaaataaggtttcatgggctctaggggtgtttatattatttttggaatagggattcaaaggaatttaactttatggcaatgattggaggactaggacaataggattaaaaataaactaagggttttataaaaaaaaatgaaagaaatttagatgagaggctttaaatattgaaataaaacattaaatatttaggtcaaagataataaaagaagataaaaagaaaacaagatggctccaatttaaatgaaaatcaaggagggtgaaataaaaactttttcgcataattttttcttaaaattttgagtacgttacagagtaggccacacattcagctaggtgtggtaaaactaaaccaattcactatgtgcgtgattggattgagcggcatgtgtggcaagctactttatgccccattcttgatgggtcctcacttatgcttgccccaaggcttaacggtttcggaggcttagcatggcaagctctcaaacatactcaggcccggtttagtttcaaactttgaaccccaaaaacgtcacatcgtacttttctacacacacaaactttcaactttttcgtcacatcgttccaatttcaattaaacttctaattttagcgtgtaactaaacacaccctcagctcatggcgggccttgctaaggggtcggcccatgggccgacgaaactagcagataaaggagctgctaacaaaagttataatatctaatagtgatacgaatcaaatcttcccttgggcttgggtcatctggtgtttcatggagcaagtataataggagaaccgagactaaggaaagggggttagatcataggtgttacacatccagataaccataaagctttataatcccgtgcgttcacttgatctagcgatttaggggggttccctaacctcatacttattcctaactactccctccgtttcaggttataaaatattttgactttgttcaaagtcaaaatgctttaagtttaaaagtttgtagaaaaaaagtagtaacattttcaacacaagacaaatttattatgaaaatatattcaattattgatatgatgatactaatttagtattataaatattactatatttatctataaacttagttaaccttgaaatagtttgactttaaccaaagttaaaatgtcttataacctgaaacgaagtaagtaataactgtccgcttaaactcactgaatggggccttggatactccacaatccagatcattttgcccgacaccttggtctcaaaacaactatatagaccggtgcaaagtgactatttgcaactaaacgcccatctacttgttgcaaatctacttctcccaaacatcctcctctaaaaaaaatttaaatatacttatcacttgagcgctgcgaaacctacagagacttgaacgtaacgcaaacgtttgaacaggtcgaccgcaggattaaaatcgaacggtcaatactgccacgcaacaataaccaccagacaaagatcggacggccaggaaggaaccctagcacccgtggctgcctatataagaggcaatcctctcgccctaaccccctcctctctcccatctcatcccagccgccgccgccgcagcctcctcctctcgccatctcccgtcctctccttcaaggtcagcttcagatcttctcacttatccttgtttgcgcctgttcatgatcgttcgtagctgcagatctggtttggtatcgcgaggtttgggtgatttggtgcttgggcatgttgttttcgttcattttttattgtgtattcgtctcactgctgtgatcttagtttgatgtccgttgacgcgaagataaacttgatttgtccgcgaatcatgtgcgtatgttggaaattatcggtagaatcgaacgataaacttgagttactgcataatcatctacataagtggaaaactactggtagaatcggtagaaaatctgtatctagaatccataatttgttgttaaactactgctgagtagatgttgttattgtccgtgccctgttcagttgggtactgaaattctgtatctaaaatccaatccgtaaatttgtttctgtaaatttgttattgtgctactgctgagtagatggtgttattgtctgtaccctgttcggttgtgtcgattactgcgcgtctgtgtaaatctcatgctgattttgatggctattaacgttctgtggatgtccaagtgatctgatctgagatcttgcctgtgatatttatttggagttaaaaattatacagaaaattgtttctaatctttgttttattacgtagaacagtcagctacctgcttaatcaaccatgggtaaggagaagacgcacatcaacattgtggtcattggccacgtcgactctggcaagtcgaccaccacgggccatctgatctacaagcttggaggtatcgacaagcgtgtgattgagaggttcgagaaggaagccgctgagatgaacaagaggtccttcaagtacgcgtgggtgctcgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatctctagtgtttggtcttttgttatgattgttgagcctagcacttgtttgtacatattcgtgatgctattctagatacaatgaagtcgcataatctgttttattcactatgcatctaatacttcaatgtttgattcttgcatatctatcttcttttatgattgatctgcacagcacttctgtacatattcatgatgcttgtcctgaatactcttgattacatcaatgaagtagctttcatttgaacgtctagttgtttgttactttatactaagcatctatttgattggtttaagttatattttaaattatctggttgtggtgttgtacttcattttgtcatttttatcctgctggaagttgcagcccctgtcctgtttcattacatcttatctggtcactgtgtatcttatatgctgttaagtaccttttgatactcctacatctggtccctgctcttgtatatcttatatgctgttttaagtattgtttcatatgatcatatcttgtatggttatctttgtttggttgccaaccgaccccctgctgaggaaagttattgatttgttttcctttgttctgttacagatggatgccaccactcccaagtactccaaggcccgttatgatgaaatcgtgaaggaagtctcatcctacctgaagaaggtcggctacaaccctgacaagattccctttgttcccatctctgggtttgagggtgacaacatgattgagaggtccaccaaccttgactggtacaagggccccaccttgcttgaggctcttgaccagatcaacgagcccaagaggccatcagacaagcccctacgtcttccccttcaggacgtgtacaagatcggcggtattggtaccgtgcctgtgggtcgtgttgagactggtgtcctcaagcctggtatggtggtgacctttggtcccagcggtctgaccactgaggtcaagtcggttgagatgcaccacgaggctctccaggaggctcttcctggtgacaacgttgggttcaacgtgaagaacgttgccgtgaaggatctgaagcgtgggtacgtggcctctaactccaaggatgaccctgccaaggaggctgccagcttcacctcccaggtgatcatcatgaaccaccctgggcagatcggcaatggctacgccccagtgctggactgccacacctcacacattgccgtcaagtttgctgagctggtgaccaagatcgacagacgatccggcaaggagctggagaaggagcccaagttcctcaagaacggtgatgctggtatggttaagatgattcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgatcctcgttcaagtggtagttttgtgcacggccatggcactcgttgcattgaccgttattatcatatgctcgctgtgtgcactgtgtcgtttaaaactctctattttctgttcggtttaaacttgttctgagcctgattattgcccttcggctgttgtggaatgcgggtatttacattgctaattcctatgtctttattttggcttgtggcattcgcttgttctactgctattgaaaactgtaatctgtttctgttattaaaaactgaaccttttcttctgctatttgaaactgaagcgagtgggtttcaatttgctgaaatcctgctacttgctatttaaattatttatgttcaatttcgttcagtcccatatttgttggattgagtgaaaaactgactactctggtttcgcttgaattatggaactgatacgatagcacaccgtttcaatttctccggttaagttctttcattaacagtttaactctgaaattagttccgttattacaatgataacttttgatgaaaacaaacttttgctcccttcttggtaatgtttcgggaccgtgagaatccactcaatacaacaaacttttgttaaagtaaaatggtggattcgactgatttaatttcatctctaaaatggatgaattcttcaagataggtttggagtagttggtattgacctttgatgaatttaggtcaaggaatttctatttttatcactctgtatttgcgagatataaatttacaagatctatatgaatgtcaaactatttaagctctatttaaatttagatatggtttatgtccaagttctgttgaatttcaacgataactgcatagagtatgatttccctaaggtgcctaattttgtgattctaacaagttctatttcagctcattttggagctggcatctatttacttttaattttacaagttttagataaaaattaggatatttatatgctacatagtttttagaggtgtcctatgtagcataagtgccagattctaatctacagttataaagagtagccgtaacaaaatttggttgttcttaattagaacttaggatgaattccttgcgagtattacaaggctctgttcgcaagaaaaggtttccaactcaaacattacgtatggaaaacggaacagtctattagcacgtaattaattaagtatttactatttttttaaaaaaatagatcaatatgatttttttaagcaactttcataaagagactttttttttataaaaaaaacgcaccaatttaacagtttgaaaagcgtgcgcacgaaaaacgagagtagggagttgggaaacagctcttgcaaatagaacctaagtctcggtacatattatagtaattatttactacacagtacttagagggatttcccataccgaaagtgcataattttagtttacaatattaacaagcacaatttgtttaatctactgagatttgattcatcctatttggagctaaaatgaaatttctatcaatatataggctgaacatatttttcagctgaacaattaaagctttagctactttcattatattttccagattttaaaaacatcggtccacctgtaagtgagagccaatatgcaaaaatgcccctggttttcacgaggagtcaactttgcactccctcacgtagtcacgtatctatgccaggttttaaaaggagtccctatcttcttttttatatctagggggtatttagatccagggtgtaaatttttggtgtgtcatatcggtattatatagggtgtcgcatggggtattcgggcactaacaagaaaaactaattacataatccgtcagtaaacaacgagacgaatttattaaacctaattaatctgtcattagcaaatgtttaccgtagcaccacattgtcaaatcatgaagcaataaggcttaaaatattcgtctcgcaatttagtcgcaatctgtgcaattagttgttttgttagcttatatttaatacttcatgcaagtgttcaaacgttcgatttgacatagtgtaaaattttgagttaatcagatccatgctattacaaatttatctattcagaaaaataccactacaattcgtatatttatagccgtgacactgaaattttataaaattagaaccgtgccactaccgtaacgttttccttccatctcctttgttttccgtctttcttccttcttgttctcaacgacctcagctgttcttgtgctcatcatcccaaccattattccttctccaaaattgtgagcccaaatccgacatgaagacaaagccaaggccgccatcctctgtcggcacgacacgaaacccacacacctcaaaggggcggaggcgaagccgaggcgacgcggcgcggtggcgatgacgttggggagagggctccggcgagctcggtgcctcggtggagaccgagatctctcttcgcaacggggagatgctgaggacgaagaccccacggccgcgtggtggcaagtcccatcgcgccacggctgcggcaggggtgcgcggggaaggggaggtcatcatcaggggagctgtcgctgcagcatgagcatgtctcactcttctccttcctcgtcgattccctcgcgaaggcgccgctgcggtgggcggcgcgcccaccggcatactaccacgcactccgcacctgcttgttatcatgtcgtcgacgtcccagaaggcggagcggcgacggcggcacgacaaagaagaacgtgagttagtcagtggcgtgcgagtgtgataggggagcgcctgcattgtggtgctgccatgccgctgcaggggggaggtgcaggtccacgggggccgctgccgtgccgaggacgacgccctgcccaccacgcggacgccgttgaggaagaagagctcgccctcgccggccatctccatgtcctccacgagtagctcgtcatccttcacacccttcgaggagctgcaaccgcctttgcctctacctatgttgcagccgctggccacgccaatggacgctgacaaggtcgtggaggagaaggattgtggcatccctggtgttcttggtgctgtggatttcgatctgaacgagcagaggctagttgtgattaatgtgcccatggctgtaagtgatgccgaagaggtgcgcatcacggcggcggtggtggtgggcgcaaaagcgacagaggaaggcgcggtcggcagtgacgaggcggcgctaacgcgtgcaaacagccgcggcaggaggcgggggagtatctcaggagaagaagacgggagaaagaaggaagaaacggaaaaggaagggtaggggtgggcgttcggtcagaccgaaaaattcggtctcagtcttcggtcttttggccatttcggtctttgaaaactcgagaccgaattttatccaaaaaaatctcaggaccggcaaatttggtctcggttttttcggtctttctcggtcagaccgattcttttccggagatggatgcggccgacgggatggaggctggctagaggaggcggcccgcgcggcgccggcgtggtggaggctggaggcggcccgcgcggcgcagtggaggactggagggcggaggcggcgaggcggcgctggcgccggcgcggtggacggcggaggcgggaggcagcgccggcgcggtggacggccgaggcggaggcagaaggcggaggcggcgaggcggcgccggcgcggtggagaggcggcgccggcgcagtcgagggcggaggtggcgagcgtgacacgatggccgatggggatgggaggcggcgccgcgtgagggagtgggagggagtggctgtgtggtattggttgcctctagggtttagtttgttgggcttattgggcctcctaggtctattgggccacaattcggttttctcggttaattcggttaaccgagggtaatgaccgaattacccgaataaatttcggtctttcaatggctgagatagaactactaaccgaatttctcggtctcggtcttttcggtctcgatctcggtcttttcggttcggttcttcagttcggtcttattttgcccacccctaaggaaggagatagatggaaaacgtgacagcgatggcacggttttaattttataaaattagagtggcacgactacaaataaataaattgtattgatatttttctgaataggtaaatttacaatggcatagattgaattaacctaaaatttttatgtgaaaactaaacagggccttactacccaagtccatgtcccttattttatataactccaagatggccgcgggaccgcggcactggaacagcttggtggtggcgaacttcagcaaacggtgacgacggtgttcggcccacgagctaccaaaccaatacgtgcaagtgctccgtgggatcctatggacgcttactgtttgtacagtgattgacgccttgacagcgacgtttgacgacgggagcagaggatagacagacaaatgtgacacaacttagtacataactagatttattatacagtatatatcatgtctgatactagtggatcggttttttatgagacggagggagtatgtggtttaggaggtgagtcagttttaggattaaattacttttggttccaacatgtaataaggataaataagaggcgggtcaacttccaagagttgaataagtagttttttcttttgtgttaccaatttgacacattcgaaaatacggaaactaaggttaatgtttggagtgcaatcgatagtactttatctaccgagttttaatatggaaatccaaattgtcgttagggttgacctaaccgttatttttgagtttgcaaatattgggatacggtgtaacttgctataatgtcttgctgagaataaattcaacaatcactcactctcataattggggctctcgctctctctagaaagctcaagagcgtcttctcaagcgaaaagaaaaaaacttccccttccgcccagcccctttccttccattcccgatggcttttcggtcgccggcgagggagggagatggtctagctcctttcttcgctagtaggcttagatttagtcttctttgatagtcgggttaaccccattttgtatagcttgagggggtcatcggcgtccgactccttcattctggttgcttctgccatggatgtcctcgtcgacttcttctccggtgaaggttccctgtcaatcgttttacaggttcaccatcaacgcccgaagctaagagtgtggtgggtttgctcaaaagaaggtagcgccgaccacttgcttcttcttgggcgagctttccgcaactgcgttgttcttcttcctagtcttcggcgtcagctttagaagtgtggatgatgtgtttctccgtttgccttggatgcttcaacctccatagagaggcctcttttgggtttgcatctaggcatcattatttttttttagaattacacagtacaacgcaaacactcataacgcacgcacgcaaaccttacccctatgagcatcttcgaatactgggccagcaaattcttgagattgacaaagtcaccaccatctaggcatcattacatgcagctagccaaggattatcagctccggtcgtcgttcagtgcgtcgatctggtcatcgttgttgtggacatggcaaagagaataacccgattaccttttctgtttctttctaggtcctttcttgcatatttcagggttaaagtgtaatttgcccatctgtcaggggcctctatgtaagatttgctgtactcttagcttgcttaataaaaacctgaaatgataaattcaacaatgccttcgtcgtaagaccatatgcaagtaagtgcctatatgcacggagttggatagagtgatagacaacgctgacttctaataactattgcgggtggaagctatcaattttagtgtactgagttttgtttcaaattgtgttcacgcaaggaattttcatagagattgatcatacttgttttacctggccttaatcttcattttgaagtattttaatttaccccatattctttgagtatgcactagctagttgaagcttgtttttattttagggttaattggatccattccattgcaactttgacaaattaaaaaaaaattgtcactactattcgtcatatcggttacatatcactataaatctctaaaattggaaccatgcaactctcgtcaatttttctgccctcatcgacccgcccccctccctccacgaaagaaggcgcatctgctgactgctgggcaccttcgccacttgccgagatggttgcgcgcgtcaaacgtgttggcgaggacgtatgtcgggagctcgccaccgccgtcggcgccgcattcgagtgtgtcaatgagttacacaaacttggagagcacaaaggcgaaggggtcatcatcggaggtgatggcgaggaaggacgggatgtcgcggaagcgtagcagcgagagccccgagaggctcacctcggcaaacgcgtcccttgatgcggccgccgccaagagggcgtcgcgtcggccacggaagtagtggtagtacgcggccagcgtggtggttgactggaactagaacacggcgatggcaaccactctatggttgtgtgcgacgtcagctgctgcggtgcacgacggggcggccaccgccatcaccatcgccgagattcggcatcgttggcgcgccaggcggtcgttgctcatcgcgctcgtctcccttcttagggcggcacctaacacctgcgccaccaaggacatgctcgccgacctctcccgccaccaaggaagccggcgtcagggacgacactaccaccgtagtcgtcctcgccggatccttgctctgccgacgccctccacctgctcgccgtcgacgccgccctcgccatcttcaatccggctaacccggacctcctcgatctccgcggcaggggcggtgaggcagacccggtgccgccaagcgcttcgtgccattccattgcgagggtagggacaacgacggttgcggtggtgctcggaggggatggcggcggctgcactgtgcggaggaagaagaagaggcggtgtggctggctggcgcatgaaggaggcgcgctcggaggggtcggcggtggctgcgccgcaaggctgaagtagaagcggcgactacggcgggcggaggaacggtagcgccggcaggcggaaggaggaagcggcggcggttgctgctccatgtgcatcttcatgataggacgaagacggtgatgctacggagtggcacggttctaattttagaaaattgtagtgatatatgtccgatttcgtgaataatagttgtatttttctaatacggtatatttgcagtggcatggattcaattaacccattttataaaaaaaagactgtaatatattactttctgaaagcattttaagtattttattgcaagctaaatttcaaaattctcaatttggataattgggaaaaaaatgtttgaattaggccattagggtacctacttgcgctctgcgaaacctccagcgacgtaaacgtaacgcaatcgtttgaacatgctgttaccgcaggattaaaatggaacggtcgatactgccacgcaagagcaaccatcagaaaaagatcggacggccaggaaggaaccctagcacccgtgtctgcctatataagaggcaacacggcccaaaccctcgtttctcccgtctcaccctagccgccgccgcctcctcctcctctcgccttctcccgtcttctccttcgaggtcagcttccgatcttctctcttctccatgtttgcgcctgttcatgatcgttcgtagctgcagatctggtttggtaccgcgaggtttgggtgatttggttcttgggcatgttgttttcgttcattttttagtatttttttgtgtgtattcgtctcactgctatgatcttagtttgctgttcgttgaagcgacaataaacttgatttgtccgcgaatcatctgcataggttgaaaattatcggtagaatcgaacgataaacttgatttgatgtggaataatctacataagttgaaaattgtcggtagaatcagtagaaggatttgtatctacaatccgttcgcttagatctcttcctatgtttctgtatttttttattctactacggctgattagatgctgttatagtctgtagcctgttcggtccggtcgattactgcgcgtctgtgttattctcctgccgattaactgatttagcactttgatagttgtcgaagtttgaattaggtacctactttgatagatgcccaacttttttgtgtgtattcgtctcactactatgatattcgtctgctgttcgctgacgcgaagataaacttgatttgttggtcaatcggtagaattggatgatgaacttgatttgttgcataatctagacaagttgaaaaatatcggttgaattgttggaagatttgtgtctataatccgtttgcatagacctagagcttagtttctgttctgttttttattctactactgctgctgagtagatgctgttatcgtctctacctgtttcaattgggtttattactgtccgtctgtgtaattccttcactgattttgatgcccattaactatgttagcactttgttagattaagtaacctgatctgtgagcttacctgtaatatttatttgtttctaatctttgtttcattctatgccgcagttagctacctccttattcaaccatgggtaaggagaagacgcacatcaacatcgtggtcattggccacgtcgactccggcaagtcgaccaccacgggccatctgatttacaagcttggaggtatcgacaagcgtgtgatcgagaggttcgagaaggaagccgctgagatgaacaagaggtccttcaagtacgcgtgggtgcttgacaagctcaaggccgagcgtgagagaggtatcaccatcgatattgccctgtggaagttcgagaccaccaagtactactgcacggtcatcgatgcccctggtcaccgtgacttcatcaagaacatgatcacgggtacctcccaggctgactgtgccgtgctcatcattgactccaccactggtggttttgaggctggtatctccaaggatggccagacccgtgagcacgctcttcttgctttcactcttggagtgaagcagatgatctgctgctgcaacaaggtatatctctagtgttcggtcttttgttatgattgattagccttgcacaagtagcataatctgttttcttcactatgcatctaatacttcaattgttgatgcttgcatctctctactgtttgtcttattttattattgatctgcacagcacttctgtacatattcatgatgctagtcctgaatactgttgattacaacaatgaagtagcattatgtttgtatggatttatccctatatttgctttttttttatcttcactacgcttttgcgcatcttctaagactgcaattattgttgtttgcttttgttattactgtctgtcttcactatgaatccaagagtggaattgctgatggttgctgtcctgctactactagcattagtgatttacctgttcattcagatatctagttgttttttactttatgctagacttctattgaagttgcagcttgcccctgtttcattacatcttatatctggtcactacttttttgtgtatcttagatgctagtattaattttttttgtttcatatcatgtatagttagttatctgtgtttgtttgctagtccctgcccctaattcgtttgcttatttctgttacagatggatgccaccactcccaagtactccaaggcccgttatgatgaaatcgtgaaggaagtctcatcctacctgaagaaggtcggctacaatcctgacaagattcccttcgttcccatctctgggtttgagggtgacaacatgattgagaggtccaccaaccttgactggtacaagggccccaccttgcttgaggctcttgaccagatcaacgagcccaagaggccatcagacaagcccctgcgtcttccccttcaggacgtgtacaagatcggtggtattggcaccgtgcctgtgg

SEQ ID NO: 75293 - DNA, 15100 bp, Oryza sativa
ctgaccatcttctacggtgggaggatggtcgtcttcgaggacttccccgcggacaaggcggcggaggtgatgcgcatggcctcctccgggatggcggcggcgccggctcagcgggagggcgccgcgctcgcggacatgcccatcatgaggaaggcgtcgctgcagcggttcttcgccaagcgcaaggaccgcctcgcggcgaccaccccctacgcccgcccgtcgccggcggagaccaaggcctccgagccggaggagaagaagacgcccacctcatggctggacctcgccgcctccgcctccgccgccgcgcgccgtgacagcctcaccatcgcgctgtgatctgcgcggctttgaccaaaaacgacttaagacgcgcgcgcgctctcagcgcgcaagaggattgattcactttgctcatacccatggcgacgtagagtttttaccgcttttgctatacttctttgtaaaattcgatagggagattgaattgatgggaaaccccttgtgcctgttcttttttgtcccactgtatcaaatattctttcctgtgcaaattaagccaactttttagttgttacctcaacaaaaaaaattatctctctcccggttaatttttcaactagcaaaataattccaaaagaattaccactgaattactccagatcaagcaacacacaccaaaaaaattaattaggcttggtatgaaagtaaagaagccacacgtgatgaaacggggcacagcatgtggcgggaggattgcgtacgcgtcaatacacgcgacactgtgtggattggaatcgggagcaagctaatcgcttcttctcctcgtccacatttaggcgtatggcccgcccaatcgcgcgtgctgaaaattcacgtggccagatagcgagtcgtctcgacgacctgctgcgcggggtcggttccgaccacgtttctttcgcctcgagatcgacggatcatctaaccgatttgaacgcaaattttttataattttggccttcttagagcaggtacaataacatactataagccagctgcaaatatattttaataagataaatgaggagagagaaaaacagcggactacagatttatagccagctgtagcacagactccaaaacacactatgtgcatgatatgtgggaccagatattaataatgtaatatgtaactagttagctatatatactattaaacttgctcttatacatacgaattgcttttactttcttgatgtgctttgccgacacgagttacgtgccatcatgtttgggattttttttatagtggggaaagatgattacatgccgaacttaatttagtactagtacagtagtacatcattgaacgttatttggatgtgaacatttttatgtttcgtttcacatgtaggagtaggttagtttgaacgttctggcaggggctaattgatgttggatgggtcatgtttggtttttttagataaggaaagtattccttgaactttataccattgaactctacttggacgtataaatatttttatggattgtttgattcgactccaaaacttgccctaccgaatcattgataactacaaaggtaataactcttatgtatttggattgcaaccaaacatgtgccaaataaatatagtcgaggaatcttatcctacaaaaacgagagtaccgattcctgcctcgtgcaagaaatttgaacattccaacagggataatggcgccgcacacataaaatcttctcatgaatcaattctggttgaaacgaaccgctgctacaatagaaaaaaaagaagattatggtttactaaaggcatgcaatgatgattagtactttgtgtctgatggatcattgtcatgatttatttcgaagcaaacgaattagctctgccgccatgagtagtactactatcaggtactgttaatagtggcattgtccaatttctgcactgaaaacaacccataaaaggttagacagcgccactgatacacacttagaagtcaagattggatcttgcctgccagaaaaacacggcggttagggggcaaagaaatcagaattaacccccaaaaaaaatgtcaaactaggcagcatgcctaactagacacggtcgcctgcacggattcactttaatgatgatcaaaatctctctgcaaatcttcagagatcgatcgagacataataaaaacacaggtggtgcatgtttcgtccacaaggagcactgtatgtggaggagtaattaagtgttatttgttcttcgtgaaacacaaaccaaagtcaaacccatgcgtccttaaacaattaattaaactactcagactaataatactactactagcagccgatggagagctagccaaggccaaggcgacgactgcaaagtcaaaacgcttctgaagaatatgtgcaggctaatgcttgcagcttgcttccttccaagttcagatcagcttcctgcaagaaatatgcatgcatgtgtgccaccatttggacctggtcagtgagacacaggcacagcagcaggagatagtagaaacttaattcgagatagtcgaaacttaatttgctcgtgcttcctgcaaggaagcaaagatgttttcttccttatttgaaagatcaacaggtgagaattcaacgactgatgttagaaaaaacgatgacttcagctagacagctgctgtacggttgtttattaatctgggcgatggccctgatgaattttcgtctctgagaatagtactggtacgtgctccatcaatttcatattgtaaatcattttaacttttttttctatttattctttttaagtttaactaaatttatagaataatatagcaacattttcaacacaaaataaatatattatcaaaatatattcaatgttacatctaatgaaactaattttggtgctatatatgttatcaaattttcctataaacttaatcaaacctaaataaatttgattagatcaagaaaagattaaaataatttattatatgaaacggagttagtagtatactgctccaaatacgtgacaaaactgacactgtaatccagtagggccgagggaaaatatctagcagctgaaacacctcttgttggtttcggtaccagcctgagactgctagttgggttgcaaaattgcaatcaactttaggtggcgctagctgtgtcatgtgtgcgcgcgagagagagactcagagaccaattacaattacagcatgtgcaatagggaaagatcggtatggctcgggtctgggtgctttccctttcttccgacagataattttcagccacagttgcagttttttgccgagagatcgaagcaaccggccggccactatctctccctctccatctccctacctttcgtctggaaaaggatggatttgcacggtgactcggccgtgccgagccagacgagacgcgagtacgcgttacgccggtcgccgcgctcgcctctgcctcagcatttgcccgttgcctcgttgctgttcgcaccaaggctaagtttagttccaaaatttttcttccaatttttctatcacatcaaaacttttctacacacaaacttctaacttttccgtcacattgtttcaatttcaaccaaacttttaattttaacatgaactaaacacaccccaatactaccctttctccggtcaaaaacaagcatcgcacggtgatgacgggaaacggcggcaggtttccttggacgataggttgccggcacaccgcgatgtacttcttctgtcttaaaaaagacaatttttatacacgtattcagagaaacaagtggtaggagagtagcgtggcaaagcacagcgaaatattaaagctagcgagagctcaaaacaaacgtttctgttcgaagtcacagttgtacgcacatgttttaatttagcacggatgaggggagtccctttaacatgtcttgatcatctcggcatcttctgctacatggtggacaatagtgtcgttgtccatgggtcacaagggtcatatgtatgtgatatgtcccccataaaaggaaaattgaaggaatggtggaatttggttatattacgggtctcatggttatcgatattacctaataagtccaaacggcttattcagaataaaaactaatatataggtaaaacttttatatatttgttcgtatcgatttaaaaaagccaaaaaaatatgctaaaaatatcttaaaattaactcaaaaatttaagttaaaaaaatggtttttcctttgacttattaggccaaccgacgggactctaggcttaatagaaattatagaaattataggtttgtttgactgtacttcctatggctctgttcgtatgtcaaggttctcaactcctacttctcgtttttcgcgcgcacgtttttcaaactgttaaacggtgtattttttgtaaaaaaaattatatacaaaagttgcttaaaaatcatattgatctattttcttttaaaaaaataattaattaatcacatactaatagactgctatgttttccgtgccggagggatgggttctcagcccaggcaaacgaacagagccatgcctgcaactcaactagcccatacagtgacttgtgtcagcaacaacggctgcattggctgcggaacgacggccatcatgtagccgaacacgggttagggtacatttggttttgtgttagaatagatcttaccaaatgttttggtattagtgtgaagagagacatggtgcgaatgcttttggagctactgaattttggaatggttgttcgtttgtgtttctttgcagctggctgtgggtgcggccgtgcgggtgtgctgtattacagtgcaggcagtaaaaattatgttgggtttggtggtgttgttgcggctgcacagttgcagcaatctcttcggatcaaccccaaagtgtttaagcaatatttagtttgtttctttactaattatttttgctaggaatttctttactaaagtttgataatactgaaatattacaccgatactctctttcagacaaaggcatgatccagaattaacttctagctactgatgtaggtagacatggctcttctagctactgatattgctttggtaaaactgcacagaggaacaattatcaattattgggctatgttttctttccttttcagaagtcacagaccattcttgtatcgaaatggcagcccaaaataagactgggctagatttgtagggaaacggaaatctcttcctgttaccagtaataggttatattttaagcacaaatataaacttttaactgaaaaattttaagcaagagatagaaactcttttttttattatacggtaaacacataggagcactcaacattacacacacaacatcacactcacaccccacgaatgtgctccataacgcactctaatagatggaaactaacgacatatctctaatctcgctaaaattctcggcctcgtcttttcgtttatgcttatacttatcagccaaaatttgaattttcaatcttaaatctggagttgattttggggttttttttcataagtatttacttttagatcgctaagaacacgtatataaaagttttatccacaaattatttttgtttgcaaatatgccatttcgcacgtctgttgaaaactcatctacgtgtgtgtaatattaattgtttggtaaatggaatcatgcacctatgacttcagtaccacatcacttgtgctttcctagaaacttaatctgcaagtgctttctgcgaggaatcaaagatgttttcatccttatttgaaataccaaggcctggtttagtttcccactttttcttcaaacttccaatttttctatcacatcaaaacttttctacacacatataaacttccaacttttttcttcaaacttttaattttagtcaaaattccaattttagcgtggaactaaacacaccccaagttaacttacacgaatatgcatggatagtgaacgacctcagccaactgatgtatggtttgtttaatactatatgcgataacctgagtgcaagttttatagtagagatagcttctaccacctttaatctgatgcacgttatatataataaattaagaggtaatatgtactaccaatagctataatactcttatgtttttattgaagttttatgtagaggttgacccttatataaggagtagctttctctctcctccacttcaccattttttagtcttacgtgacattttgagacgtgtgattagctgctcatttacttgctttgatgaattttcgtctccgataatagcacactcgtaatctagtactagtactgaaggaatatctagcagctgaaacgtaggagtacattctgtaccaacctggccataagtgtcttctcaaatatactttcccaacttgtacttactagtatttctttacaaccttttgcacgtttcctaaactgaacaatatatttttaaaataaagttctataggaaagatgctttaaaaaaatcaaattaatccctttttaagttttttagctaatgcttaactaatacttcctccgtttcatattataagactttctagcattgctcacatttatatatactagaaaagatgcccgtgcgttgcaatggatgaagtctattttaatcttattattgttatagcaaatatgctcgtgcgctgcaatggaaaaaaataaaattataataattactatatgattagatatcgtttttataatatcagctctttaagaaaaatatattcttcaaatagacctagtaatcttatgtgcaattcataatttaccataataataataataataataataataataataataataataataataataataataataataataataataataataacagtcttcaacctaaaaattgaaagaaaaatcataagatggaaccaagaattgaggacaatctcataacggaaaacgaataggagtagagaattattgtttttagggtaactggagtctagtttaatttttcattatgaggacgatatacaaaaatcgtgtataacgtttaacgaaagcacttcggtttttagtagtgtgtgatctccaactgctctttgttagacgaaaccaggcatggtcaggacggttacttcaatcctgagaccagtcattaaatcaaaagagttatcaaggtcgaagaataaaaaagacgttttctcaaatattttatttagtggggtataggattagaaatattaatattaacgttaacagaaagtcgagtcaatctcctgttagttattaatttctctagcgaacaactgtgtatgatatcacagaagcatgaggtctccttgaaagccaggcattagtttgtgcgttaaaatatttcttgttaattatccgcctcacaccctcgatgattagtttttttttacggacctcgctgattagttgctctagacggaaacggattcgatttacatggcggggttgtttgatggggaaaacgctttgtagacgatatcagtacgaatcgaaaacggacgacatacgaaaacttgtggcaaaaacatcttaaacttttatatttatggtagtatgtgctaatccttcactttgatcctcgtgccggcggggagggtttctaatccctccaaatagctagtcgggtttcaatcaactttaggtggcgctagctgtgggagagagagacaaattacaggcagcatgtgcatcgacattctccgtgttctttgcttttcctttcgtccttccaagagatagctatgaaccacggttgcatttttgtcgaagcaactggccatttttgtcacacactcacacaccctttcggctggaaaatgattggtggcacgtacggctgcacggtggatcggcgaaccacaggagtgtcgctgctattctgttcgcaccacgcgttggataaattggattatggcttttattatctggtccaaacaaacaccactcgcacgcctgaagatgaccggaagaggcaggtttcttggacgataggtttcactacagtataccgccataccggcacaccagcaaacgtacggtctaggggtgaaaacggtacggaaacggacggaaacaacctttatcgttttcgttttcatattttttttcggaatcggaatcgaaatcggaaaccccggaaacgaaaacggaaacgaatattatcgaaaccgaaaacggagcaaaaacgaaccggcgcggatacggtaacgaaaatttatcggaatacataaacccctcaaactgagcctcacagcaaaatatattcttctataacttcaaataatttgcataacaaatattctaaaagaatacagcaaaacagaatggtataagcctataaggtatacacaattcaggtgctatactgctatcagcctatcactccaggaaatgggtttgagaacaacaacagaacatcagtccatcaacacttagttcatcaatcatcacagaacagcaatagttcatcaatcatcacagaacagcaacgcacatcagtccatcagtgtttcagtacttagttcaatcacaaaacacatcaccctataaatacatagttcatcacaaaacatagttcaatcacaaaacacatcagtacatggttcaaacatatctcatccacttgtgcagcaggagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcagtgaggaagagactgcagtggtggtgtcgtcgtcgcctcgtcggtgtggtggttgttccgtcggcggcggcggtggtggcgacggtgaaacggcgagacgcggtgggacggcgccttgagatggcggggaccgagcaggccggcggaggtgcgagatggtggcggcggccggcggcgaaacgacgaagagcaagggcggcgcgagatggtgggggcgaggacggcgggggccagccggccaggcgaccagcagtgggcggtggggcgccggcgccacgggcggtgggcgtgagggcacgccggcgccgcgatgccgcgatctggacgccgcagccgccgctccgcctccaactcgcgagtcgcgtctgagttctgagtctgacggtctctctcctatagggttagccggttagggtagatgccgccgcgatttgggttgggctgggaagctagggataaattatggactattgaatctatgggatttttaacttcggaaattccgacaatttttccggaatgtttccgatcgtttccgggttccgacggaaactgcttttatcatattcgattccgtttccgagaaaatatttccgttttcgattccgattccgagaaattccgaaaaaattccgaccggccgattccgtttccgaaaacatgaccggaatccggaaaaattccgtactgttttcacccctagtacggtcccatcgttagcttattcgtggaataagccaaacgatatatttgtaaacgaaaaataatttatgaataaaatttttatatatgtgttcttagcaatctaaaaacaaagactgaaaaataaatttcgataaaaaaactcaaaattagcttcaaatttaatgtttatttaatgttaaaaatttaaattttagctactaaacataaacataaacgaaaagatgagacctgtagacacgtagtgcaatagcaagacctattgttgattatgtgttagcaataaaaaataatttaacgataatttttttatatatgttcttaggtatttaaaaataaatattttaagataaactatgattaaaaatcacaataatcaactagaaaatttacttttaaaatatatttattttattaaaaaataaatttaaatttagaattataagtataatcaaaacaacgagctgatactatagtagtagcatagcactagtaacatccgaagcacaacgagaaataatttaaaggggtagagataaatctggtgagagctcaaatcggcgtccccatttgacgcacagttaaaacgcacatgtttgaattcaacacttgccgagttgattcccctgcacatcacgtcatctcggcatcttctactgctacatggtgaacgaaagcgttgttgtccatgggccatggcacaggggcgtctgtgatatgggatatttcccccaggaaaaggtaccctgtacgaaatgaagacattggttttgtgacagtggtaacaagggtatgcttagtttcgtgctaaaataagtctaaccataatttaggagtggtatttaagtgtgaatggttctggagttactgaactttagaatggtcgaattgtttaagttttgtttagtttgttttagtatttactaagaagtttgatattaccgaaatttgataacgttacaagcttacaaatggcaatgaatcaaaggcgctattactatttttttatatatggcgtaggcttttgtacaattgtgcgggatactagttagctattcagtcatggcttatttttgagaaaatctaagttttggcatccacaagtgtcaacctcttctccttttttttttctattaacgagtgtaatatctacaaaagtacaaagtttgtctataaaatgccactaccgtcatatttgtcgtctttccatccatacttccatagcgttttattagcccatgtggaaagatcattttgcttttgtgcttggactcaccttgccactcggctttatggtggagctgtgcatccaacgattcgattgtgttgatcccatctagattcgcgcggtcatggtaactgagggcaacggaaaccttatggtttgtcgatatgcgaggacatataggcagctggtggcctaaggggaattgaaccagtggcaatgccttgggtaaggatgagccgattgcccaaggaggatgaggtggaggtgggagtgcgcattgaggataagccactgatgacgtcttatgcgaggttgagcttgtcgtggcggccagagaaaggacgcaacggaggtgtctggtgaaggaatcgaggacaagccggcggtgggcaaggagacgtggcaccactaaaataaaatcgtttgtataatggtatttggtaaaactcgatggtgaaatgtagaattagtagatgtttctggatagcaaaatgttacaggcttcaatgaaagagagacccaaaataagatcgggctagatttgtggtacaacgagaagtcccacaaagctgaattcatcaaggaatgggttggattttaaacagcaatattataggcttttggattgaaaatatttcttggattagcccaaacctaacaagcccaataaggctgtgggctagattttctatccaaacacatgggctagttttaagcatcgccattgctgtcctttcagttgtagaggctcgtgctccgcttgattcccccttcctctttccggccatcccactgccccttcccagcctcctcctctcgccgccggctagaagcgccgatagctgccgtcctccgtcacttcctgctccggtcgcgttcgtaccatcgtgttactcccgtgtatgcccgttccagccgttcgggacaccatgcgcaccacctgtttgcgggattgtctagccaagctgttgcgccgcgggggccagcgccagggccagagctgattctgctgccccacacagttatctttcgcgcgggggatgacgcggagccgcaacgtgaggcaacggagcaagaaaaagcgggtgcacgcgctcgaggtggccacggagcggtggaaggtgctcaccaaggtgctcgccgtcgtcgacgcgctcaagaaggaggaggagcacgtcaccccgctcaagcgcctcgagatcctgcgcccgcagcttgggctcaccaagcccaacaaggtcgcccacttcgtgagccgctcgccgcagctcttcgaggtctgccgcgacagccgcggcgtcatgtgggcgggcctctcgccgcaggccgaggcgctcatcgaggaggaggcgcgcctgctggaggatcactcgcgcacggccgctgagtacgtcaccaggctgctgatgatgtcggtggaccgtcgtctggctatcgacaagattgcacatttcaggcgcgacatggggcttcctcatgatttcaagacacgatgggttcacatgttccccgagcagttcagggtggtcaggttggaggatggcgattacctggagcttgtctcttggaacccaaactgggcagtcaccgagctcgagaaaaagacagcagcattgactggtgatgcaaatgctaacggcattggcagtccaccaggagagctctcactatcattccccatgaagttcccaccaaattttacaagttactacaaattctacggaaaagttcatcattatgtgaaaaaagggaataccgagcagtttcagaagacaacatacctatatccttattcagaggcaagaggattgactcctggctcgcctgaatttgataagagggcagttgctgtgatgcacgaggtactgaacttcacgttggaaaagaggctggtgattgatcacctcacatatttctgtcgtgagtttgttatgccgcagaagttgatgaggctgcttctgaagcattatggcatcttttatgtgtatgagagggggaagcggtttagcgtgttcttgacgaagtcttatgatgggacaaaattgatagagaagtgcccactggtgaggtggaaggaaaaagttcttcaacttaccagctatagagggaggatcaagaatcttggtaaatttgccgagttgtttgattcagaggactatttgtttggtaatgatgatagtagcagtgctactgattctatattggatgtcaaaagtgaagattcagatgatatcatggatgatggcgctcttgcagatgatactgagatggatgtaggggatctaagtgattgttgcatagagtgaataagtgacatccattaatttaaagagcagtttttgatatttgttccctaacaatcaagctccaaaagtaaattcttgtgatcctagggcaatggttatattctcttactccctcgctcatggcatatttggattctttatattaacccggggcttaaatagaaactcttgctgattggatatgtacttcttgcttattgctaaaaatataaaccatgcgtactttatgtttatgtagatcagttggttcttccttttttattcacagaagatgatatttgcaaaaaattgtgccaaagcattatatattgaagttatgaaacgtcaagcaagatttgttttaacagtaatcgctatgtctgaattcagttttctagccttccagttggtgatggattcaatattcagataagtacatcgctactatttgtcatcggctatttgaaagctttatttacacatagttaactgtgtgctgtaagaagggaatatttttgtttatggtgtcataataagacttccaaaagggttttgaagaagctgaacagccggccaacgtggaagtgtggaacttgaactctagtgctcggtaagaaattctgtttggataatttctagagactcaaaagagatcatactgtagtacggagtacataattttattgacagagattttgtagatgttgccactttttttaaaaaacttggtcaaactttaaaaagtttgactctaagataaaccaaaattgcgttataatatgaaatggagggagtagttactccagtaaattagttatttgctctaggtgctattaattttcgtatgtgctttattaagtgttctttgtggctgctgttttttttaagaaaagaacattccgtagcccattagatgtgtttcaggagtaactggattgtctatgtttgtcttgttcttttataaggtctaaggtttgtaccgaggtaaaaaaggataaagtacaagtcttcctgctgacataagtgataatacctgataatgctctgttttgtcttcctgctaacataatccattcttacattggccagcaattctactgatgactttaaaatagtgtcagaatttttaacgtactgtatgtctgtactgctcatttcttgccaaaaacttgaaaatctagcaacttgtgtatatgatgaaactaggtcccagttacattccttcatgtattatttggtggtggtggtgcttctgctgctgtatgcagtagaaaagaaatatactatctacctggtcgtcttttgataacaacattaaggaaggcgaataatattccttgcagcatgtactccatttttaatatgctattttagaagattttactagagggaatattgtttatttatcttaacactagcttcaagatgacaaattgctgtagaatgcattctgcttatttccactgatgatttacagatttaacattgaaaaattcattcctgttcacaaacagttacgccgtgtttagttccaaaataattcttcaaacttccaacttttccatcacatcaaaactttcctacacacacaaattttcaacttttccgtcacatcgttccaatttcaaccaaacttccaattttagtgtgaactaaacacaatcttaatatttcacttgagcgttcagtgaccaaaagtgaccagtctattgggagatccatcacctctgctacaaacaagctcacatggctatcagaggaagggcttaatgctaccacatgggggcatggtgtcacatttatttcctggatggttgcaaccatgaatgttcttactgcactagagatctcccatacagccaaccggccatacgagattctctctcattttttggtcgaaaaatatgggatgctcatttggacggag

SEQ ID NO: 75294 - DNA, 14946 bp, Oryza sativa
aaagtcaatggcgtcaaatattttaaaacggagggagtaatttatatcctatatatagttaatcatcagaatcttttttgttcggtaaacaatggaactctatatgcattggtgttgcatgcagaagacgtagctttcatggtctggaaaagtgtgaattgctggaaatacatttttttgctgagagagaagtccaaaatgttctaaacaacattgatatatatagagagaatgagagtttttttaaactaaatatatatagggtatctagcaatctttttattgtgtaggaagaagataattaacaaatatatatactagcactatacattatctatctagcaaattttgctgctggacactcaaaatttatttaatttgctgatagacattgaaaaacgtgtcatagctaaaagttatctttaaaagtggtaatttgctagatgatacttttagcttaattagagagagaaattatttaaaaatatgagaatgcacttagggtcaaaagcttctaactcttgaggctgtagtaaagtaggcatatttttttttgcatgtttgacatttagtatttttctcactactttttgtttcatgggttttgtgtcctagttagcaaatatgtgccacgccaagttgacaaacatattaactacttcctccgtttaacattacccatattcatatagatgttattgaatctatacatatgtatatgtgtctagattcattaacatcaaaatgaatatggataatgctaaaaagtcttacattgttaaacggagggagtataaaatttgttctaacgactttcccttgtaaaaaaatgtaggcatccaatggaaaaataaaatgcagaacagattgaaagcacttgtgatcaaatcaaaaccttgcaagaaaagctgcaggcttgccgctgctctgttcagtttgttgcttccatactgcggtgacagggaaagaatagtcagcgttaggcttccatagctgctactgctggtaatactgcctcccaaattaagatcgcaactgactcaacgtttaaccgtccatcttatttaaaaaaataattagtaattttattgttatataagatgataaaacataaatagtaatttatatgtgactaatttattttaatttttttcataaatccaccacacacttaaaataggacgtgctagtagacaacttgtccatggcagccaaaaggacaaaagacatagaaagctgtccgtttcacttgcaggagggtgacagggaagatatagccataggcatgcaaccaaatttgcccaagcacattgcatatatgcatgggtccctttcggtttattccggtccaaagctaccgatcgatctcttgctctctctctctctcttggcttggagacgagacgacgagacgttcaataattctcctgatcgagatgatcaacagatcgaataatggagagttctccccttgaacgagacaaggtcgtcgttcccgtgtctcgaatctgtacatgccgagaggaaaaccagtaaaaatctttgacgaccaagccccgggcgatccagatcgaccgaccgaccgaatgaaataacgaaagcgatacgagtaatttttactgtgtcgatcgtatgcgtatcgtaactgttctcttgatcgatcagctatattttacttgtcggaatttgttgaaagatccagcaatcgcgggcctttttcacgcttgccagattaatcctagctaaatatgtgtcaacaagattacagatcgattgttcctcactaacactttttcttcgttataatatagagttagtaatacatgtcattttggataatggtgagatcaaactttaattttttttaaatttggttagtaaaagtaatttctaaaattttatcttaaaaatgtacagaccatatgtatatattaaaaagtacttcaccaaaaatcatatgtttgttgatatttttatttatattataataaaaagtagtggtaaaagttatttttaagaccgcacctttattcaaaacgatgataatttatcaaacctggagggagtacaaggagtctgaggctttaaaatttatcatataataaggacttttatagctgatgcactctcccaagcatggattaattagtctgaaactaaccaacaactaatgaattagaagtagcttcctattaatgagggaaattatggacttttgccttttcctatttaatttgtaagctatataattttgaatggaaggagtaacatgattattttatttttttttcatgtttttaatcaaagagcaaacatatattaccttccgatattaattcatatttcctttgtttttaatatatgatggcatcgatttttatacatgtttaacaattacctaagtattccctccgtttctaaatatttgatactgttgactttttagcacatgtttgaccgttcgtcttattaaaaaaattgtgaaatatgtaaaactatatgtatacatgaaagtatatttaacaatgaatcaaatgatatgaaaagaattaataattacttgatttttttaataagacaaatggtcaaatatatttaaaaaagtcaacagcgtcaaatatttagaaacagatagagtatcatttattttgttgtgtcttttttttatttttaaaaggactttaaacatgaattatattctttatatttgtaaaaattaaagacgaatgattaaataaatgtatgttcaaaagttattggtactatacattaaaaaagggaatagtattttcctggtattcataccataaggacaacaaaacaactcccatgatattttcttttctcaaataactaacaaagcctcatgcctaatctctttatcataagctacctggatctaggtagtttctcttttcatgttattgggaatatttgaccgattttcttgatagctacttatggacatgtgctcaaaggatgtaataaatatgatttttttttaaaaaaaaaagatgaattcacagtaactatttctagtggcgtaaaaaaaagattttacttgcatgaaaagacatggtttgaagagagagctctggccatgcagcaaggacgagccaatcagccaatggtatatgctgcaaaaagtcaaacgcatgcatgggccccagttgtcagtggcatatgcatgacctctaatttatatggtttattttttccctcgtaatatttcccaacattttctgtgtcacgtaggggaagctgcttagccagcctcagctcacatgcttaaaccctcgcctcttctccctataaatacacaccctaaccttcttctccctcccacccacacatcattcttcatcccccaccctaaaactcaactactcatcctctagctctcagctgctacgatcgatcgccattgctagctagctctagctcagagcacgtagaaacacttgccatggcggcggcgcagcagcagcagcagaaggaggggggcgcgaggcgcacgagggaggaggtgccggcggtggggagggtggcgatcatcggcggcgggatcagcgggctggcggcggcgaagcagctggcggcgcacgacccggtggtgttcgaggcgacgccgcacatcggcggggtgtggaagcactgcgcgtaccggtcgacgcggctgcagacgccgcggccggactacgagttctccgacatggcgtggcccaaccgcgacgacccctcgttccccacccacgtcgagatcgtcgactacctcgaggactacgccgacaggttcggcctctggcgctacatcgcgctccgctccaaggtcgtcggcgtcaagttcctcggcggcccctccgccggattcaccgagctctggagcggctccggcgagcccctccagggcaagcccatgtgggagctcgccgtctcctccaccgacgaccccgactccgacgacgtccaggtaaattaacatactcctcccctaccataggccggtctggccgattgtattgtgtaacaaaaacgtaactctattactctaatatattgacgtgcaataattcttttgcacgttcgcgaaaaaacgtctaggtaaacataccatgttaattctcacacacctagagcttgatttccggtcatggtgatcgatggattgggtcgatatgatgcagttgtacaagttcgagttcgtggtgatgtgcacggggaagtacggcgacgtggcgaggatgccggtgttcccgccggggaagggaccggaggtgttcaaggggaaggtgatgcattcgctggactactgcaagctcaacgagcaggagaccgtcgagctcatgagaggcaagaaggtcgtcgtcgttggctacaagaagagtgctattgatctagcccttgaatgcgccgaggccaaccaaggtaaaaaaaaatttaaaaaaataatttactcaccatcgatcgttgaatattcgtctcagtaaaaagctcgatcaatatgcatggatgttctatgtatttaccgttgtagattaggtgcaaattctcacaaagacaaaaccatttttgttcttaataaatgactatgtatgtattgagtatctaggaaattaacatgcatgtataactagctaggcgcagtcagatgagctatcatgcatgcatgaacgcggagattaacaagtaaatcatagaaaaagaagattcatgcatgccaagttcacacataactaactccaaaggaattacatatttatatcgtggaaacgtccaatcatttgatgaacttgggacggaattaatattgtacacttgcatggtatagtagtagtattaatttgcatacccaatttggtgacatgcatgtaacgccgtgacagcaacctgtcctaacgaaattcaggagacccaatcttagttagctctgacaccctgtttcagaaaaggtcactcttgtcttgatccgtcgtacactccatctagaattttatttctttttatgccacatgtagccaagcctcctcttgctctatacaggttcaaagtacgctaaacacaacacatacgcatatatgctctgacttttcaagctgaagtgttttatatgctagctacgcgttccacttgtcaatctcttttttctactctgaaactgcgcagagatgatcactccaacattttgactgtgtacttgaccatatcaaagtgctagcttagtatattaattccttttgtttggccatcaagttagtaattaattccaagttgatcatgcagcaacaaaaactatctgtcattaattctgaagaattattaatcctttaatttcaagcttgttcagttctgattgattggtttggttgcaggtgagggagggcagccgtgcacgatgctggtgaggaccctgcattgggtggtgccatcctactcaatctggggcttgcccttcttcctcttctactccactcgcttctcccagctcttctacgagaggcccaaccagggcatcttcagatcactcctctgccgcctcatgaccccattggtatgtacatactcactcgatctactcatttcacgtgaacatcttatcagaaattaagttcagaatgtgcatgctcaagactttgacaatattattttgtttgtagtagctagctagcttgtcagcatcataatttaccatgtttttttttgggagagcagaaggctggggtgtccaagttcatcgagtcgtacctgtcatggaagcttccactgagcaggtacgggttgaggccggatcacccgttcgtggaggactacgcgagctgccagatggccatcctgccggacggcttcttcgacatggccgaccgcgacctgatccgtttccggcgctccgccggcggctggtgcttctccgagaacggcgtcgtcctcgacgacggcacccacgtcgacgccgacctcgtcttcctcgccaccggcttcgagggcaaggacaagctccgctccgtcctccccgagcccttccgcggcctcgtcgtcaacaaatcctccatgatgcccctctaccggtacccacatgttaaccaaccaattacaccgcagacgcacacgcacaattagctaatggatgagtgttttttttttgtgtgtgtagggggacgatacatccgctgataccgaacatggcgttcgtggggtacgtggagagcgtgtcgaacctgcacacgtcggagctgaggtgcaggtggctggcggggctgctgggggggaggttcgcgctgccggcggtggaggagatggtgaggcacgtcgacggcgagacggaggcgatgcggcggacgacgcggttctaccgccgccactgcatctccacctacagcatccacgacagcgacgccatgtgcgccgacctcggctcccgcgtccaccgcaagtccaacttcctcgccgagctcttcgccccctacaacaaccaggactacaaggaagagtagccaatcctggccgtccatccttcccgtacaccgaatcaagataccgttaattcagtcgtataaaatgatataataagattcgttatttgtttataaaagtaattaagttaattgattattaagggctgattaattaattgttagttaataataatggaggactagcttaggtcgtgttcatgtgtcatgtgaactggggaattgatttggtgaggactcgaactacgatctggtctcggccgcgaccgggagaggaatcaaatcatatccaagaacgggaccatgtaagttaggtccgtatgtacgatctgtacgatcgatgtgtgcatgatcaaaggtggtttttccaaacctcttaatttgtaatcattcttttttgtctgatgatgaaattcaataaaattcatttattgtctgaaatcgtatccgcctgtttcgatcgcttctgtacgtgtgaatttcatggatcagccatatactgttctgttttatatttcttacattggttaaattcaaggataaatttattagtttgttcaatatttatgaatgatctgggagtatgattggtttttaatcaaatgcaaatggcaaccaacagccaagaaaacaattcatggcattttgaacttttccacgggtcaagtcaatagcttctaagatgcatatatgatacctaaaatacaaaccaaccaagtcaaaatggtcaaacagtcgatactatgtatacaaactactagagtagcacttaactaagagttgaccacaataatgctagcttcaattagtcggtacttggtagttatatgtttttttttccttctgtaaatattttatagttctctccctttcgggttgttgcaccatagtcagatgttaaggaagttatatatatatatatatatatatatatatatatatcatctattctaggcaggtttcatgaatgtatatatacaccatgtttttcttttcttttttttttcaagttgcccgttcatgttgtggcgtcaatcggtcatgattttgaccaccaataatctgcatatgtagctatcagatggtaaatttttaggcagtttaattagtcgttttggcctctgaaaaggcaagcagctaagcttctcatcgtttactgtatggagataaaccgtaaaagaaaagtaactaaaaataatttatgagtacaccttttacatatgtgtttcttagtaatttaaaagtcaatactgaaaatgaactaagatgaaaaaactttaaaatgaactctaataccatgttttaaaatttaatttttggctgtgggagatgcatgcactgaacgaccgttccataattaatttacgcacataaccgaacacatcatcttgcaaacccattacttacattattccgtttatttttgttttttattgtcacaatcttgtctctggattgtgatttttcaggagttggattcttaaaatctgattgtgaattcagattttgaaacatgcgaaatgtgcaatttatataatacttctagtgatagttttagatcaacatcatcaccccacaaaagcagcttcattgctaacttttggtttttattagaaaccatgcctcgtttctacgaatctgctttcagaatcaagctatttgcttttgcttttgattgtcaagcggtgaaacaacaatatggtacgcccccggtgttttgccacgccttaattatgacaaaagtcacaaaacccttgtcacgtcagtcaagtcggcatgatgaaacaaaattaggcatgttgttttgttattctagcctagctgttgtggccaaaagattagttttggaagttttggtatatagtttattttaaaaaataaaaatttaaaaggttcaatagataaaaaaatataattatgggcattatatgtgtatttagacactcagaacatctacttaattccaatacaatgcatatttcctcttttttttccatgattaattaatgttgcgtacgtgtaaatagttacctttaactttgtacgtcaacaatatattgtggatacaactaagaggagaaactttgaacaggagccatatcattggagcctaccaccgttgctaagtcaaattcaagcaaatatttcgtgaaactcgttgcaagtgatgtggataccaagataattagtaaatcggttagccgataatggctaaacatatgagagcccaacaactaagtactccaatggttgtatatatatacacccccgttggtgtagaagccattcccattatccaaaaaaaaaacaagtaagtactccaacttatgaatgtcaaaatatttcctatctatcttatcctagcaacaggtgttatgctagagatctgaaaaaccgttttaattcatctaattgtacgataaatcttgagctttttgtttaatttctgaaatggaaataaaacgtgagttatagaaaaactatattttgtaggctagttgtaccgtttcatcagcaatgcatgcaattgacatttatagttccagtgatgaattaaactgcaacacctttgttttctaaatagatggcttcgttaatttttagattaatatttgactattcatattatttaaaagtttagtgcaaatataaaaactttttttataaatcatgcttaaagtttctataataataaagtaattagtgccaacaaaataaataagacctatataaatttattttaataagataagtgttgaaaccctatgctaaaaaccaacgataccatctaaaaaaaagaagtatgtactactatcctgtatttgtaaaatatatatttagctagctagggaatgagccctagaaataggatagaaactgcgtcgaaattaagatgcatgaatgccatcctacatttggaagaaatgatgaaatacgtacatgcgtacgacgtagccgtataaggtagtagaagttatagttaagctaaatgttgtttatttaaggtagttctgagaaaataatgtacgtaaaggaggaagatcgatgtaccttcgtagaaattttgcaacatgaatcctctaggtaggttagttaggtcgacgctggtggtacgtgaatttcctgcatatatattttcttccgttccattaatttcaaaactggtcctaataaattattgtttctatcttcaattcgatccatgttgcactcaaattaattaataaactgcaactttttccaaagcttggaattcaagatttgctcacgtcaaggattcaacacgcgaacgaaagaattaatgtttccattttcaaaacttgcacgaacgacgacgaaaccatatgcttgtatatacagctgaaacgcagtagctagtggcgtctggactttaatttgatcaaccgaaagaccaagactagtagtactattacgcacgagagagaactaacacaacacattatattaattaatccaatcgtatatatgcaacggccggttcgtcgtcgtctccgttgggtttatttgatttcaattcgtccgagaccgatcgatcgagccgctcccacggtacgtggtccggtcggtcgtccggtccaggttgagttttcactcctggtctggtccgtacgtgcgtgcgcatgtacgcgtttggtatgtcgcttttgaacactgtactagtgctatatatatatcctgcacgtgcctgatatatacatgggtcgcgcgcattaatgaacccgacgacacgcgcgcgcatcatctgtgacgtacgtgttcgtgtgaatagctcgctgttcgtggccaaggcgccaacaaccacacgtacgtcgacgtcggtcggcttaattcccaccagcagccgatcgtgcagtgcagagacgtacagcgcagtgtgacagtcgtagctagtagagaaggagaagaaaactgaaaacggccgagcgagcgaggcgagccatcgacgtctcgctgcatggtccctcgacgcgtaccggtgtaccacccacacacgccgcagcaaccaaatcggcctgggagttgagcagcgtacgtgtcctcccgcggatgtctacaccggccggccacgtacatcgccgtcgtcgctgcgcgaccgctcgctgggccgcgcgtccatatcatcccaccgcgacgggctccgatccacttccactccatctcccggctcgacatcctcctccgatccgacccgggcctcgcctcgcgcgcgaccccgcgattccgccgcttcgcgcgggccgttcgctaagttttcttcacacggcctgtacgtctcggggacgcgcaaaaggaaaaagtacaccgaaggtccctcaacttgtcctcgagatacaaaaccagatatcccacgtcccttaactaatcaaaaccggtcacaaaagtcactcggcggttttgaccccggttttatcctacgtggctgctgagtcagcgtgggacccacgtggaccccacatgtcagcttgggccacgtcagcctcctctatctttcccctattctctcccttccgcatctgtctcactcttcccttctcttcttaggtaagcagcgttgctggcactgccggggaggagaccgccggggcgaggcgggatcagccggaatgctgagctcgtccgcatccttgccaccgtcgccgccgggatcctcctcagcgccgcctcgatgctcgcgttctgaccgccggcaacgacgtcggtgtgggggatggacaccgaatagctccggtagtccgttccctcggcaggtgccaagtgtacttggtgtacgccgacgctgggtggaggaacaccgggatgtagccggcgagcatggagtcgaacgtcgacttgcgggtataggagtcgccacgcggctggatgcagaacacgcggaattgaggagctccatgatccgccccggcgagtttccgaagtgggtgcaggacggcgacgcgtgcactgctcgatgatctgggcgcgcacggtcttggtgctcccggggcgcggcgcgccggcgaacgcccagagccaccggcggtcgcgccgccgcatgcggtcctaccaccggagcacgtcggcgtctaacaaaagtttatctctaactctacaaaaacacgcacgtatgccttcacgcaaaacccatccaaccgcagcctgcggcgtgtatgggcctccatctgcctccatctccatcgtctcttcgcaaaccagtagctatagctagcaccacattgatttggttcttcgtgacaacaggctgtgccatctatgaagtaaagcaatgccttccctgcccaacgaggcaacgatacaccgccatgcatgcaaagcccacgtgtagtacctgttaactcagcacacaaattcccaataaagcaattaattaagtaaatcactaaccaatcagcaatttggcaaaccaaataacccaactatcctaattacagtgtcaacagaccggtgcccagccggcgggtgtacatgtacgagctccctccgcggttcaacgccgagatcgtccgcgactgccggctgtactcgaggtcgatggacgtgtgcaagctcgtcatgaacgacgggttcggccccgcggcgctccccagcggtggcgcgctgccggagcgggacgtgtacgacaccgaccagtacatgctggcgctgatctaccacgcgcggatgcggcggtatgagtgcctcaccggcgagagcatggcgaggaagaagacccgcgacgcccggagcaagctcgctccaccgccgccggacttgtcggacacgacgctcgccgccatcggagcggacgtgcgccctcgccttctcccgcatcgcagccgccgctgccgcttcctcccccacctcgccccgggggcctcctccccagcagcgccgcccggcttgcctgagaagagaagggaagagtgagagagaaatgagaaagggagagaatacgggagaaagagaggaggctaacgtggcccaagctgacatgtgggacccacgtgggtcccacgctgactcagcagccacgtaggataaaaccggggtcaaaaccgtcgagggaccttttgtgaccggttttaattagttaagggacgcgagatatctggttttatggtttgaggacgattttgtatctcgatgacaagttgagggaccttgggtgtacttttccccgcgcaaaaaccaactgggataagttcacttcagatctcttattttaacagagttcgaatttcatccctaaaccataatatcagatatgaagagtcctttgacttataaaaatcggtgcaccaaagattccaagacattatactctcatgttttagctaacgtgacgagctgacttcggtcaacccgactgatttagtatgggacacacatgtcataaaaaaaatcactacccttcttttcccctgtgtctctccggatccacccaccattgacgccgcgagttcccccacgaacatcattcgcttcccccgcatcgtccccatgaacaaccgcgcatcaaagctgctcgattcaatttgtgagcaaatcaatctaaagaaaatgcaaagatgttgatttagaaggaaggaatgcaaatgtgccttgcttggtgaggaaggtatagaaatcaatgttggggtagaggtagtcatcgatggagtactcaacgagggtgtggacgtccttgccatacctgaagagggcagggagaaagaaggcgacaacgagggtggtgactggggaagtggggagcgacatgctacggcaaggaaggagcagctagaggaggaagggagtgttggtcgtggattggtagggtggttgtggcgtcgtggagtaaggcggcgaccaaccagggggagggggtaggagcgacagttgacgggaaggcgcgcggcagggagaaagacggtcaccgacttgaagagaggcggtgggtgcagcagattgtaagggcaggcagctgaacgagctcccatgcttgcgtctgcacctcacgtctccccggtgcccacagcttgccacccatctccccctgcccgccactcgctgagcatgcccgcccacatcacagaggggaagggggcaatgctgctagctcatgccatcggcgtgatgcccaagccacaacaatcgcccccttccaccaccttgcctccaccaccactgccctccacttcagcccttgtcgccgcctcctcaaccaagccaacccgctttgtagggctcatgtgggtcctatttaccacattaaccaaacccggggagcatactatcttgagatttttggtatactggttttattggttgaggaattcttcatatctgatattgtggttcaacgatgaaattcgaactcgacgactttaagaagagggacctaaagtgaacttgttccaaaccaacgtctcatcgcggttgcggcccttgtcgcgcgcgtgtcgcgggcttgcaccttgcggtttcgcgcttgggcttttgcctgccggaccggcccagcggccagcggattccagtggataaacattgtagcgttcaccgttatcgcttcctgcaaagtggatggataggataaccatggcgtttttctcactttggtaaaggaaaaacccatcttgcagccgatgacgacctgacaggttgcagccgcagagcatggctacttacaacgctgattgagaagcaaaaaattttgttatccatcgagatcgatcgaagctttcattcatccatatcaagtcacgatcggttggttttatgttcttcctccgatccagcggcctgccaccatcaaattcatcacgatgtgttcgctcctgataaaaccacgaatggattggcacgggtcacacgagtggagctagaaacactaaaatttatactccctccatttcacaatgtaaatcattcctattcattaacatcaatataaatgagaaaaatgttaaaatggcttacattgtgaaaggaggaagtatttactaataatactatttttaatttattttttataaaagctacagtgtgtaattttacagaaattgagagaggccctaaatgataacatgaggaggagtatcatttatcacctattgactgcaaacctcatgttagttaacttaataatttcatcaatatggtaagcctgatctcacaagctgactttttgtacccatacctgcatgcttctgttgcaggctggtaggtagctaacgctaactgtttataataatccaggagcatcttaatgaaagcaaaattatgcgtataatctatcacacaagtgggcacgaactcatcaagttggatatataccacggtcagagctgggctcttctctttctctcttctggcgccaattcagaatgaatacagctaatccatccatgccaagtcagcaataataatccccaattctgttccaaggaaaacggattatattacctcaactagatgcatgacggggtgtttgaatcagaaa

SEQ ID NO: 75295 - DNA, 7683 bp, Oryza sativa
ctcggaattggagcgttcaagtgtctaatttctccttaagaagtcaagaacccatttttgtgcttgcttcggcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgattaaattaatgcattatcgctttatttaaattcccgcgttatcactgttttatttagccatgcctatttacctttgttaagacattattattgctattgttattattaccttgttcaccctagaataaacaaaaccccaactagtggacactctactcatggtaccactagcatgattttaggtagatgcttcgctattttaattaggtaactttaggtggtttttcaactctagacttggggatattcatatcacctggacactttggaattgttggtttattgtggaattggattcacaccgccccctctattcaaaatccccaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatagctaggatgggttggaaactatgtcacgtcttccgtctgtataccgtggtggtatgtggcacatggttgcacgtgaggaagatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcactgccttgattaataatactgtgtagctctaggatcgtctttataaaatggctttgggcaactaagtgacttttaaatgctgtttactgcaaaacttaacccctatattattaccccttgtacccccttgcattaatcatgcatctgccggtgtgacttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacagcgcgcgggccgcgggagagaaaggagggattgggccgaaaggggcccaaagagaggaaggatgattttatttgttttctatttattttaattgatgcaatgatctttatgctattaaaactatttctcgagctccgaaaattcacgaaaaattccggagagtacattagggcacaaagaatattacaaaatattcccggccaatgattttttttaaaggaaattttaatttcctctataatttcacttgattaaattgatttaacttttaatataatttctagaaatgcattattaattgatttttaatcccgaacgaaaatcggggcgttacagtccgactacaacaacaacaggttcgttgtcctgagacctgaggcacctactccaagaagtgaagacttacgacaagaacttcacgagttgcaagaccggatggctcaacttggaaggcggctacaagaccatgaggcaccatcaacacatgctgggggcagatcaagacgatatcaaccaagctatcgtcctcaacatggtcgccgcacattggctcctcggcatacacccctgccagcccaagtgacgaggcaaaggcagacggcgccaccaccacgctggaaccggtggtcaagacgccaagatcatcacgcatcttcacgccctgctcaagaatggcgagttcgaggggctcccccaattcaggcgccgcctcacgctccatcttctccaagacgaggagtccaaatacaaaggtgacaggaaacatatgcatctaccgcagccgcacgacaagttgcgcctcctctcctaccaacaccaccaattccaccaagacttcaacatgcacctaccgagaaccaacgcaagcgggagcggcgtcgcaacaaccgttacgccctctaccgagagctcgaagacttggagctgaaacacacccaagttcgtgttcatccagatggagaagttcgtcaagaagatgagaggattacgttccgcatctcccccaacttggagagagacgcaagatatagctaccttatagctcgcttgaccccaagaccacgaagggtgagacctgtggttgatgaaaagagggagacgacggctatccaacctcgccccgtaaccatcttgcaacgatccaagggtcaagcacaagtttccccaagtacatcatcaccaaagaaccagtttgagcggaatgaatctactccaatggagggagtcgagcaggcaccaatagaacatgttgacatggcgccgcgtcaagttgatgccatccttgagaaagatccatcccccgttcctcccttcggagttaagcaaaagatgggaagcgagaaccgggaagaaacacaagagaatattgtcatgtgcggcgcattagtcgcacactccgagattgagtctagtgctgtgtgggttcctccacctgtcacgcaagaactcacttacccttctgatgaggagattgtaccaaacccaagggtgaatttctccaagacatttcttccacgattgaaccaagttcgttcatggttcagctcagaagactcgagacaaaccactattccgtctcaagaggaggccagtgcttcggccccttgtcttcccattggcataggaaagggatgcctagcccaactaacacagcccaatccctattatcttgtacaaagtctagaattgatcctaggggaccacatcccactcaaaaaccgtggtttagttggccttcttctccccttgcgcgcgttgccctggcgttcgacttcgccgcgcgccgagctgccgcgcatcggcctcggggccgcttgcgcgtgcccaaccgccttggcgcaccgtcgcccgtccgacgcccttagaccgtcgctgccgcaccaatcttgacgacgacaaagccaggacgacctccgccgcaaggaatcgccgctcgacgccgtgcgcacctgtccaaagccaccgccgagtccgattttgattctactcggggtgaatcgagccaattcttgccgcacggttggattgaagatagacggtggtatcccctctcacaattcaaaccattcacccccgagtcggccgttttcaccctcgccgccgccgtgcgtcgcgcccggattggcgccaacacgtcgccagccgatttcacacgcggtcaagccaatccttcaccggtaaatattcaaacgtggcctcccgccactcaaattgatcttgcccgccctctcacaacctctgccgccctagccatatccaaagctcgagctcatccatggcgatgtcggtgcccgagctcatccattcctcccagccctataaataggacctcaatcccttccttgtccatcatcgatcatcaacaaccatagccccacaacctcgaagctctgcttccccaatccattccatcaaccaccatcgcccgtcggtcaaacaccttgtgcacgatcgactccacacctctccatccatcctccgccctaaataccccttagaacactttatatcaactatgttctagtatattagaccctaaccgaagccctgcgttgagttttacctcgctgcaccaagccgagcaccgccgcccccgcgctgctctgttcttcgccgccgagaagtttttccgaccgcaatccttcatctcggcatatctcggtgagttcttatgtttcaaccatctacatactctctagattccattttagcaatccctttgcactatcatgccaccccctgagctgttgacgtgagcacgaccgccaccaatggaggcgctcgtcggcaactattctccgcgtcttgccaaaggacggcaagctgtcggaatccatctaggtgcctcgtagatgctctagaacccctcccctagccatgtctaactcatatcaccttgatcaccatcacgacctaaccgtgccaccgccgccctagccacaacccatccacacatcaaattaacccctccgccgccgctcgccgttgccggagaaccctagctccctcccctcctcggcggcaaccactttccccctccatcgccgccgtaatcgccaaccctagcgccgccggccgattttggggaacagccaaaggaagaagaagagaagagagagagagagagagagagattgacaggtgggacccgcacacagtgccatttcacatttatttgattttcaaactttagaagcccatatcttttaaaatatagatccaattccagtaaaaggaccaatattcttctaaaatcattctctatcttttgagcccctttttcctatttttgtattttattttattttctctatttttcatatttttggattttatttgaattccttttgaatttgaattttatatgtctaaccctaggtcttgaggattcttctgactcaatagataatatcaatcaatctcaggacatcgagcaaggcaagttaccatatacctgttgatcatttaagcctatattttacaaattatttatttatagccttctattcagtactctattttatatgcacaattcaaccatagaaacccagataatttagtattgcttatttctcttacaatctggttaaaatatcttatacttagattgggacagtacgtaagatttggttgatttccgggtgactaggattgtctcgatcgatataagttttgccaggtacttatgtcaaacgaacgggtacgaccgcagtttctagaatggggacagacctagttattatgttaattagcaatatggcacctctgtatagtggttcttatttttaagtcctcgcgcatgaggcaactatagccgcgaaggacgactttaaccattaccatgtacaggtaaatggtttgtgatactcgagtataaactatatggtatatttctaaaccctgatcaagatgacgtggtgtcatacgatcagttccccttaaatatctcgggaacgccagaactcctcttgttgctgttaacaatacgttcagagcatatgaggatataagttcatggaacaggtgccacaattgttaatgacttaatactgggccatgactaaagccgatgattatcagcaagtcgtggactgcggataaagcgtacatctgctgcagtagaatatctttgaaactattcgaatagccgtactcatggaattgagtaacgagactcatatggtaccctggttagaaatctaaagtctatacgttttataaattcttgctataacacttccagattgtttattactgctttttgcaaagaaccctactatatattaattcataacatatttccatgataatttgctgagtattgcgaatacttatccttgctcttataacccctttttcagatttgggtcaagaggacccttatgactattactacgatgaccccgataacttagagaatccctaaaggttatacctccctagtcagaatgtatagaagcttctgctgtgtattaattagttaggtaagtacctattattgtaaaacccttagtattgtaaaactttaacgtatgcaatgaagaaccagctatattggatgtatcaatatttactgattcagggattgatacattaattctagtcggatccaagttgttagttttgagctccgacaaggggagccgcatcatcccgtccccagcgtcaccgtggccaatcgtggaggatctacagcggcagtggcagtgctgtagcggcaaactctcgagagagaaggaaggagataacagtggaggagagatgatgtcactggggtccattgattttttattttttttcatgagacttacatgtaggtcccctgtttgtaattttcacttttattttttctggtgttgtggaaaacgatcgtactggccgattaatcggccgtatatacgttaacggtagtaaaattgttccgttagcatgatacgatgtacaattatcatttgtaaacgtcaaatctccgtttttagcgattagttggccgttttccgtttagtcacccgaataatcgtctgtatgttgtattagatgatgatttagagtagtttttaatttaatttagaattgtttatgttttacttaatttagaattgtttgtgttttactcatttaatgcaaccaattctacataaatgcggtgttaggagatttaatattccacttatcttctaaaacatgaacattaaaatcagtgaaaaccatcctcaaaacaatgaagagagcccagttgcacggttttaatagtcaaaggggacggcatacctgattttacgtttgggagagacgcatcagaccattactcaagggactcaaattggattttttttttctcaagggccaaaagtcactgattgggtccttgaacggaaaggccgtcagatttgggtcgctgtaggcctactgtcttgaaattcgtcctgtattaaaagcataagaaggtcaaatttcggccttgtcgatgtccagtacgggccgcaccgacatcatcggcccaaactagcactaatgggttgttacggataattttgcgaagcaaatcccccctcccctaatatcggagcctccgtcgcaatccattgttgcgatttctgccgttcgggccatggcgatcacacggcgaccggagaatagcagacgagccgcgctatacgaaggccgccgccctggctagtccctaggaaggccgcgcgataggcgcccacctcccaacgcgtcctttccgccagctccaatctgttccgccgccacccgatcgacccaactcggcagtccccaactaggcgacgaggtaaatacacgaaatcccctcttgttgtggttgtacaaatcgatatgcatgcttgtttgggatttcttgcaaacttgaatgattactgcttagtagttttgacctcaagatctaggtaattggctgaagaacattatgttgtccgtcagaatat

SEQ ID NO: 75296 - DNA, 4414 bp, Oryza sativa
gcatcattagttgtatccatacattgagatagtgtgtcagcactataatattccttctcttgattaggtactaagctaagtatatagttgttcacttcatcaacaatctcattagttgtagctagaattgctctatttttcaaataatttggattaaagaaactatttttgaaatctgggtatgtaaactttaccaactcttctaatttgttttctcctgtgtttattaataaattttccggcacttgtataatggttgtatctgtgtcttcattttgagcagtactttgtttggtatttattttaccattgcctatatccagaatccaattattaaagtcattgatttctttatattctaaagtattagatttggttttttgtaatcgcatattttcaaatagaaatatttttttaacatacccccaaagatatgactttacgattgatgcattaataatttccagttttgatgcattttctataactggtaagatttgtttagggtctcctcctagaacaacaactttacctccaaatggtttatcgatagcattaatatatttttctgataatatatctcttaatgttctatcaagagcctcaaagcattggcgatttgtcattaatgcttcgtcccatattataagagaagtttctattagtaattcagctaattttgttccacgtttaatatcacataatgatagttcatctatatcaactggtattcgaaatcttgaatgggctgttcgaccatttggtagtaataatgatgctactccagacgatgcgactgttagacaatttcttttttagctctcaaaaatgatacaatagtattccatataatgttttgccagttcctccatggccagatacaaagaaaaaattactttctttatttattacactatttactataagatgaaatgctttcttttggtcatcgtttagctgtaagtacaatttgttagcttgctcttctaaatcatttgcattataatttaattcatcttgaattagtgtattagttgaatctaatttgtatcttactgtcatctgaggaagattaaatttatctatacttataccacttttggataataaatattctatttgttcaattagaatatcttttaattctatatcagtcgggttgtacttaattgggtgatattttgatattaattgaaattttatatcatctaccatttttgcccaatttgtctcaaaaaatttcctttcatcttctaaattgcaatacaatagtaggattataaataaagatcgtagttgtggagatgttgcccaacttgcagcttcgtcaaatgttttataccattcattatcatccattaataatccacgtgctgcacatgtttctttaaaagttttataaataataccattgtatgttctaatatcttcatagttttttgctcctttaactatcattaatagcatacgtagatagaaacgttctccttcagttggtttgacataatataaacgggctattttaaaaccatgttgtcgtttgacccatttcctttcttttttatcccatttccatttttgtgggaattcacagtatgtcaagtttcttgcttcttcatgtaactgatttgccataaaccattctgtaagcatcgttctttgattatctggattttctataatattttttagttttgtatccttagttaatttgaccaattcattaagggaagatgaacaggcattctttccactggtggccaatgataatgtatttcatatccaagtaatctccacataccatcttgatcacaaatatatctacattctaaatattctttatttcatctattttttctgtttgctcattttcagaatgatctattccttgtttgatacgttggaaaattattttagctttatcccctcctttgtttacatatttacataaatattttaacattctgctttgattaacaaactcaacatttaaatgggcttgatatctttttaataggaataaattgtgtggaacaacccatctattgtccaagttatggttatctttacgtatgtatatattagtatttctacgtttatattgtgcaaatccattttcagtaaaattagtttgatcattgaattctttagggtaaaattttgaacatttgccttttttcatgcatggacaattttcattcttggctccacatggtccatgcatcatatgttcagctataaggatgtatcctagaggatcttctctaggatctggtatttcagttgatatccatttttctatcatttcaatcgttatttcacttggctttttatctaaccaaactaagatatgtacatgtggtaaacctcttttttggaattctaccgagtataaaatagctgttgtaggtccaaatattgtgccggattgtatatcttctattaattgttctagctttatatgaaatactcgaactataatatcaggtctatcattgggttgttcgttttctaagattgtcatagtaatttcaggccacctaggattacatgtaaatgttataaataaatgtggaggtccatatacacgacatattgctatgccatcgtaatagttttgcattgtatatcgtttagaaccaacatggcttgatggtaatattattttttttcctatttggtttccttccgttaaacctttttgtactgcatcaaatattccttgtaaacattcagctcgtaatttgttttgatttttagcaataaacattagtctatcttcatcttctattgcacgggcatcaactattgcttgttttgataatctaccataacataaataaggatttggttgatttggtcgataatgcatatgatatttgtagtattcatgtactgtaattgttgatcttgtttttttactctttttatttgtattactattataatatggtatgccaagttgaaatcctctttctccataaggaaataataaagggtattgtaaagccatataggctggatggaatatagatatgcgttgtaatccattatttttattttgaacaataatatctcttttataattttctagatttaattctccaactattaaaattgctaaatcttctgtatgtggcatttcatattgtattggatcacctttatcagcccctattattcgaatactaaaatcaacacctttattttcttcaaatagatcgcgagcatagcgaaatgtttttaccaatggattatattcatcaaacattttttttaattgttcaactatatacggattgatatctgtacttcccatttcttctttatttaaagcatgtattctattttctatttcatttttagtatcaaaaatatatagttctgcaaactttggaatttcattaggcttaggtaggagacatccaatacgatgatgtatttgtccatttacacgaaacacatatggtccatcgccattatttatatttttatctattgtgccacccattgaagtaaaagaaaataaactattatattgtctaatcttctgcataaaatgttttgatagattatcttctttattattaagtaacctagcaagtgtttctggtgggttctggaatggtggtatttttattttgttatttttacagcaatttgatatataatttcaccttttcttttctttgtctctcttttatttctttcttcaaaccaaaatatagcattgcaatgtttacatttatactctggcatacctataaatgatttgttttcatatgattcttttagatatttaatgtattctggggtaaaggacaccatgccatgtgaagttgataaatatgaagatatatggtctatctctaaacatttcttttttgcaattttttctagataatctaaattatattgtatttttcttttatttttaatatttttttgcttttctgtatatattatatctcttatattactattttttgatgtttcttcttcatctttattacattttttattgttattatgcaccatatttttttcttcttctctttttcgctttttctctcttagaatttgtagtctgatatatcttcttttcttgcaatctgatttatcatattctgctatttttattggatcttgctttctctttgatggcatattaacacttctgattatataagcacaaaaaatagccaaagtcagaaatgaatataagcataaaattaaatatgaataattaaagatattggttgaatcaatacaaaacttaatcattcatttcaacagctatatataatctgaaaattacacatgaatagtaaaaaaagtgttagctaatacaaacacttcaatatttatgacgacaaagattaatatgagctacaattattgatcatacatacaa

SEQ ID NO: 75297 - DNA, 6317 bp, Oryza sativa
taaacatttactaatatcattgcagatgatcaatgtacaatgatgaaaaatactaaaaagaatagacaatgtttttttttctggtaaatatccatactacacgaaatgttattcacagctgattggttgtgctatagcttttctaaatagaaagtaaaatttgctgtaacttgctgcaaattatttagaggaaaagattagactttgtgactaattgatttacgggattgaagttagtataattacatgtaagtacctaggtttgtcaattaagggtttgtttggatcagaagtggaggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcattaggatcagggcaagttgcagtaggctggtgttgatgttctttgattcggtataaatcaatcaatcaaaatgcaaaatactactggatctgggctaatttgggggctttcgtgatcgtgcaaggtaatgcaggcgatcgtgtacctgacctcgtcctcgtgttcactaatacatgtgattcagttcactgacctcgtcctggtgtcgccggacctgctcgccgcagagctaccggccggaggccaccgcctcggaggctcctcctcgtcgttgtgttgtcgcgcacggcgcaggatgtgcttgccgcagaggtaccggctggaggtcgttgcttctttatccctcggtggatcagatgtattgccggtggatgttgatggtggtgtttggtgccggtgaatgtggatggtggaacggcaagaaggaatgtgagacaatgacgagaggaaagaggaatgatggagaatgaatatatatacagagaagaagaagagtcaatcaaggaagacgaagagtcgtggcccttccggagaaatcaggtggctttgcactttttcattatactccaacgtaagattgtcttttatatttagtccttttcgcgttttggagcgcacgcacgaaccacgctgtgccacgtggcatcgctaatcgctcgataacttgcacggatttcgatagtaagagataggaaggatggggccaattaaacttggacagactcgacggtgtaccgtaccatgttgacgacttgttcaattcaccgatcgatcgatctgcgggcggcgcgctcgcgaagacccatgcacgcaccggccaggaagatggacagctagctagctcgatcgatcgatcggcggattactgtacgagagatattagacagccgcgcgcgcgcatgcgccgccgatacggtgcatgcgcgttttcatgcaggcacagctagcgcgattccggacttcacttgtcggtgcggtgctgcatatgcatgcgccgtacgtacgtacgctcgccagatcagagctagtggtcgacggcagtatacaagcacagacaggggcggatccaacgtgataccccctaagcccccccttcaattttttcatcacattttagcatagtttaacactgagattatatgtttatatcggtgtactcagtatgttgagtcccccaactttttgtttctgatccgccacagagagatgcatggcatgcgtacgtcagggcccgcgcgcccgggtcagctgctggatgcattctgccgcgcgccaaacgtcaagttttccattttctatactaccttaatttggccaggccacgtactagctgtatttatcatgcatatgattaggggtgtcaatttcccggtgaggggcgtatatgttactgttcagttactacactaatatatatatacgtacatatactatgtgtacatacgggtaatatatattaatctatactccatctgtctcaaaatttaagcattttttttatctcgacacggtccttgagatgctacttggaccaacaatatctataaaagtaagatgtcgttttaaataaaaagagttgcatattatgatagtttgtttaataataaatccaataacatcaattttacatgattgatcttttttattttttctattaacagtcaaagtttaaaatgtttaacttgacactatgctaaaaatgcttatattttaggacggagaaagtatatactttgaatacgtacatgcatgtactggtagctgtcagagagaattgctagatttcagtcacctcaaaagaaatttttagtcatttaaaagaagggggtatttaactttttgtcatttttaagatgtggtaattaataatttgccacccgtaatctataacacgtgggccctcgtatgtctatggcatgtgggcttagtgataaatctttaattgtcacttgtaagagtggcaaatagttaattattcctctaaagatattgcacactctgcctaaatttgcagtgatgtgcaacaaacaattttcttttttactgcagtttgatgttatgtatggtttttctttattttttttctatgttggagtctttctcatttaattttgtaaatctttatgtgttataggtttacttcattttattatatatatatatatatatatatatatatatatatatatatatatatatatatgttttttaaaaaataatattgtacgattattgggcactggtaattaatactaattaagtaatatggaagtgatgagaatagtttatcatccgaagaatacgaaaagtagtgactgaaaattttaggcacctgaaatctagacagacactctcgtattaagatattaatcctggtcctatatatatcgcttatataccattcataatcagtactccttccgttttccgttttacgttataatatgttttgactttggtcaaattcaaacagctttaaatttgaccaagtttatagaaaaaataatattttcgattaagataaatttattataaaaatatatttaattattaatttaataaaactaatttggtgtaaaattactgtattaatatttgtctataaacttagtcaaactttaaacaaattgactttgactaaagttaaaacttcttataacctgaaatggagagggttattttttttagtgttgagcatgtagtatgatcatcgacctctcaccgtgtatgactaaattgactacacatgcattgatacgtatgtatcgtgcatatatgctccatactcgtctgagtcgtttgatcatgtagttattgacatggtctggtctggttacgtctactggtctgttgctttagtaaagtcccagattaagtcgatcctacatttcataccggccggtccacaagtcaagcacatggctaaccgtgcatacataccacttccatcatgtagtatgcaacaatcatggagtataatatttcatcccaaactatgcaagtgtatgttaattagtatatattaaccaccaaaagcaatcattaatttataattaattagtttcggaagacctagctatgatctctagccacaagccccacaaggcaatgaacggacactggacttaattagcacccaaattaaataatattgtcatcgtcttggtcaagccatcctaacgctgatacagcttgaccacctcaaaggctcaaaaccttgtgcgcttgcaagagcaatctagctagctgttttcagtattagtctcttgacagaaagggaacacctaattaattattttatcactgccatggaaggtcttttaagctagctattagctgctacttgcaaacttctacatattactgtctagttcgatctctttctgcagaatctaattgaatattggagcagtatgcttgatctgcttgtgtatagttaattaatacgttaaatcattggagagaaattaattaattgcaatattagagtacgtatatatggtatatatagtatacatgcatatggtcttcagacaaatgaagaagaaatactaggaaaggacgggaaaatatgaacaagcatattagtcagctgaaagtacttttacttaattatctgtcttcgcgttcccttcagttatacggtcaagtagttggtctccaacaattcaaagttttctaccacattcgttaattcgtattaatattcaaatgtcccaagttgaaaaatcatgagctggctagctatctcccattctcccttgaatcttgacgagtgatgactgaagagtatatatgcacacactgagcattattttttctttgatttgttatgtctcatacgtacaagaaatgtaagcgaaatttgccacaaacttagtggcaatttctatagcattaactagtgcgtgcatccttgctcaaatactccacttaattattttgttatgtttacatagcgcgagtattatcacagccaaatactccctccgtattttaatgtatgacgccattgactttttagccaacatttaaccattcgttttattcaaaaattttgtgcaaatatgaaaatatttatatcatgcttaaagaacatttgatgatgaatcaaggcacaataaaatgaatgataattacataaattttttgaataagatgaatggtcaaacgttgtacaaaaagtcaacgacgtcatacattgaaatatggaggtagtataacggtagtgaatcgtctagctagctacctctagatcgatcatccggccgcgcatgggtatcagtgtgtatatatatatatatatgcgcttgattttatatttctatcatagcacttaattactttatttgttgttgaaaactcaaggtcaaaatgagtttcaatcaggtcgtcattgctaatttgtctagaactcctttgaataaatgcaggtaatatatagttaatttattattttctatcaagttctattgcaacgtttgttaatttgtgtctttgggaataaaagaaagttagctatatatatagacatatagtcaataaaaccatacgtgtgcatgcatgtttctttagtttattttcacattccaaaaatggaccagtaactaaactacgttcacatgctaatatatcatgtcgcaaaagtcaaaagcattactagtacagtagagtagtaaaagcagctgaccattttctccgacatttctgagtgcatcaattattttcaatcttacatttgcaactctacgtgctgatcgatataatgtgccatgcatccatatactcagcctaattactttgcagtttcttacttttcccgtttaggactcctagcacatgtcgaaattaaactgatcaaattttaccattttcactagcacacgtacgtacatataaatatgtttatccacattttatatgtatattatttaatatgcaattcatctccatatgagaaagtgccaagaaaattagatcaaacttcgtggtaaatgtaaggaataatcaagagctagctagcttgcgtatgcaggatggatagctagctaaatttgtggtacctgtacaatcatcagtaccaaatacactcaattaattaatatattgctaaatattattgaacaactagaccaatggaatcagatccatgtggaggatgttggttaatctgcgccatgtggcgcagaataatcgatcatatatactttgttataatgcatcgatctaattaagagatgtgcttagtattttttttctagttaagagatctagctacttagttttttttcgaacaaaaaaaaatgggtccacacagaggtcaaagctaatatccattataatctgggtcttcagaggaagttcagatgaaaaatacacttgctatgtttgttgatgctgatgatcaacctaattattcttggtttttggtacggcgagtgcatgttcaaggtcagccttcttccaagcagctacctagtcttggtttcttgagttcatagtgcacacacatacacattgtgtactactccagttcgatacagtggtctaattaattattaacaaattaattaagtattcgcaaaaagaaaaattgagctggtactgttttatactccatccgtttcgaaatgtttgacgccattg

SEQ ID NO: 75298 - DNA, 8346 bp, Oryza sativa
ccgcggtggttcatgctctaaaaatctggccgcactatctcattgggaattccttggaaatggtttccggtccttaaaagtttgaaatccatcttcactcattcggacctgaatcttcggcaaaggagatggttagaactcatcaaggattatgatgtgggaattcactatcatcctggtaaggccaacgtggttgccgacgctctaagtcgaaaaagccattgcaacactcttaacgtccgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcacgaagatctacttagacttgaaggagaaatactggtgggttagtatgaagcgggaaattgcagagttcgtggccctttgtgatgtgtgccagcgcgtcaaggcagagcaccaacgaccggccggacttctccaacctctccaagtacttgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgaactctacttcgctaggatcgtaagtctccatggcgttcctaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgagataagagtctcccctatgccgagttctcctacaacaacagctatcaagccagcatacaaatggcaccttatgaagcgttgtatgggcgcaaatgccggacaccgctaatgtgggatcaagttggggaaagccaagtgttcgggactgatatcctgagagaagctgaagctaaagtcagaaccattcgggataatccaaaggtggcacagtcccggcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcatgatgtgttccatgggtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtcctttttccccccttcctctcttgggccggctcggcccagctccctccttctctctcctctcccccgcggcccatcggccttcccccgcgcgcgcgtcgctgacgggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttccccccacttttccctctctctctctctcggattcgtttggaaatcctcccgcaaacttcgccggcgtcattgatggagccgagatcgccgcgccggtttccttcccctccggccgccctctctcactcccaacactatttaagcactccctgtgcctccctcctccgtttccgacccttgccgctttctttccccgtcggaatcgagctcgcgccgtcgtcctctctctccgccgtcgccgccgagcttcggttcgccgccgtcgtcgccccggacctcctcccgcttcggcatcgcctcctttggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgcagtcgacccggggtgagccgaggaccgccatttcgcttcccccttccctcccctctctcgggcgccgctccgtcgcgccggaggtcgccgccggtgaccatcggggcgcgggcgcgccgcctcccgtcggccgtgccggcgaggccgccttcgggcgcgccctgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcacaaatatccatttaaagagcatataaacttcaaatggccatatcttggccatttgaactcggaattggaccgttcaagtctctaatttttccttaagaagtcaagaacccatttttgtgctttgtttctgcttgttatatggagttgagtagagtaaaagccttttcttttccgttggtcgtgtagacgctgcagcttcggaagatccgctcttcgtggaagttgaagccggcgtttgggaaagcgagcaaggcaagtcacatcatctttgaacatattgattccccgtttgtaaaattatgttgatttaaattattgcattatcgctttatttaaattcccgcgttatcactgttttatttagccatgcctatttacctttgttatgaccttattattgttattgttattattaccttgttcaccctagaataaacaaaacaccaactagtggacactctactcatggtaccactagtacgattataggtagatgcttcgcttttaattaggtaacattaggcggttttacaactctagactttgggaatattcatatcacctggacactgtggaattgttggagtattgtggaattggattcacaccgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcctgggggttccggccgtaggtgggattgggtcggtactcttgtctatggctaggatgggttggaaactatgtcacgtgttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgaggaactaaatatctttaaatgctgtttactgcaaccctaacccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaccttgcaggtatcagagcccccttgaccctaggacgagccgtagatcccaagccttagcaatattttcgaaataaaaatcctttgtatttgtgaaaatcctcgtctctctctatcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccctggggtatccacacggagtggactaccaggccaggccgcttccggagcaggagggtgacgatgcagagccccacgctgcttgggaggtcactgcagtgatcctcgctggctctcccgagcggacttcgctgacagtcaccgcgggtggagactctttccccgccgcttgccagagcgccgctctcctcgccatcggcactcttcaccagcgctacccggacgagttgcagcactcgccctaccgctaccaccctcgtcgcggaggagcccgcgaccacaccaccttccgggatgctagctcggaggatgacgctaccatcgtgcacctggcgcgcatggtggaggcgtacgacgcggctcgtatcgacttccatcagatggtgcgccgtgggatggtcgaggacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttctgtcctggcccgtcgcagcagtagacgagcatttagtaggcttgcgcgtgtgttcattctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccagagaagtgctaacaccggtgatggcaaccaacctgaaggcagcaaccacaaccatcagggcaacccacctccacctcctcctctgcctccaccaccaccaccagacaccaacgccattctcacccaaatcctcgcccagcaggccaacatgatgactgctttcctccaccacctccaaaatccgccacaacttaatgctccaccaccacccccacaacactctaaactcgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcaccgccgttttccgaagaacccatgtgcccgccggagtcgtggcccttaagaaaagggaattccgagagtggaagcaaggcaaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtgttaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatatccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcccaagcgagagattgagttccggatagatcttgctccaggaaccgctcctctgtacgagcgaccctaccgtatggcagcaaatgaactggccgaagttaaaaaacagttggaagagttgaaagaaaaggggtatatacgtccgagtacttccccatggggtgctcctgtgatttttgtggagaagaaagacaagtacgaagaggatgtgcgttgactacagagctctcaatgaagtcaccatcaaaaacaagtaccctcttccccggatcgatgatctgttcgatcagcttaaagcgtgccacggtattctccaagattgatcttcgttccggatatcaccaattacgtattcgcgaagaatatattccgaagaccgcattcaccacgcgatacggactgtatgaattcacggtgatgtcgttcggtttaaccaatgctcctgccttattcatgaacttaatgaacaaaggatcatggaatacttggataagtttg

SEQ ID NO: 75299 - DNA, 31017 bp, Oryza sativa
tcttaatgtatactatatttttctctatatactatataaacacaaacacagtactaacattttccattgcttataatttgcagatgaatatcactccaattgcagagctgcgcccagggcgatatgactacatgatatgcgtccgaatatccaggatatgggaatttagaggaactaatgaagatgataacatcaaacatttagatctggttttacttgatcaaaaggtaatactatatcctttatttatattttctcctaacatatatttatcattaaatatatattattttattaaaattgcatggccattgcagggagatgctatctatgctgagatcccacctgatgctatacctttattgaaccaatatttacaggaaggaaatatcgtctacatcagcaagataacagttaacaatgctaagcccagttatagagcagttggtaatccatatatgatcaaactaaacaaaagaacttgtatcattgaagccaaagatcaacctatggattttccaaagtatacatttgatttggtgtcatttgataaacttcatgatttcacaagcaagactgatcgttttctaggtactaaattaacttttatttcattacacgtaaccataatattctatatgcaatgttataatcaaatactttattctatctttgcagatgttattggaaaaatcattgctgtttctaatgcagcaatgatttctacaagttcatcagattataggatgagaagaatagtcaaactacaagatttaaggtaatttatgccaatatcagctatatttccccatctgaacactaacactaatctgaaactacttgatactgactttattgtttcttcaaagtggaaaaaccatcgacctctcattatcaggaaaaagagctgttgagtttgatggagagacaatactggaagttggtcaaaataaccatataatagcaatatttgttggtacatcaatgaaaatccttaagggaacatatgaatttctaagtggaacaacagcttgtcgttggtatatcaacgaaaatgacatccctgaaatcaagatgtttcaaaaatggtaagtacaatttaatcccctgcatatcttcttttactttatggaatttcctatttctaacatcttatatatgcagccttccaccacatgctgatcctatacaaaagctatacttgcaaagtgatgaagatatgcaacggagcattgaacacaaaacacttgcagaattgaaggaaattgatccttttgttgacaaggttagacttatgtacctaaattaatatactattaaattctttcattgaactacaacttaaacctttcatttatacatttacataggatgaaaaataccagtgcactgctactatcattggaattcaggaaagaaaaacttggtgttatcaagcctgtaaattgtgcaattgcaagatgatatgggatggttctatattaaaatgcaagaaagagaactgcccatgtaggcagtatgagtacaagtgagtatttctttttccaatcatactattaagtgtgaatatatataactataattttcaaataactctgcacttgaacaggtacaaaataccattcattgcaaatgatggcacagctagccttgaacttgtgctatttgaaaagaaaggtacagaacttattggtaggactgctgaaactatgaaaaggcaatatgatatcaatcaaacacctccagaaataaaagcatggataggacataaattcacattcatagtgaaggttttgctgaacataactatcaacgctgatgaaccttcatttgaggtgctgacaattaaagaaagatttggaaggcaacattccagccaaggctttaaggcaactaagaatcttcccatcagttcaagttcatctcaacaactacataatttacctccactggtgcctatactatccaagaaaatacaacatgaggtaaaagagtagtactctttcttttattcatttttgtcggtgctacataatctcttactatttcctttcttttctttcttatttactgctcatcatcccagatagaaccaccccaagatattcaaagcatggaagttgaaccatataatttagaaacaagcactttgtcaggaaaaagagcttatgaagatccaaacagtacagatcaggtaaacaactgatcatatttaaattcatttgtttttcattcttcaatcatacaattaacctactaactgtactgtgcacaagcttggcaccatttcaatcaagtgtatttttttagataatggaatgaaatattcaagcaagtgtataccctgtggtcaacaactattctctatttacatgtactattcacatatatggctgacactaggggtctcatacttgccaaacctactgcctgcattgtgctaagtattgcatgagaaagaattgctggttccttagtaatatactttgataaggattctgtttttcttttttaggaaaatgatgaagaagaaagcactgactatggcttcattcagacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatcaacatctagaggatgatgacgatgacgatgggttgcttggttccggcaaacgattacgaggacgtcggccgggttctcgagaatcctgtcgtcgtctcccgttgttgaagataatatgtcaatactcttcaaatgtctgtcacaaatagccactgtgttttgttcagattatacagtctatatcacactatatgtcacaaaaatcttctaaattttgtagtctactacagcaatcatgattgtgcactgtagtatcatgctataacttgcgtttttttttttgagataatacttgcattgttgttaaactgattattctgtctcattagggtcaaatagcatggcccatccagtattgcacgcggcaaagccgcgtgtttttttctagtgtgtcacgatattgttgcatataggagattcaggcacgcggttggccatgtgaccgtatcctcctttttttttttccgcttttgttactgcacgtgcacgcacaccggccagctgggccaggcccttgtctctccgagccccgcctttcgggctgaattctaagccaaaatggaccaggccgtacctggcctccatgctgatgggccggcctctccagctcggaggcccatatttgttctgccgtcgccgcgtcgtgcggcccgggtctcgatcgctttcgtgcgtgcattcctcggcgagatacacgcgcagcggccactggcttagctttcacagctcgaaagcagcttcccccccggagctttccagctgcacacacatcaggatgtcactgctgcatccatccgatccgagcccaccatctctgtgctttgcaagctcacgcggtggtccgtccagccgaaagcttcatcgacaaaaaaggtctggatgtcacgcaggaccaaagaacagcctccacctaattacctctgttaagtttctgcactcttgctaaactgtcgttatgttatactgttattgaccatgagcacggatactcctctcaaatatgtcacccgttctgacaaacttgcatacaacataatacggatcaagtgacgctgacagcaaaagggaggctgatatgttctgcaaacccagcatgacttgataccaacacacacagtttatccattttgatgcaaggtgaaaattgcaaagctttcagatttgtacttcgtattgagcaaacatgaagagtatcggagatttgccaacacgcaacagcaacatgaccactgcccaaaatgaataaattaatgcataacttaaaatggacacacacacacacacagcggctatttacacctcaatcactccctacgtcatcttgtacaagtggaataaataacttagatgatcgattccttcactctccttggcatcaggatcgatcatattgtgtgttgcagttctgttacagcagagtactcccttcagctggttccaagccaaaaaataaacacaaccagccctgagctcctgtgacagcatctacctggcttcaagtgctgatgccgcagtctcgacagtcccaagtaagcaggtgtacaccttctgcttcagctgctcaatggtttcaaccaaagcatcttgagatttatcaacctcactatgcaactggtcgagccagttactcgtctccttcagttgcgacaaccgaaccgcgatttgcccgtctccgcccttggagtgccctcttactcgttctctggtgttcttgttttggccctcgaacttgaatccagcttcaagagcatcttccaagaaactgagaaaccatgactgtgattctttctttagaataatccatgatctggagatctccttgaaaccatcctctctggcccagtcaatcttttcacttgtgtaagcatcgtcagagttctttgccgtactacctgcaacagctttgttctgagatgcagaggctttccttgatggcttttccttctctggccgagattctttgacaggctctgatgagtaatctttccaaaaaacactttgctgaatgataagccggtttagctgaaaaaacttggtaattgcagcatgtggatcctcctcagcggactttctgatctcagcgaatattctgaaaaacagacacagacattagttcttacgttcagtagcaagagtacagtatatagtttcaagtaaaaggtgtttgacactttggaaaggatttgcacaaaaagggaacagggggacaccaactacaccagctggaatagctgtaaaagaaacacctgagctaacagaaattcagcatagaactacttacccaaggcctttaagaagtgaggccgctgcagtagcctccctttgagcctcagctgctactacaagagcaatagtcttcctccttgcaacaacctattcacacaaaagaaatgtatgcagcatggattagaacttcgtgaagcctcttttcgtatttacatggaatggttcaaataatagtttgcagttcatggcttcatgcatgcccatgtaatacagtcatgtagacggtatataatcaagtcatgatttatgctcgattttttaaacgaagatgacctaaaaaatataatgggttaatatacctttactgacttgattagacttgttggaagagagtcccaggagacagtttcagtaactcttcgtttaacagtcggcgtagaagtaactgtaccggaagtaccattaggctttgctgccaaattgagctttggtggtgaagtcattgcaggcggtggtggtgttggtgttggtgttggtggtgaagtcttataaagctttggtggtgagtttttttcagatgcagactcctttttgctgtcctttgacatttgcttcttcactacagctgagccattctgactgggtgaagaagcgctagtcttgcgtgtgtccttgttaatttcttgttttgcagaaactatcttagcaggactgcgagatggagtatttggccgttcctgcaatattagcagcaaatgaaatcagtaaccatcctagagatgcttttgtgcttcctatctttgttcattttagaataaaagaactcgaatatagcagatgtcattcaaataccattagtacaattttgctcatctcaaagacccatagtaaatggaatgattcatcactatggaaatgcacggggattgtcaaagacaatatatagtaaaggccatgttttggctgatagtagcatcttagttcaaatgtaaattaaacctacgcacttaaacgtacctgaggttttgattcttgtttgaattttgtcggagctgacttctgatttgcagaacatatgctacttcctccattacttttgtcactatctatgctggagtttagattggtaattttgctattgttgctagatatcccaagcatgtaacgtgaagctacaactgccttctgctctttgatgactaccttcctctgagagttctccttttcactttcagacagttcagctgactttgtagccttccgttgatgagccaatgcttctgaaatcccagtgggagttgacatctgcatcaaatcctttggatttccaatgcaagggttccttcctggaacaggtcgaaccccaacaagaactgggacagggatactagattggaccttttcaacatatatgaactgtccaagttgaagtttgtttgataagatgagttcattatcctccttcgataaagaaacatacgttgagtgcgacgagtctgaaacttttataaagaaaccatggtctggccaaagttctgaaccagtgattgcaggaactatgctaataacttggagaagaatggaccgatattctccacatactttcacatcagaatttatattttttagtacttttaacagtacccctggagtaagagatgccatatcttcaagccagcttattcttcttcttttttctgaaaaaaggtaccgaataataaatcacatatgttaaaaaagggaaaaaaaacatgtaatactgcttaacaacacagtttgaccactcacaaagcatcagaactacgaaaggaaaccatacagatatttattattttgaaaaaagttagcgaataataaatcacatatgttaaaagaggccgagaaacatgtaatctactgcttaacaacacagtttgaccactctaaaggaaaaaggaaaagaaacaaaatagtctttgacaaagcatcagaaccacgaaaggacaccgtacagagatatactctagaccagaattctagagtcccaagacaagaacatttgcaatctagatttcgccacatgtctgaagatgaacgcaacaagacaaacaccaaaaggacacgtagaacccaaatcacaaggaggcctgaagcaaagtttgttctttttggtgatgtactccatattcaattagaaatcccacacatgtccttccgaacagtcgcctgcaacagcagcatatccaactagagaagtccaatcacatatcttccaatgcacatcacagagagaccttaactgaacaagcgaaagcattagaagaaaagaaattgactttatgaatgtttcttagctttccagcaaagctttgtagggcccatcaactaaaaacgcaactaataattcttatgaagctcttcatggccaggtacgtggacacctaaaaggccaaaagctaccaactttcccatttcccatgcctcaattccttagggagaggctgtgagaaatgcactgcctaattcatggaagaagacaccatcctatatgggtttcttcatttcttgacttaatggctactaggaaaggagagacctaacaagccaagaaacggcaattcttgggagggatgagcattttggtcagaatacaactcctaaatctacaacgcccaacatttgtagaggggctcttaaaccaacttctgttagttatttggcacagaaacgatatttaatgtctcatacagtcacttgcacgaaaatttccatgagaaaaaaattctccagcaaaattgtccttgtcggaggtctttggtctccaaactaagtgaaggcgttgattgacatagtaccttgaggttaccaagaaggaaagcaatcctagtacgcgaaacaagaaaccgaaaaaaaagcaaaggactaagttacacctccttgttgaggaaagaatttcttaaccgaaggattatcccagaaaagaaaaattacgaaagcaagacgcaagagaacttaaaataatctatccacagccttctctaagaacttccatttacccaatccgcgtggttttccgccctttggtccgagaacaagaaccagggcgcaccaacagaaccatcaagaaacagcctaataatccctcaattgaacaagaacacttctttctcggccacaggaggagaaacccggcatcaaattcgtgcagcgaaaatcgaaacagggaggcagctgttttggctgcggcattccatcgaacaggtggtggggtggggaggggaggagggagacgattagtatacctttcggccgcgcggagtcggatgctcggagcagaggagaggtcgagaggagacgagaggaggacggagtcggcaagcggcggttgtgctctcccgaggaggaataaaaagggggcgacgaggtagtagacgacacgaggcgaccaactgcccgtataactgtctctgacacctcgggtcagatcccccggctctccgcgtggcggccgcacgttgctgctagctcgcactgacgcgcgggcccgactttgtgctggtcactcacacgtggaccccacggaccctcgggcccacatgtcagtggggacaacgtgtggggtgggagggaggtcccgatccccggggcgagctcggaaccaaacgcagaaccggtgcggcgtccgcgtcgcagccgatgggcggtcagcccgccaccgcgcgcgccacgccaatgccatccctcgccgcggccggcggcagaggcagaggcagccagttattaggccataccgccgcgcgcgtcaaggctcgcatgcgtccacggccgcttcgccttcgcgcccgcgcgtgcccacttccaccgtcttccgcgaggtcgcgtgcacgcgcgcgcgcatatccgattgcgtttgcgtgtgcccccccaagcgcgcgcggggctgcgcggtcgacaggttgacccgggctcggctcgggttgggttggttggtgggtggctgcgacgacgcgagttcatccgcgcatgttcgcggcgcgctttcttctaccgatcgtttcgctttgttttagtggaggccacggggggttttcatggcgatcgacgtgacgggaaaagatttttcagtgcaaaagctcgtgccggacagctgcttgaattttgcaacgagattaagggagtaaagtaatcactccagaacccagtagtagcagtagtagtagtagtagtagtagtagtagtagtagtaggagtagtaccgaactgccgataattgggtatacaaacatctgttctactaccgaaatagtaactaccgtctaccagttgttgggttggtacttaggccgttaggcgtagggagcatttggtagataataaatggagatggtactgtatactatatatttgtccatcatgccgtagcaggttaggataagtgtttaacggcatcactccattaacggcttcaccaagaattatgagctgtaggtgcttatattcagcctaaagctgaagaaattggaccctgcaataaggggcaattggcttcaccaagaattatgggctgtacttatattcaggctaaagctgaagaaattggaccctggcaccctgcaataaggggcaattattttcacggataaacgaggacctaaacctctgacctcacaaaattgagaggcccagaggggttgaatcagcaatcgtgctgtgacgaaatgtcagcctctagagaaaacgacactttattccctactctcatttctgcagcggacgaacaggttgcttgtttaagggttaaaccgttttgttacagcattagtcagcttggagataatatcacatatatattgtataatctacagatttatatatgctattaaagacagttggtactccatatatttctagttaaaatggattgcatcagacaattaattaatgcaataatctcctttggacctcaacaagtactactagcagcatgaaccccacttcaaatgaaatatcataatctctgttcaagacaaagacatttttatcgtgcttgtgcaagatgtttgttgaattggctaatgcaatctgcttttggttcctcataatgctaagcactaccgtgaaatttttttaaaaaaatactgtgagtgtgagcaaaccacccaattattggaacagctccaccatccagtcatccacaacccaggttgctcaacaaatccatctcaaggtgatggcatgaccaaatcaattcgcttaactaatgccatcaaaaaagcagctcgcaggtcttatcagagaggatttctcatcttacttcgctgcaatctctccccctcataatattttctccccattttgccgcatcattgtcaggtatcgagagttcatatatggtcaacatggacattccatctaattcgtatacttctgcatatttttattaatgtcgtggtcttggtaacatcaccggaaaaattatatattgacacacatatagtggaacaatcatcacttaatcagcatatcccaagcaacctaattaagaaatcattccaaaaaaatacggcataatatccgtcatttatatattgacacatatagtggaacaatcatcacttaatcagcatatcccaagtcactaattaaaaccaaaaaaatatgtcatagtatccaaattacttagcacactgcaaacattggggctttactgttttgacatttcgagtggatgataaatggacccatctgtatctatgaaatatgggtctagtatcattataacaaagattaatatttgcagtgttataattgcaaatcccccagcaacgagataaccttttttttttttttacttgaacgcttgtgcctccgtctccgccttcaccatggcagcgtagaggccgtcgccgtggccggcgaggagggcgtcatggccgccgaactcgacgaccctgccggcgctgacgacggcgatgcggtcggcgtcgcgcacggtggagaggcggtgcgccacggtgatcgccgtggcgcgccgcgaggccctcctcagggcctcctgcacgtgccgctcggactccaggtccagcgcgctgctcgcctcgtccagcagcagtatcctcgcctgcttcacgatcgcccgcgcgatcgcgatcctctgcttctgcccacctgacaactgcaccccactctccccaacctaagcaaaacaaagaaattttagttcaacaattcaactgaaattcacccaataatcatttcaaaatggtagtttagagtaaattttacaaaccacacgtattatggtccaaattacacaaaacttcatagattttggcatatggcatagaacttcacgtatcatgattaagtttcacaaaaccacactatttaattctacaatcacatatcaattttataaggattctatccatcatataaatgttacacctgcattttaaaattttgatataggattgtatcagaaatggttaacggtgtggttttatcaaatattagtaccatagtatttagggttatgtgtcacgtgtcaaaatatttacggttttatataacttggataatttatttttttacgtaacttggatgttttatggaatgtactctataatttatgaagatatttgaatgcttagatttgaaatttttagtagttaacctgggtttcgtagccttgggggagggcggagatgaacttgtggatgttggcctccttggcggcctcctcgatttcggcccacgaggcctttgggttgccgaacccgatgttgtctcggatggacccgctgaagagggccggctcctggcccaccatggcgcactcgccgcggagccacttgaggtcaagctcccgcgcgtccacgccgccgaccaccaccttcccgtcgcccgggtcgtagaaccgctgcaccagccacaccaccgtcgacttcccgctcccgctcgcgccgaccaccgccaccgtcgtgccggccttcacccgcagcgagaagccgctcagcaccgtcacctccggccgcgacgggtacgcgaacgtcaccttccggagctccacgtcgatgggcttcccgtccttgatcgtgatccttcgcttggtggagtctccggtgatcgccggacgtcgcttgaggatggttagtatgccggcgatggccgccggggcgccggaggtgtcaggggcgaggccggcgagctggccgacggagaaggagctgaggacgaggatgaggaagatcttggacacgtcgccgaaggtggacacgccattgttgatgaagtgggcgccggcgcagagcgtcgccgtgtaggcgccgtacatggcgccctgggagagcccgaggatgacgcccatgagctgcgatctccggctggccttggccgccggcccgtccagcgcgcggttgaacgtgccgacgacgctgccctgggcgcagagcgccgcgacggtgcgcacgttcgacacggcgccggcggcgatgccgctggcgcgggcgtacgcgccgtcgtcggacctggcgcccacgttgatgagcaggttgaggtagctggcgccgagcgtcagcggcgtgcacgccgtggccaccagcgtgagccgccagtccagcccgaagcaaatgccgagccccacgccggccgagccgacggccatgagcagcacggcgtagcggtcgccgaacatggagcggaacgcgacggcgtcccgcgcgagccgcgtcaccaggacgcccatcgcgttgtcctcctcgtcgaaccacgcgggctcctgccgcatgatggcgcggaagaggcggtcccggacgcgcatggtgagccgggcgcccgcccagccgcacagcccctgctgccccgtcatggtcaggatgcaggccacgccgaggccgaccaccgccatggccaggtactccacctgccgcttcatcctcgccgtgtcggcgtcgaagtacacctccaccgcctggcccagcagcagcgggaacaccgagaacaccgcgccggcgtgtatgcccatcaagaaccccaaaatcagcaatggaccttcccgccgctgcagcctccatatctcggagaccctcaccttggcgtcctgcgaatccttcttctcctcctcttctcgaatcgtctggaagccgtacctcgacttggacaccgacacgtcgtaccccgactcgtcggtgaagctggtgtacgccgctgcagcgccggcgaggtctggcctggcgccgccgctgtcggaggcgaggctgaccagcgcggagtagggcccgcggcgggccatgaggtcggcgtggcggccggactcgacgacggcgccgcggtcgagcaccgcgatggtgtcggcgttgcggacggtggcgaggcggtgcgcgatgacgacgacggtgcggccggcggcgaggcggtcgatggactgctgcaccacggcctccgactgggtgtccagcgcgctggttggctcgtccagcagcaggatgcgcgggtcgcggatgatggcgcgcgccagcgcgatccgctgcttctgtccccccgacagctgggccccacggtccccaacctaattaacacacatattatattatctatgattaattaacagataatccgtgagattaatggttgattagtttgtgtgtgtcagtgtgacctgagtgtcgtagccgtcggggagggcgaggacgaaggtgtggacgttggccatggcgcacgccgagatggcgtcgtggcgcgtggcgttctccttccccatcatgacgttctcgatgatggaggtggagaagaggacgggctcctgcccgacgagcccgatctgcgaccggagccaccggaggttcagcgacgcgaggtcatggccgtccaacgtgatcgaccctgcacaccccacggacgcaaaagcttcgtcatcgatcaccgacgatctcgccatggtcgtgctctgcgtgcgcgtcaatggccattccctctcacctcgagtcgggtcgtagaagcgctcgatgagcgcgaacatggtggacttgccgccgccgctgacgccgacgagcgccagcgtcttggcggcggggatgaccaggttgaggttgtacagcaccatggcgtccggccgcgacgggtacgcgaactccacgtccttgaactccatccgccccttcaccgccggcagcgcccgcccgccggcgccgtacgcgtcgatctccggcacccggtcgatgacctcgaacacccgccccgccgccaccgtgccctgcgcgaactgcgccatgtacgacagcgtcagcgccaagcccctgcacacacacacaaccattccgagatcagagatcaccaccacaccaaccacgaaactccggcgaccggcgccattgacgacaacaagaagcggtgcgaggaggttgatgtgcgtgccttcctccgaccatgacgccgaagaagcaggcgatggcgtcgccgcccttgatctcgccgttggcgacgagcctggagccgtaccagagcgccagcgcccactgggagtaggtcaccaggtagatcacccccatgccggcgcccttggcgaaccccatcttgacgccgatcggcgccgccttgtccagccactcggcgtactcgccggcgagccgctcctccatgacgaacgacatcaccgtcctgatcgagctgatcgcctgctgcgccacgtcgccggcacgctggtacgatgcctaccaaattccatcaaattggtttcaaactttcaattcatcaaatttggtttcagtataagagcgagagagtgagtggccggctgctaaacctcttccttggcggtgaggccgccatagatggccttgtaggccatgccgcacgccatcatggcaggcgtgacggcgaagacggcgagagcgatcctccacgatttggcgaagccgaccacgtagccgaagacgaaggtgaagacgtggtgcacgaatcctggaatctttacaaaatgtgcacaagattttagtcatgtgtcagcttttgaacatatgtgtttgggggtaaattttgtgtgtgcgctctaccttctctcccatgacttcttggatttgggcgacatcgccggagatgctgtgcatcacctcgccggtgctcacctccgtgtcgaagaatccgatctcctgcctcagcaccgccttcaggtactctcgccgcatccgcagcgccgacctctcgccgatgatcctccagcaggtgatctctgatcgcacataattagaaactcataattcgattcaagagattcccaggaattgaactttttcatgattaatttgcaaaaatgctcaccaagataggctcctacgacgacaactgcagcaaggaacgccatgtacacactaatctggcatcgaacaagaaacgaagatgagaagatcggatttgaatcgaagctgagaaatcgaagaaatgatcatggcgatgcacgcggcgagacctgcttgacgtccttcatcatctgcgtcttgtcgacgttgacgatcttgttgacgaagttaccgaacaggtaggagtaccatggcagcgagccgccgttgatcatggcgccgacgcacccgagcacgaggaggacgatgtccatggccgtcgagtacttgaaaagccccgcgacgccgacgggcttcccgaccctcacgtcgatctcgtcgtcgtcgtcgtcgtagtcgccgacggcgtcctcgtaccggctctggccgctgaaggacgcgacgctgatgtcgtagccgaagctgggcgggtcacgccgcgccgcggagacgtagagctggtcgtggttgtcgcgcgagaaggagacctcgcgggaggcggcggcggcggcgttggtgtcgctgtacctcaccatggctcgtcctcctcggccggcgtcatggccgggcgcggagtagacggcggagtcggcgacgacgacgctgtcgtcgttgctggcgaaggaggtgttcggcaccacgacgatggcgcggctcgcgtcggtcaccacgctctgcagctccagccgcctgccgccaccgccgccggcgcggcggcgacgggcctgtgcgccgacgaggagacgtcgcggtagcgcgggcgggcggaccgcctcgacacgtagtactccctcgccgtccgccggaacagcgcggggccacggcggccggcgctccccatcctggcgggcgcccagggcccgacggcggcgccgaggccgtggggctgcgcccacgacgtgtccggctgccaggacactgagctctgccacgacatgtcgtcgacgaccacatcccggcgccgcgggccgccgcgcggggagggggggagcccggcggcgaaggaggtggagctgtccgggacagagtaggggctacctcgccggcggtggcggccgccgccttgcgggccggagtgggagaaggagaagtcgtccatgcacgcacggtggcgagcacctggtgggcgtggtgttcgataaaaaagggtgtagcttctgatgcgcgcggctttggacggcaccggcgggaggcggccctcggattcgacactgcgcgctgtttcgttggatcgtttcgcgcgagatagccagcccgaccgtgtccgggcgagctctgagcctctcgactttgtgaagatttttttatgatggattcctagtacttctttcaggttttaatatgtgacgttgctaattttttttatacatttgatcattcgtcttattttaaaaaatagattaaatttcagaaaactacaattttagttacaaaactatcgatttgctacaataataacgtaagaacttatcacaatactacaatgtttacattatatgctactacagtatatataggtgacaactgtagcaaataacgtaaaagtttcagttttgtgataatttcacacactgttgttgtagcaaactaaaaaatatcgttaatgttatagcaaaccgatagttttatcactaaagttgtagtattctgaaatttattaaaaaaatatttaattattatttattttgtggtgaattgatttatcatcaaatattatttaagcgtgacttaaatacttttatatttgcatggaaattttgaataagacaaatgaccaaatgtttgtcaagaaagttaatgacgttatatattaaatctgacaatctgctcgtgtctttgaggtataaatctgacattgctttcagaggaaaaaaaaacttgatttgattattcactcttcttttttttctgaactgataattatgtgctgtactctctttacagttcatctctgcaggagtaaatctatggcaatttttgagtcattgcatacctagtctaaactaaatatacacagagaaagaacgacaccttcgacaaatggaggtagaaacttgttaggcttcatgtatttggtttggaggtagcgtttgtgtatttttgtgatgtggattcatcagtaaacatgtagagtctggaagggatgaaatggtattttgatgtgaccaaagctgtcaacgccaacgaattaacagcttattaaggccatcttttccatcggctgcaatttgtttgattgtctcaggaacagcgatcatcaaattcgtcagaaacacccatgacagaccaggagagcaatccaagaacatccttcagagcttcaccgaagaactgaacaacacatcattttcttatcttattcctatcttttgttcccattttgacgccgtctcatttcttgatctctaccgcgtactgtagatcgtgtgtgtgtgtgtgtgtgtgtgatagtgcgtaatacgatgatttggacaggagaagtagaagtatttgctagtacctgtacttcaaatttcagttttgtttcgtcaggtggttgtggttgtgcttctctttttcatattatgtttttgcagacgtggagtaattcagacaatggtacgctcgtcaacgctgaaacctgactgcaaaatagtttgattgtcttctgtactgaacttgttccaaatggcaaggagacaacatagttcatcagcagtgggaaatcgtcttcctttgagtaatgcaggcacatggatttgattatctggttaggtaatcagtaaccacagacgtcagtcaggttgtggaaatatggctatccaaaacatgtagcattctgaaagtacctttttctttaagaaaacattttctagcagtggtactactatgagagtaatagaagatcctaataaggaaattcaaataatccaccacgccaacactgaaaattggaaacagtgagagcattagattaaaagagtgcatggttgaagtggccatttggcagcgaagcaattgaaagcttctgcaaaatcaccagaactacgaactgtatgtctgtatatactacatcacatatgctaataatacaaccttattttaggccaataatcagacttatgtcttagcgggtacttcctccaaggtccaacagcgtttaaactctgaacgtagtttcctgaaaactattgagcttgtatatttgtgatgctacgaaatatgaattagaatttacaagggagatgtaaaggtagagactagagactgtttcgatgtcttgtgtcattgtctttggaataacagagcaaaaaagtttttggaagacaagaacagggcaaaagcgccagttctgtttttcataagaaacctgtttcatggttcaggcgaaaatttccaataaactgctgctgctgaatccctgctaagggagcataaccctgtaaaacaaccaaaagtcagaaaggcaaattaaaaaaatcttccatataatcatgagtctaatttacttatattgagtgttccaattaatagatacttcctccgttccacaatgtaagtcattctagcatttcccacatacatattgatattaatgaatctagatagatatatatgtctagattcattaacatcaatatgaatgtgggaaatgctagaatgacttacattgtgaaacggagggagtactaatcttctgtatatctaaaagccagaaatgcacaaaaagatgtgagcgtattcttttgtcaccagtggtctcaaatcgtatacaaccatggaatgtggcgatcttgagaatatttttctaacaaaatttgagtgcatacaaacttaatggattgcttgcctcagaaggcggtgcatacaaaatactatgagaagagcaaaagcaccaatattgcttttagaaattaagtattgcacaagtgagttcagttctaccaaggggtcttacctgacttccctgtgcacctccatgaagggcctgctggtgggagttagaaacagaagtgtcctgtagttgatcacgcatattgaacctcaacctttactaaggataaaaaataaacttaatgaatagttatatttgatcaacttacatggttaagctcgttatttgattgcacatgttgtggatctataaatggcacgggaacattcaaataagagctgggaatttgtgaaactcctccattcagaagttcttgattgcctgtacttgcagacttgacatccttcttccatcttttcatgaaatatttttgtggtaactcctttatatttctgaaatctagaactttcaacacatggcaacactggatacccattgcttcaaattttttacaactgcatacaacagataagtcgccagagtcaaacctaacatagtgttccccaggcctatctgttactgctactctatattcgaatgcatttccatcctctccacagctataaatcacggaatcgacaaacatctcaaactccctgcgaaaaatttcaaagaccactggtgtgtacatgttagcagcctgtctcagcattttggatggaggaattctagggaagctttggcttgcatgaaaatcagcttgtaactctgcataacgaaactcatcaagcattctttcatagtgcttaaagaaagataacaggtcaaattgtggactcaaggacttcttcaaggcatttctaacactttccgactgcaaagaactttttatatctgcagtgaatacatggcgattgtatactggagaccatttatcacgatcatcaaatatttttttaatccactcattgtttcgtagatcatacttctctagcatagtattccatccaagcaagaagttctcttcatcatcgtagtcataaacgcattttccgaaatcctttgcaaatgttttggagccttgaaagatgtgattaaggtgcttgacagagttttggtacacttgccatggacaaaggcgatgaactgttccaggccatgctgctgttatcgcagaagccgtagttgctgccatagaccaatctgtcaagattgtttttggttgctttccatttgcagcaatcttgaatgtatcaaatagccacttgaaagactcttctgattcatcataaagcaaggcagcaccaaatatggagatttgcttgtggtggttcactccaaggaatagtgttaatggtctgctatgttcatttatcttgtaggttgtgtccaaacaaaccacgtcactgtagtagctgaagtcggttctagatttggaatcggcccagaaaatgtttgtcagtttgtcatcctcatcaagctggacagcataaaagaaagaagggttgcttagctgcatgctttgcaggtactttacagttactcctgcatcaccaggttgcatatttttcttgcgctttgaacaaagagagcacctgtattctgcagggagaaaattggtatgtctaattacttctgcttgcttcaccaaagagcaactagaaaaccttgatggtgtcgctgattcttctgaggagtctgcttcagttgtttgcagctcagtgagtactctctgagacctcagcatatgcatggttgatgggggtgctggctgatggttatgatctggtacgaattcagatatacgatatttaccatcagatgtaatcttaattgacattcgtgcaggacaccctattcttgtttctggccgtggtcttttaacttccttagctcctttcttgtccttacgaaaaccttctctcgagcatacaaaggttcttgaccttgtgatgttttcagctgatttgtccgatgaacttttacgaacactgaatcccacatgtccagcgtacctgttgtagaactcatatgctttatcttcgtcatcgaattccatgctaagttctggaaccatttgtgcaaacatggcattatccatgggggtatcagaatcaataacttttcgcacttttccctgcatgtagaaaaccaaaacgacttacatttggaattggagcgagtataaacaagaagtggtggagaacaattagaatacctttgcccatgctataccacaagcattgcataaagttctccgtccctctggtccacggcgcatatgaggcgtcgcatttgcactgatgccacaacgtagacatctgaaaaactataacataaaagttaggaatcgtctcactaccatgaataattgagtccttgattcaagagaaaatgatctgtatcaatttccagcatgctgctgaatgttgatagtactgagtagtatagtagtcaccaacctgctaagtagtcagtgtgcaatactaacattccaccatatgcatggaccgacagacagcctttgataattttattgctttcataacccgatctgagaaaaggcattgatgatcagctactactccctccggacggaaatatatgatgtttcaggtagtggaattgatttgcacttagtagtatttccctgtctgaaacgacaagtaatactgacttgaggaagtgttactcttctaaatttgaatccggtctcgcttaaccataactacagaagactagaattgggaaaagaaaagaactgcaaaagggtactaaatagtactaacatccagagctctcttctctcgtgatatctcgtactccctccgtctaataatatagcaacttagtactggatgagacatttcaatatttcatagtacaataaatctagacaagagcatgttagatttattgtactatgaaatgtctcgtccgttactaggtcactatattatggagggacggtttcaaaaaaaaaaaactatattatggagggtaggccctagctacagttataactagcttggcacgttagcttttcacccaaacattgcacatatgaaatctcgatgctgaactgctgaatgtaggatacggtaaaaataaaaaagaaagaaaaattcttcacctggtaagctcatccactgtgaccctgccaccatcttcaccctcaccggcaccaacatgaacatctcccccgtcctcgaactgcatcgcttacaaaccacaacgaaccaggaaataccaagctttcttcaaaactccgcgcgggattctgcgagcaaatcttctagcgctgagcaaacccgaagcaaagcaatcacgacagaaagatcaaacaccgtccgaatcccttctccccgagatgagctcaactccagccacatcgaatcccaaatccacccagcacaaaaccttactccagaaggatcagatcgttgctcagacagagattccttccataacctttgcccccaccgaaatcgacgggctccattgcagaagtcgaaatctgccaggtttttttctaaaagagcgccgcccaggagcagatcctggcacgaggtgcgcgaaatggcgggaatcggcgcggggattggttggattcgggggtttaaagctagggtttagcgtgggggatccggattgggatttggtgcgggaggttggataccggaggcggaggagatgcgagtgacgaacgctctctgcttgccacgagagccgcctcccctcgttgtggggcgaggcagcttggtgggccgcttgggctcaactcgggtagttgggccgtaaagagcaaaagctgtctatgccgtccaagagggattatgggccggaaagccgttggtgggcttatgggtctgatgagctggcggataaagtctaagtttctagtccgatctcaactgtcagtatcatgtactttcaaaatatataatcctttaaacatttgtactttttttagaaaaaaatgcttagagtttaaatatgaatatttacagtgacagatattttaaaatggagacggagtgagtggattgtgtgtgcgattttctttggaggaaaattcggattgtgtgccaaggcaaattacctgtaaaaatagccgaaaacttagtaaagttggtgatgcaacgttgtctttcttttattgcgtggtaacgtatatacacacgtcactgcatacgtaacatcgtactcatacacccatgttcaatgaagcagaaactagcgagacatcctaaaattttattaaaacttgaaagtccatcagtttcaaaaatattttggggttggaacggaaatatgctagggccatatggtattatggcaagtcgtctcgtttccattttaacatttttagcttacttttaattcttataggcatatgggacaaggagctataaacttgtaacttggacgtttatagcttgatcataacattggtgctaagaattttaactataaacattatagttttatgataattttattgttaaatatgtggttttgtaatacttaatcttaaatcaatagttttgtgacaaattcagtgttaaatctataatttaataatacaacatcttaaatgtgaagttttgtgatagtttgataaaaatatattaagttttgtaaaaattactctattaaaaaaaggaaatgtgtgctatgctccctatcttgctagtccagggaccaaataaaacacatatacttgaacaactatcagtccattgcagcaacacttaataaacagccaccaggttaattcaagtagcatatgacagtataaataatagaatcaaacgtagataagttcacatatcaccgaactcgcgtacactggttcagtacacatgtctcgcacaacttttatggtagtctatggctcataaaccgacttgctaatacaccaacacaaattaatcaagcttgaaccttaaccggcatcgcatgccgatcccgtcttttgacgttgcagtaattttccgttcattagcctctgcatacttaccactgcagcttaagcgttcatgcgagccgggtactgctcgacgcagtccagccacgggctgcgcgccgggcggcgcacgcggcggacggcgcgccacacggcgctgttgcacttgaacccggagccgaaggcgagctgccacacgcggtcgccgcggcggacgcggcccttggcctccaggtacgccagctcgtaccagatgctgctgctcgacgtgttgccgaagcggtggagcgcggcgcgcgacgcctccaggtcgccgtcgcggaggcccaggttgccctgcaggtgctccagcacgtcgcggctcgccgcgtgcatgcagaagtgctcgaacgcgcgcttgaagtccgggatgtagggagcggcggcggaggcgtcgccgtcggcggacggcggcggcggggcggaggtcttggacgggaacaggtggcggaagagcacgccggcgaagaagaggatctgctccgagaacggaagcacgagcgggcccagggtggtgatgttggtcttgagcgcgtggccgccgacctccacgaggtcgcggctgatggacaggcccttgatccgctgctcgtcctcctcctggtacaccgaccggaagctgcggtcgtcggcgcccttgtgggtgcgcacgatgtgctcgagctggtacttggcgcggtggaagtccctgcggcggttggagagcagcacggcggcgcagccggcgcggaagaaggcgttggggatgagcatggagcggcgcttcccggcgtaccaggtgaaggagacggcctccgtgctgacgacgacggcgagccccgcgccgctggcctggagcatgtcgcgggcgaggtccaccgcgatgacgccggcgctgcaccccatgccgccgaggttgtagctgaggatgttcccgcgcatcttgtagtggttgacgatcatggcggacagcgacggcgtcgggttgaagaggctgcagttgacgacgagcacgccgacgtccttggggcggacgcggcacttgtcgaacagctcgtccagcgcggcgaacatggcggcggacgcctcggcgcggccttccttcatggtggcgcagttggtgcccggctcgaacacgcagcgcggcatgtaggactcgtcgccgatgccagacttggccagcagccgcgactggaacgccaggctatcctcgtcgaacttgcccgacttcctcgccagatcgatgaactccgccttcgacacctgcaagcaattgtccatgcaaaatcacatccttgcttacaaatcaccagctagtaccataatgcatcaaactgattacaaactgtaagtaacaagtgaaatcgaagaaatttcatgcatgcgaaccgggtaaacttggttgtttgactcaaatccatcgtgcgtgcaaggatagtgcaggttgtggtttgtgtgctcacgcaaaacatttttcgaaaagaaaatgtgtgctcacgcaaaacatttacggtttaataatacggttcggctcattgaatgtgtgtgcccaatcgcccaaccgtatttgatgacacgagcaagtgagagcgatcgactgatcgagtcaccggctggcctggccataaccgaaagcatcctaccagctcgtcataacttcgaccctgccctgcccattcacttccaaggactggggcccaaccaaaggtgcctcctaacttgcattcaagactccaacaaaataatggtagccaacaaactgttttccaaaacttagtgatgtgtagcatataagggcctgtttagttcgtgaaaagaaaatttttatatgtcacatcagatattttaccggatgtcgaaagaggttttcagatacgaatgaaaaaactaatttcataacgcggtttcgtgaaaagaaattttttatatgtcatatcagatatttcaccggatgtcgaaggggttttcggatacgaatgaaaaaataatttcataactcgtttggaaaccgcgagacaaatcttttgagcctaattaatctgtcattagcacatgtggattactgtagcacatatggctaattatggactaattaggctcaaaagattcgtctcgtgatttcccccctaactgtgcaattagtttttgtaatttatatttaatgctccatgcatgtgttcaaagattcgatgttatgttttagggaaaaaaaattggagaactaaaccaggcctaagtctgcaaagatataactagagtttcttttggagtatctactaaggaggagcttcttatcaattttggatctaatatatcatgtaaatactttataatattcagttaatattttattaccattcctttagtcaacatagagtaatcagggaaaaaagcagtggtcaaagactttacttgagaatgatggcagtatttatactaaaagtaacatacagtacaagataacagaggcactcgggcacaaggaaaagcatctatctagtgtaaacttattaggtgtagaatcaatatatgataaatgaatttgattcatacaaaatagcactacctccgttcttttttttttgtgcaatttctaagatattgctttgaccattgcacattttacaacgttgtgttaggatataatccctccgtttcatgttataagatgttttgactttggtcaaagtcaaactgcttcaaatttaactaagtttatagacaaatatgaaaaatatggtaatatttaaattagcaaattagttttattaaattaataattaaatatatttttataataaatttatcttcggtcgaaaatattactatttttttatataaacttggtcaaacttgaaagtttgactttgaccaaagtcaaaatattttataacctgaaatggagggagtaataacaagcgtatactaagtatggaagtattttttttatgatggatctaatgatataatttctaaaaatttaattcaagatgatttcaaatatgccaatgtggtgaaatctcaaggaaaaaaaaaagacgaatcacaccggttctatctagggctgtcaagtaaaatggaggtggtaatcgtatgagcgtggctcgggtatttcagtcagtgccgggcagatttgtcagtgctcaaatagtgaatgtgtgctacattaaaagcatttgagctggtagtagctggcaaggattatgaccgtattaaaggaccatgcggagtagtactagctatagacaccactataccaatagttattcacaactaaaagcccaactgatgatgagtttttttttttttgttgttgtcaatgcaagttcatccagcagttaatactaaaccctcctccaacaaaggtaagtcagctagctcataaatctccacatcagcttttgtatgatgtggaagagagagaagataaggaaagagaatgcactatctcttctttaagagctaagctactaaagaaattgtgaaacctaaagcattttatacaatgtgctatgagacaatctatgggagaggtagactttttactatctcttatatgaggtggacaagcatgagctagctcaaccattaaaggaggcccaaggcttacacgttccaagagttttctcttcacacctcaccttgaatagctttcacagttttgagatttcagctactacgtccggtaaatccaaaagtatatttgcagttttaatttgcgttgtttgattcgtctcaaaaaaaaaaaaagaatggcgctgtttgaaaaacagttggctagatcactgaaggaccatgtggattccatgaatcatgaaattcgatcctatgctagctccatatgagaccttcatttagtccttgagcactttgtataacgtcaatatatatgttttatccgatctatccttttgcaccagaaatatgcttttattgtttcagaataaaaccttggccgattcaatttacgtgagatctgaaatgttagaacgaacaagtttcttgcgcagtaacaaatcatagatcctaggagcttcacacattggcataatatgctttcatttaaacataatactagtaatataatactaatctactccgatgaactaccgaatatgtgtatacgtgattaagcatggaattaagtagtattaccttgagttcgtcggctggtttgtagcaggcgaagtcgatgaggtagacgggcctaggcctggacatgatgtagacggagatggtgaaggcgaggacggcgaggaaggcgaggacggtggcgaggtcgtaggtggcctcgccccagaccttgcgccacagctcgtctcggctgaggctgccgacctcggcgccgcagacgagcacgatgaccgggatggtggccaggtacacgccgtggctgatgaggtagtggtacccgagccgcacgtacttgaggttcaccgactggaggaagtccggcagccgccgccgcacccgcaccgagaacgtcggcgacccggcgtccggccccgacggctccacgccgcggttcacgatctccgtcaacagcagcgcctgctccctcgccatggccgcctcctccttcaccttcaccttctgcagtaaatgagaaggcagtgaagtgatgagatgatctcggagactttagatatagggagagcagtgcaggggttgggggaggagatggtggtgggtgggtgggtcgctagatggcagttaatgccatttagagagcaagccaggaaaggtctgcctcaatgcatggtgttcttgcatatacatgcatctgtttgctgtgagcctgtgcaccatgttgtaactgcaagtactggaatcatactgctagcatagcaaattcatggccacagctttggcttaactgatcactgactttgtagcagtaataactactcctacagaacatgtgcaaacaccagcattgtctataaagaaaaaatgtgcatggatatgctgtactctctctgttcttttcagcctattcactgaattattaaaatgaattctttaactccacatttaaaaaaaaagttcactgaaaacaaatattgtattatttagaccacttattttaattcatttgttaaatctattactcaaaacatttgattatccctataatcaaatcgatgatctactcaataatagaatcaaacagagctcaaagattcaactccatatgcttattttgacattaaacccgtttattattgagatgtactacacatgtggaatcaatcctgttactgctacaaagctgtgaatcaataactgtgttgatgggaggaggatgtacatgtacagagtgctgcacctgcactgctgcttggacactgatctggcattcttgatcaactagctggcccttattgattgaccgcgcagtggtagaaggaagaggcggaggagatttcatggagggcctctttattaggtagcggcgaaaacctgttcagctttcatgctgttctctgcttaaaaaaaaaaaactctggtgacttggtgccagtcctgcaactgtaagagtcttagggtgggtttagttcatgctaaaattgaaagtttggttgaaattagaacgatgtgacgaaaaagctgaaagtttatatgtgtaggaaagttttgatgtgatggaaaaattgtaagtttgaagaaaaaatttataactaaacaagggcttaattaaccattcgatgagatcagtgctgcagcaagctgcaaaggaaaaaggatccaaaaatatccccagcacttactgttcggtttagcatgaggcccttttcggttagttctccccaagccaatggacatgcagttcatctgtacgactgtacaatccagaattcgtcatatcatccatccatcggttcaactgctaaccagtaaccaccagctgcgccgatagtagcacttgactgattgaatacacggtccgccatgtgatgttacttcctgctaacacaattcatttcttcaccgggctgctgctttgtttcttcagacttcagagttttgccttgtatagaacacagttttacacatgaatttcctcaaagctggtgagttctagaggaatctgtagtagtaaaattaccataggcaccttgaaggaacttttggttaaaacctcctgagcgtgaaagcaaccctgagagccacttccctgactaaagaagacaaccgtcaataggtcctcaagaagaaaaattccagatacacaatgatctaagcatccaacacgaatacacgatcaagaccttcagctcatatattcgaagcaacagcgacatggattaatctacaagcacatttatttatggtggtgcatatgtgcagttgggagttctaacttaaccatcacccactagagaccggattgatctgcatttcgttacaggtatgtaccacactcttcaagaaacattggtcacgatcagcaggatagcgatcatatagtggcaccaacaatagtcagccaatgggtctttttgggttggtcagatgcatatataacactagtgcgacttgcttatgataacgagaatgatacagacaaaattaatggtttgatcagcaatttctggcaatggccttcaactacttccagcctgctttaaattggcgcagcaaatgttaagccatgatggccgtgctgtcacacagtctctacggagagaagaattgacttgatgatagatcaaaaggctaaggttgcggcattaagcaaaagccaaatgctaagctaagaaaatggtttgaaaaataaatgccaaacctgatatttgttttaatgaaaaagaatactggaccttttggcctgtatgcacgaggatgcagaaactagagatataaaacacttcttcatcatcttgat

SEQ ID NO: 75300 - DNA, 51881 bp, Oryza sativa
cattagctcagctttggaaatgaggccttctagtgaagcctactcaatgggatgtgttgttcttacccttgattgtatgatgtaaattcgagttaagtttgattatttcaacgaaattatttttttaaagaaaacaaaaccatagtaaacaaaaagaacacaggattatgaaacaagtaaaatgtagaggctgtgagggctacctcaaatcctactaattgaagaaaagccacatgagtgactatttggataaagcacacgaaaacagacacaaactatagagagataggcagggggtttttttttcaagacgttaggtattatgttaaattttttcccaaatacctatgtatttactatttcttcgatgaaagggccttagtggaaagctttccatatgattgaatttcttcaaaatttttaaaaccctttgttccaaaggagcccgaggtgtctttattatttattaggaaaagaaaaacactgtaatgacaaaccagtctacctaacctaccccagaaggccaggagagttgcagcctgctgacagctcgccaacaggctccgctccgccatctaggaccttctggaagattctgcggttctgcccatggtgccaaggaaagatatttctttggtttcaaggtcctacttaaatttcaagtggctgtccatgttctcataaatctaatcagacaagttgcaagaggggctctatcaatgcagctcaacctgatacataaacaccaacgcaagctgctttcttctcctggcaaagaaaagaacacttgtgatcactgacaaactgccttctcctttttgcacataattaatcctctcatgtttttggaacatacctctccaaaaaaataaggttatatgccatgtcacagcacatccatatgattaatacagttattattagaaatgggagtgtgtggtttcaattatgagttatcatattcaattcttaacatgtttataatttcttcttaaaaaatgtttggagggatatctcttccttcaaatcttttttttaatacagggctgatttggtttgaggtctaaattaggcttaccaatatttgtcaatttcaatagtgtttagtgtctatttggtttgaagacaaattttggcatgcataagaaaataggccgtttcaatagtgaacttagactattttggcttcaatccaaatataactttaccttaccaaaattagtcatgccaaaatttggcattgacaaaatttggtaaggtctatttagatcacaaaccaaaccaacccacagttattatcaggtaattttgccaaagtgtccaacgcggccgacgcattagctcacgctctgatgaataatttaggtaacaaagccgtcaaaaggtgaggagatccatcatgaggagcacaacgcgaatatgccaggaacactatgcaagagcagggaagaatctgggcatgataagatcgatcgaaagctacacaaaaaaaatggtttttaatccagcgtggtccagcttcctgatggaaatggcgctataaattattatcaggtcaagaacaaaaacatgtacgggaaaggcattgtaaattcggggttggattaaaaagttcagaaaaagaaatagtgggaaatttcggccggccatatcatgaatgaactccaccaagtatacacttgtgtagtgcttgacaaagaagcgatgatgattggtactgcaacgagtcgatctcatgtcagtaattcgtgataaatcacacttgtaagttgtaactgaactaattacagtggatttgtgcaatttactttagttgaaaggtttaaactgttttcagattttcgtagacttgatgagcagcaaattgtagagctacatatatgccgactaaacagtggcttagtacatcgtattattcatatccgacagtttatcaacactcaattgcatgcatgtgcgtgtgatggtgacttctttgattatgagaccaaaccaaacccctcaaacactcactaaaatcacagaatttgattcctcgtgtcggctaagtgacgattttttaaaaacaaaattatggggggagaaatcatggagcgttgattagggatggttttgaggttcattttggagcatgtgaagatcagcatcacgactgggctgattatcgctccatccaaccccaccaaaccttggaagatttggcatctgttccagccaatcagcgaccctggaatcaacatcagacgcccttaaaaaatttcaagttgcaattaatgaacggcgtttccaatccattgcaagcttgatcctcatgtttttataataaaaagggtcattcttgagttcattttcatttcaagcaaaagttgactttgctagtttaaacctctttctgtattcaggctgaagaaatgatagaggaacatggctctggtttcccctgcaggccaacagataagaacaaatcttgcttgaaattgaatcactagtgtaggatatatttttgtattctgtaacttgcctcggttttcagcctttcaggttggttttggtattggtcttttgctttgcttcactgctcaaacacctgcaagttgaattttttgcactaatgatattctgtatggtgaaaaacttattatatatccaacctgcacctaactgtataattgggcaaaggttctactcgtgcgatgtgatgtgaaaaatgtgcaaaatacagcgtaaaagctcgtaaaaggtgagaatatatagctagtgttaagatgctccagctagagcagcttgcttctgagtcacattatgcttgaatttgacagagctccaacaattatgtctcagagtccaaccaaaaccaagaaactgtacaatgtgctcagttcttttatgcttcctatcttagccgaaatggacagaatctttgatctcccaatgctcttgtcatggcaagcataagcataacacaaagatgaaaaaaaaatgtcaaaattggattgagcagcatgaacagagaaaaatggaattcttttttccaccttagctctcaatctctcattgtcctccagaatgttgtttcccattccttcacagttacacaaagctggagaacttgcaggattttgcgtacaaattgagcacgtaattattgcgagctaaatataatcaagctaggaaaattaagcagcaattaaggtagagagattcaaattaaaagagaaagaggctaggactagctatagctagcgccatgggagagcaacagatcttcgatctgtcgtctcaggcgtcatggaactccagcaccaccacggccttggccttctccttcctgccgccctcgccggcgccgcggagcagccgccgcaccgccgcgatgagccgctccgccgcggcgggggacctgcagccgagcgcgcggcagaaggcggcgtgcctcgcgatcgccgcctccacctccaccaccaccgacccgtcgtccccggcgccgcccccggcagcggcgagctcctcccccaccgcctcgccgcacaggccgcacagccaccgcccgccgtaccgcgcccgcacgcccgccgcgtacgtcggcgtgcactcctccctcagcccgcagcacgcgcactccgcccattccacctccaccaccgccgccaccacaacgcccggattaacctcctgcccagccgccgccgccgccgccgccgacatatcccaaaaaaacttccgatcgatccctatatccagcgaaagaagctgcaacccgtagaacacaccaccagatgatcggatcggatataccgccggtgctattcgccggcggcgaggaggagaggtggctcgtccatggatgaggaggaggaggtggtggtggtggttcttgggcaagcgaggcccggttggtgcagcggctggtagtgcgaggcgcgcgcgtcttttgtatgcgacgaggaggaggaggaggaggagcaatgcgtgcgagtgtgggcaacaatggcgggagaggaggtggtggggtggggcccacgagcaaattaatcattgaggttgggattttcatctttgattaatggtttgatgtggtaagcttgacactttggcttttgctgagctggcagtgactcagtgactcgcccagtgagctgccagtgacgtcgacgttgtagtgatggcacgatcttgatcttgcgagctttgtgattgtgtttagctaagcagatcggtttgtggttttaaaacaaccgctaattccacgggtttaagtgagctactactcgtactacttgctagctggaaaagggctcaaaattgtgggctgcagctgcaaggatgttacgaacagcagtattactgttgtaagagtactggagtactatgttgtttcgaactgtttataactgttgtactatcaccaatttgcagcattatcattcgtcatatgatatcgaaattatgcgttctggattttactgcgtgtggtgccatgtcaggggatacaatcatacaagctggcaactgatgccagcaatgcgaacagggtactccagtacagagtcatgcacagcttggacagcttttgcttaaacttgctcttttggacagctcgcttactgctctcattatgcggtcccaacccaaaattttttaccctgccacatcgaacgtttgaataacttcgtgaaatattaaatatagattaaaaaataattaattacacagattacgactaatttgctagacgaatcttttaagcttaattgctctatgatttgacaatgtgatgccacagtaaacattttctaataacggattaattaggtttaataattcatcccgctgtttactgacggattctgtaattagttttttaattattgtccaaacactccatacacatcaaaacgacgctctatataataataatatgacataccaaagctttacggcatgatctgaacaccgtatcgtgctcgtgatgctttctgaagtggagtactctactagcttttggatgcctttgccacgctaaaaaactgcagattacggcgcgtccaatcgaaattcgccaggtaatgtgaaccgcgctatggtcgctttttgtgcgtgtgtgaggtgtccgaagtactaagagctgcaaagtcagtttaactgcttctgtactagcggcaaatttccaatttgccaattcgattgtgtttgtccagaattggttgctaacaatttccggtgactctaccggtcagaaacaatttactggtaattctctgaagtttctgaagtctgaaccatctcttttcggacggggacactttctgttcaggaaagctctgtctcttttttcctggcttcaggacatttacatcaacaaaaacaacttgatccacaatctcgatttttaccgagttttcgcatcccctcctgaattgaatggttctagaacaaaataatgtgatccaatgaagaatagatgcgccagcaatatcttagtgcatccacaatgattatctataagctctctacaagagatctatgtcagtatattttcttatttggaagagattaaatgaagagagagaacaaaactatctactaacctggagatagtctatagagaaaaacgaggcaatgaattagagagctatagatacccatgtagacatactattgagatggtttactattaatctagtttattgctgagatatacatgttttatagagagcaccttactttaccattgcgggtgctcttatgcctaccctttattaagacaggcatgaacagaaggccagccaatagaaatctgagttgccagttgccacacagatgttggcaagctcatacaggtggttctcagcctctgattgttgccaaacccctggttcagaattcagagttcatcagagcctcagaaatggtaaaccttcggagttcagatggacctcaacaaaacaatactaggttgttctgtcgccaaattgttctgtaaattctacacatacttgtcgtaaatttgcgtgctgattgaccatgatgctgcagcaaatctgcaaatgcaagtgtaaccaaagagcgtataggttgttctgtacttttctgataagaaatcgcatctgaaaggagaaggaaataattaaaaaaaaaaacagtttggctgtttgtttgtcctcacctagagagacgcaccgaggaccacaaaatcccatgcaaccaaagaatcattcgccacaaagtattcgctcctccacctcgcaccctcgaacagcgcgcacgatgctaacccgaacacaaaaaaaaaaaatcacaaaagtacaacacctaccatgacatgtgggtcccactacacgtggggccccacggatcagtcgcacggctcacgtacaggccggtacagcgcccccgcgcgggccccagcgcatagacaggtggggcccacggcttccctcacgggacaaacaaacacgccacaggagtcgccatttcacgtgcgggccccacatgtcagccgccgcggggttcggtttggctccagaggtagtacgctttagccggggcgaccgacggccggatgcgcgcgcaggggccgatcggacggccgggaggcgcccgtgggatcctatcgcgtccacgaataatataaggctacgagtcaacacagcgaacaagaagtgatagagagagcgagctaaaaaaaatcgccgcagaaaaggagagaagagaaaaaaaactttgggcgagaggagaggaggaggaggaggaggaagaaggcgcaggtgagatctccgatccttctagaagcttctggaatcgcgcggtccaggtagaattatacacttgagggggctgatgcgtggtggtgcgccgccggagtggtaggtggcggtcggggggagtgggagcttctagaagggcgtgtcgtacgtgtgcgagtgggttgggagtcctctggatttatcggttcgtcgatctcgcgggaggtgagggcgccgatggttctagatcgctgtagatgatttgtcgatgcattgaattgggctttggtgcgcttggtctgcgcgcatgggggtttttgtggattgattttgataagagttgctgaatttagctagtttttgcggttgatttcgttgggctccaagttgccaaatgctgcttacgcatcgctctaggtggtttttcgttggatcaaactggtattttggtggttagattcggggcgtgtgagtggtcaccatttttggactaacgaggtctccccaattcagtaatttatgttcttactgcttagtgttactgttacgttcgattgacttcttcatggaaggactgtacaagctcgatcaatatcgttcggatgtggcttgagtgtgaaaactaatgccttgtgtcttttttagcttagtagtagatgtctctggatgcatgcgttggtggataatagtttgatggggtcatctccgcgttggatagcaattaaggttactgttttttttttggctattcttctgtcagttctgttgattacaacagtttttagctattttgcttgagtcatcgtctgttgacagtgatgacagtaatgtggttctcttgcaacgatgatgaacttataatgggcactctttttctttctcaaagattgttccatgataaaggaaagtacatacttttagctatgccatgcttaaagtcaccagtatttttccatttatcggataccccatgtaacaatgctacaattagttgtcgtgatctatgtttttgggctgaaatgtaagctggaaaccccagtgtgactctttaaaacctgctttcagaaaagcagggccatctggcttatcatctaaaagaaacaatgctacaattagtagcttttgcccatagttggatctcccataagacaatgctttttgctctggtactttttgcattcaaaagtatcaaatggacagacattcagtttatttcgtcttgaatgcatcttgaccgacaagggatgatcagagatggccagcttggcgactgtagtttctgtctgtaggcaactgatttgtttttgcgtcttctcaagtgcaatcctggtgtgtcaacttatttgtgttctgatgtgaacttctaagattaatttgcaggtttccgtctccatttttagctggcagaaaaatgggaaagagtttatttctgtgtgacttggggcttacttttacatgtccaattctctttcttgcattctcttttggtatgtttgacttgcagcttataggatggatattttctttaacttgcaatagactgatagtatgattctgataatcacgtgcagtcttcatggccatatataaatgttcaatatcttgattcttccataccatatgggatttccaatttgtctgatgtattcaccatttatcaacttgaactatgtaataagaactttagagcatatattttgcaccgaatgcaatccaccattcatctagttggataattcaacaggttctatgccaaaccagacttaaaaatgttatggtcctgttttttcttcaatatcattggggataagttgagttccacataaatgtagttgttaggtttctttgaatctttgtttctagcaaaaccatcagctgtttctaggaatctaagactgccttgcacaattctatatgataggaataggaagaatatctccagcaagactttcatctgcttatcatcagtatgtccatcgaagagagaacattaagtttgataaacaagaccactgcgttaaatccaaatgcacaagaatttgtaccttcatccctcagatctatcaatgatgtttcaaatagatcagacacatccaggatttctgtatcaggatcctccaaagacactattgcagatcaacaagatcctgttataccaagtaaccctgatgaagaagcacatcggtactggcaagaacagcttccagatgatattacccctgatttcaaagttctgggacaagatgagatgcctggacctgataatatttcactcactggcttgtcaataaatgatagcattggtgcttcactattttctccaaaccagacatcgaatttgcaacaccgtgcttctccttttattagggacactctgagcacacgatcaaagatcgagtttcctagcccaacttatgtagaagaacagtcaagagctactattatgagtccaactgcaagcgctatgagtccaactgcggctccgtgggtaaaaacagtaagaaatggtgtgcaatacaatgcaaacagaagggatgccagccattacaatggagattctagcattggtatagtgttgatttcatgggtgtaattttattcactgaaggtagtagtatgaaccctaacctttagaattttcaggagctccagtgcaaaaccttactgatgcatacttcggaagcaggcgcagctttagctcaactatggatatcatgagtcagctggaggtctgtttttcttctgatattcatctcaattttaaatctaccaattttttctctctccaactgtgccttggggcttggacagttgaactacatatgaatcataactggcatgctcatcatatattacagaaaatttcataacaagcaaaatgcttcatagttcttttgttttttttttaaaaaaaaaccatcaaactactttcactatatggttttacatcaactccagacaagttgtaacctgagcaaagatgtctgacaaaacaatactttgaacatttggcaatagtccttgattgaatgaatgctagactattgagtggatcttgcttcctgtcacccaattcatacaagtatacagcattataacactttttagttccagattattaacattgtagtatgatactgatctataaataatgagaccccatttaatgatccaccgatatgtttttcttcaatcaactgaagtttgcacgttcaatactgaatattccatgtcatttttggcatctgggctgtattattgtttttttactctttataatcaggaacatatgttcagtttgatttttaaactggtggcactctgtaatgacctcatgtgtttgtccgagacttaatgaatgaaatagatatttgaaatttgtgactttgaagtatatttgtttgagtcaatctgatgttaatataaggaaaagcttggtggacttctagtgactgaaaactatttgaacccactgattctcctaatctacaacctattaattatttcttctcataaaagtcactcaggcaactgatttagaacattatattgttgttggacagcttaaactgtccatgctaattatgattctactggggctgtttactttcttgccaaaattaaccctaccaaattttggcaaagcaaggtaacaattcaacattgacataaattgcctcaactaccaaagttggtaattctagaatcttcctcacaaaaacttggcaaaggtagcaaaccaaatacaacttttacacatctcaaccaatttggtaaggttgattttgagattgaagtgaacagccctgaaatggcattatgttctcaaaattatcacttgcattcaactttgaatacgactatagtctagaaactaggtgggattctatatgtagatgactatgatgagcgaggattatttcttgagcccattcattatagaaactgatataacaacaatgccactgttggttctctgttttagataccacatagaagtggttgaatcatcaacatagtgtccgagacttaatcagtctcattcattctggatcagattagtctcttagcgaaactcccctacttttttactataagttcaagaaatatttgcttggaaataccatgtcgcggccatgtctgttgacgattttcttccatttggccatgcttgatgggaatgactaagatatgattacatgcatgatgtctgcttcaagcatttatttaatattatcatatgttcattagcagaataaagttgatggacgattcaatcagaatctgaggtcactgtcgtttggacattcaagtcctccatcaccagcatcatatggtcaaaatggtcttgcaaactataacaaagaagcttttggtctggcaaacaatacatatagatcccactcagctgtactcgcagatgatatactttccccttcagctggtcgggaacatatttctctggatgctcctagggggaggtacaatacaactaatttgcctgtttctggtcttggttcaagcagaggctctcagttcatggcaagctcattcaatggcaatcatgacatagtctcaaacaacaccctgcaaaatatagctggagttcaaacaggacctgcttggcttgaagctgatactgcaggtagtgttgaattataatgcatgttttttcatggacctatcacagcatacatgcctatttaccttatggttgaacttgtctgtgatgacagcaaacatgtttttggaatcaaaggatgaagctcatgattttgcaagcctacggcatgcgcttctggaacaggtgcatatgctctacttttcgatactaaattattgttacatattttaaaaccaaattattgtgcatgtgagcatgttgttaaataaatattgacagtattattattctattttaatgggactaaggttgtaagtatcgacaatattagtaatcatcaagccctaaaaagttgtaattgagttacatggttggtaacataaaaatactagcaagaaaactacttcatatcttgtcaatgtgacaaaaaagtgctctgtatcaaatatttcacagaatgagttcttttggtgatgtggtaggcttatatgttatatgactagttttcaaatccaatttggtatgacttttttttttttttggggggggggtgatggtggcacaagattattcattggattttattgacaatacatgaatattagatatggttttggaattgttgtttatagtactcaaatattatgcctcaggaagataccttgaattatgtaaacaacttactttttcttggttcttttaatgtattcgctcacagtccgctgctatgcattcaaacttttgacaggataggcaggttcttttaactggtgccaatcctttagcaaaggaactaaacatcaaggagctttacaatttgcaaagcagactagctcaggaaaaggctagagatgtatatcgccaaaggttagacgctaatctcattgacatcatcacctattaatagaattatcgtttatataaattcttactccctccattccacaaacctaggactggatatgacatatcttagttcagattcattgtactaggatatgtcacatccagtcctaggtttgttttttgtgggatggagggagtatatgttgatataatgtgtatcatgagacatcaacacacctgctcatgaaaatgattctgattgcatttgtcaatccttttcaatgagagaatttaaaacaatgcatacacttgcattttttgccttgttgagaacttgtattactatttggactttcgaataacactaggacatgaaaattacctagataatgtcataacaggtcgtacaggtagcatgaattcaggttactactaagaggtttttaattctgattcaacaataactagccaggcctttgcactactagtgtaatatattatttccttttgaactactaaggtaggtttgcataccgagcaagttgcttgagtttgcaagcgtgcactccttgtctgaatacggtgtagtagttcctacaacatgctctatctgtttaagattctatctttctgtttcttaccatatgatgaaagttctaatccattccatggctttaccagatttcaaatgccagaatttcaaggcctggttcaggagcaaaataccccaattgacctgtgtggtcttcacgtaagcgaggcgatacacgccctgaactatgagctcaacaaccggcggaagattgctcgatccacaggccgtcgtctccaggtgatcataatatcaagcacacgtactccggcgaggctgaccgccgccgtcgagcagtacctcctggagcacggcattcagtatacgcaggcacagccgggccttttccgtgtcctgttacagtgaagtaacaggatggtaggctcatcatgtttgtgtacacctttgaaagaagaagaaaaaaaagaggaggaacaaaaaagaattgacccctgtactactgtatatggcagagatgagtagtactagcagaatagaaatttgaaatagctgttgtaatattcgtatagcaaggcttttttttttgtcagcaaaaaacgttgtaaaatttgcggaattaggcgatatgttctttcaatgtggcgtccctagctgctcgttccaatctaacacgcatgcgatgcaggatgctatttggactggaatcagctgatttgcgtgcagatttgcgaaagtaatacatgacgcgacacaccatgattgaatcttcgtttaaaatcaaaatggttgacaactttctttgcaagatttttctttttagtgcgtatagcactgttcaaccggttcgtgcatttcttttttgttgctagcaactttagcaaagatgagaaagggcaaaatggcgaatagctcaaggtcgcaacaaatgcaagcagcatacaagtaaatcgtagtaaattcaaccacaacgatagaggatgatccaacaagtaaagctgatgactgttttttggagttacatgaaatggttcactgaatgtttcttggctgaacatgaaataaaatgacactgctgaaagactagagtgcagtgtgaagcagtaacatgtccaacttcattgtagctcagtcgcgctcacttatggctgttaggtgctgatcgatctcctctgtcgtgagtgctctgaaaacacgatcatctttcctcacaacaccgacctgccaaacgatagtttatctgataagcacagcgaagcagaactaaaaaaactttcagaaaagacttgcgtataaacaacagcatacctcaatctcggtggccttgaaatcttcctgaagaactgattgcaatgcagaaattgcaatctgggatcataggacaaaattagcaaataataatccagtaagaacaaaagtaaatgactggaaaaagacctcgcaatgtttacctggacagtttcctcgtaggagaactgtgggtcatccttcattttcttctccagaaaatttattgcttcctgctccttaagaccggcgctagttgcctgagaatagaataccaggtgttaaaggaaacaaatttctaatcgtccaacaaaagacagaaggctcaacattcgttcagctgataagtgaactacagaatgaaaaaggaaatatagtttaacactctaatgaagcatacagaaactgtgtataccttatgtccaaagaagtgacctgccgggtcacatttgaatagttgagcgtttttctcttcgtcatagcccaagaccatagcaactgtggaatataccaaaagaaaatgaatatggagggcaaataagatccaagctgattggtttaacattaactatagaacagaagccaatggaacaataggtcacttgatgatacgaacctactccaaggggcctcatgtaggcatgctgcgtgtagacttgtgctttgtctgctatcctgaaacataaaccagaaaagttagctatcactttgttataagaaatgcaaagatcatatattcaaccacaaccctattttcacaaatagagaacttaaggatgagacatgataccattttgctaatacgtctacgggcatctcgtagccccatttgaaacggaattcagctgcctcattccttgcttggtagactaaggaccttgcatcagctgaaaaacagaaaaaggaaaacaaagtttatgatcaatgaagaatgaaggtattcaggaaaaacaaaataagaaaatatggtctcaatgccaaattatcactagcagaacaaattatgtggaacctaatgctacaacatatatactactagaaagcaagagccttcataaggaaactgatggcaaatatgaaagagcttaattaatatggtatgcttgcatttgatccaaattttgtggtgttttcgcagtccccaaaagaaaaagggcagtgctttctaccattgccctaagagttaaaacaaacagagctaaacatactgatataccatccagtgcctcatgtacaacccaaaacaaccaggagaaccatgccctatataaagctctagcatcatcgcaaaattaaccggcaaaatcactgtgggtggtctatttccacagcatctatctcaaaattgatatctggaataacttaatcttaaacctaagacacacacaaaaaaaaaacaactttttcttcatcatcaacacgcacaaaaacataacactagttatatacagtgaagcaaagctgcagagcaaacaaacctgtgaggccagtggcgagcagaccgatgtacttggtgatcgggaacaagtgcgtgacgctcgtatggtccagcaacttgtcctgcaaaatcagaatcacatcacaaggagcaagacaaatcagtctcctctcctggtctctaatcgccgtataaacagcataaagccgcgatctttttagatcgaagcgaagagaactcaccggcactttcttctgtgtgacgacgcagacggagtccttgccgcggacgccgatcgacgtcacccccgccgacttcaccgccttgaacgcgtactctgcacaacaccaaaacaccagatcaaaccagatcagatcagcctcccaacatcacaaaaaaagcagatctaacctcgagcggggaaaaacgagggcgggcgaggctagggttttagtaaggggggagaccacgcaccgacttggtagaggcggccctccggggagaagatggtgatgtggcggtcgtagccggcgcccgtgccgcggctcatcgtcgccggatttctcgccgccgcgggtggggtttcgcgttcgctttgctccgagagaatacggcgaggcttgtgtttgtgcttggttggggaggcaaaataaaccaaaaatagaaaatagacgcacgcgacggcggcttcttcttattgcgcaagaagaagagtggagggggtccgggtcggagtctcgctgcagtttcggtcgagccggactcgagggtccgactcgggctatgggagtgggacggggggttgtggccgcatcgcagtgctggtcgcttcatagccgtcagatcatgcgaagtcaatctcctaatagcctgtgtagtttgcgaaaacgtcggatgtttgaccggatgttggaaggtattttcgaacacgaataaaaaaaactaatttcataacttgcctggaaaccacgagacgaatcttttgagcctaattaatccatcattagcacaggtgggttacggtagcacttatggctaatcatggactaattaggctcaaaagattcgtctcgcgatttcccccttaaccgtgcaattagtttttcattttatctatactagaaaaaaaatgcccgtgcgttgcaacgggtaattaaagacgtttttatcactgtgcattatacttcttcgttggttctgggccgaaaatccatccctttcttccttttcagttttagctctggttgttgtctctttccgctcggccagcctctctttggcctagcttataagtgtagctgtaaacccagctcgcacaatcaaatgcaatcttcaacctccgaaagacggtatcatgcctatagatgccgaaggcatcctacccatcaaatacagccgagtctttgtcgacctcccaaacttggctcacacaatcaaatgtgatctttaaccttcgtaagatggcctgtactccacattctggagccatcagaattgattgagggttttaaaacagcttggaaaactcgttggccagccatcatcagtaattgttaaatggagactaaatctgacgaattaaagcctacttggaactgaaaatcatggcaaaaatgataaggcagaaggggaaaaaggcatattgacgtggtggggcagattgatgtgggactatgctagggttctgccagatgacaaaaaaaaataaaccaggtggataaaagctcggaagccttacacatgcgcaatagaaaaaccgtggcagaaaagatatccaaattgacaaaaaaaaagcaacgatggaaaaaaaggaaaaaaacggatctaagatattcggattgaaaaaaaaaagaaaaaaaacgtgtgcaacaggcgatggaaaaaacggatctaaaagtcacgaccaaaaaagatcgggcggaaaaaaaccggagaaaaaaaccacgtgtgaaaaaaaaattggacggaacgcgcgagggagaaaaatcaggcgagtgacgtacgaaattttctggacaaaaacatcttaaacttttataataggtaaagatttaatactccatgcatttgtccaaatattcgatatgatatttttgagaaaaaaaatttaggaactaagcaaggcctaatatttgacatatttttcttcgttggagtggataatctggcctttgcttcggtttttgtttgaggaggggggggggtgtaggttaattagcgtctcaagcttgtcaggcataattgttatgttgttacatttcctatgggatgttattttgttttcagtagcaggatcagacgtatatgtggggtgtagtatttttttccataaatatagtttcccaggtcttgtattttttttctgctatataaataaaaatatcatactatcttgtatgggttgtttaaaaaaatacagttgatactttttgagttttttatattaactttaaagccgctggtaatataaatacaaaagttttattcatgaattatatttggttgcttcgtttattactctgtcacagaatataaagactttttttagagttgctcctttattagttttttttttgggctcattatctgtagctcaaacagtcaaagccacacataagaacaacggtggagttagaaatctaaatatttatttactaaggggagtcagtacttgatggtactaattatgtttaaaattcaatcaagatatagttattgtcattgaaaatctaaaatcatgtgggaggccttcgctgactcgagaagttgagatgattaatcctcaaaaaatcaccaataaatctacataacgccagttcggtcaggattttgcacatcctcgggaattggcagtaatttgaaccatcccaaacaagatctagggctcctttaaggcaaaggaaaactagagaaactagccgggacccgcgcgttgccgcgggtgaaatggtgggcataagagcaaagtattgacatctcatgtagctcctcagagctctacctaattatgtcaagtattagcattaccgttacagtcaaccacaaaatcgaagagtacctcagtaatagaacagttaaatcgaagagtgtacttcagtaatagaactggcttcttttgcccaaaaagtactgcaaggtatacatgctttagctatgttattattgctgaaacatctttgcttgtcacaccaccggttactaatcagtttatatgtcacaccgctttgattgctcctttgggaaaaccagtttgccaagtgctaatttacacctaaagtttagtatctactacgtatgttctaagattaatattttacacttagattggtatctatgtgttaagtgttaacggtgtcaacactatgatatgctctagtttacaactaaagattagcgcctatgtaaattaccagaaggctatatatcaagctatatgaatctgaagcaccacataacaaagacatatgccattaattttgtcaaatgttgctggaatatatggtccagtagaaatagaacaataagttagataatggagatatgtttcactggactaacagttatccgatgcattttgagctttaaagagaatataagatggatggtattagtagtttactaacaaattgtgcttctatcatcttgtttcggcgcaaaaggaacagtacatgcagttggctacaatgagggcatgatgtgacaaacagttaatttgaggttccaaatatgaagatatcgatagttcagaaataattataagtatgtgctagaagagatcatgaacatgatatatgctattcttgccaaattcctatgcttcatctttcatagagctgcagagaccaaggcagtttgctcaaaagtaaaataaataatttaagatgcacaaggtttgtagatcaaacctttagtttttaaactgtattacaccaacagtgacaattaatccctatacacagatatgtacagttgtacactccgatatagagagatggggaagcaagttggttgaactgcacatatggttgtgttcttaacaaaacctagctataagaatgcatcatttcaactgcataaaggaggaagatgcacgtatctttttaattcaatgttgttgcccagttgacatattaacctgaaaaaaaaaactgaaataggaatcccacacccatggtaccatttgtttgacccatccaaacacatggacctgcttaccatgcataagaatgctgaggacaataaaaatgtatgcattatagaatcctaacatatatagcattagctggtagcctggtacctccaacaacctagctcttttgagtcaaataagtttccttcttcatgctaaatcagtacatctcatgacatgacattttattaaccattcgatattcaatattgagatttgtaggtagtttttttaaaaaaataacataaccgagtaatttccagatatctcaatgtaacttagcacataatataagaaatattaaataagtggagataaccatcttgtacatggattgaaatacctgattataaattatagcttgttttactaacttgctgcagccatacatcaagaaatcaaatagtagtacattgcaaactctgagaaatcaccatgtgggtgctcaccggcactgagatggtcctggctcatgccacgctttatggtagaatttggttgaagatagcaaacccaatgctgggaggtactgttggcgatgccggattcaggactaatgaattaagttaggaatgatgaccaaatcaatgaagaacaggttacttaagccccatctatcagccattgctattaattccattgaacaactgtgcaaaaaaaaaaagaggccatttttggttcacgaagatccaaataaatcaactaagtatttaggtataaaaagtatacggtacaactacaacagttacaacctatgctcaacatccaagttgttatttgcttgccatagtggtactgcaagccctgaaagccacaggatggtcaactcatgccaaaaacatgctgaaagctgaaaaatttgcagaatgacaacatagaaaagaaggatatcactatacatgagaatttgtagaacaattctatggttaagagtttttcatgtaggtccaattacagcaagtattcaaaaagacaaagtcataggcaaaatttagagcaaaccttgtggtggcataactttatattttgcatgtcccattagtatttcatcactggccaagtttactctcgcaaaatttactccaaggtttagtaatatgcagcctgttactacccaatagtaacttgcaaaagacataccaactattgggcattgagcacgaaagtaagaaagaaatataggaaccccattgcaacgaattcagatcctctgcaacaggcagtcttggatgatattgcacttctgcagaagaggaacaactaaataaaaaataatgtacagagaagattgcatgtaaatttaataataataacaatttggtgatttcctattttcatggcccacacaagaactgaatagtagctcctgaaaatattttgtagaaggaaaaaaataacctgtgcacgaaaggtcatgataggcatccatgcttaactatctgttctttatttgagaagttgtcaaccatctgtcctaaaagtgtggtggttggaaatgtatggatggcagcccatagtcaatgaacgatgtttttaatatcctgcagtggttcactgcgcaatattgtcaatataactatagaagaatcaacttggatgtccctagatgaaattgtgaacatgagatccaaatcctcctaagcaaataaaagattgaaactgatagcaagaaagaaggggaagcacctaagagaattcatcaggagcagctgacgagatcatgggacctgcatgaagacctatcaatcaaatcaggaaaattggacacgaactggaacaaagaatcattaaatctataacctctcattgagaactgacgcgacgaaaagacggcggcaacggcgctggcctgtgcttccccgagaagcggcagtgccgaccagctctgcgaggaggcggcacaagccgttggctccgcctgaaggcagcggtggccggcttcggaagaggagggcggcggccggttgtggcgcttgcccgatggctccgtgagaaagcagccagcgccggctagatctgtcgcggcgctggtccttcgctcgctcgacaagaacctggcggcaccagcgagggcggcgaagccagcgccgtgatttccctcgctccgcaagaacgcagcggcgccggctagggcggcgaaccaggggaggatttggggatgagaaaaggaatcagggaggatgattcacgaattaacttgagaacctgggtaaggggacagagaggtagatcaggatagcggtggtggcgccatgcttcgtagccaccacagtcgccgaggtccggcggcgacgggccgaaggaatcaatccgcaaaaggcggcgacggcggtgacggtcgggcgtcgcgggaggaagatggcgcggcggtgacagccgggcgccgcgggaggaagacggcgccagccgagcatcgcaggaggaagacagcgctgcggcatggtgggaggaagacagcgcggcggcggcgccgagaagacgaggatttggggatttttggcaaggaggcggcgaggatgtctaggcggtggctggtgtggtgattgagtggactgaggggatggagggatgagcgatgaccatgtggacggctggatggaatcaccagttggacatctgacggcgcatgcatggcgagggactgtagtactgtagcagcatttctctggcctgagatgaatcgcaacactgttgctagtgggtcacgaaaactaaagatttgatatgatatgatttgggaggattaaatttgtatggcaaaaaaaaaatcctatatggttctttggaacaaaggaatggttcttctcaattcctttaaaattcttatggaacgggccatttcgagctcttttgaaatccaaaagtccatagaagtgctggaggaagagtagcatgcatttctgtcccatgttttttttcttcccgtgacataaagttctagtatttttttcctgtgttatccaaacggcaatttttaaaatttcccaaggtttttaattcctgtaggaattgaataggcatggcactttattgctatgcttttcctcttactgcgtttccacaatcctgtgttccaaaagagccctagtcatcctttggaatggaacaatgctggaggatttctcaaaaattgaactagtttccgcggaaatcctgcaaaattcttccaaaaggagaccctaagctgtactgtttagtgatactcaaacaaattctgcagttctctatgtcatagttgtcttcttttttttttgaagaacatttttactaccatcaaaacaaacacttatagtagaaatggcaagagtcacaaggcagagtgatccaagcaaattgtccgagttgaaatgactcgtgtacgatctctcactctcctgaagtcctgattgttagaagtataatatgttagttagatataagagtcaaatacaaatatagagataagatatatcctagagataaaattctagagataagatagagtcctagagatagaatcctagagataaatctactcttacttgtattgtactccaagtctctatcctctatgtactcctatatatatcccatgagagggtcgatccaatatatcagaaaacatcagaatacaacatattagattttctacatggtatcagagccatatactagcgtcaaccgatcctttgatacaatccatccatccttcggcgctgccccagggagacgagatgaatctgtaagctctccctggggcaacacaagctagctagcctctcctgtatcatctacagattagattagccaaagatcattagatgtgttttccattaattatcattagattaggggaatgttaaaagtataatatgttagttagagataagagtcaaatacaaatatagagataagatatatcctagagatagagtcctagagataagatagagtactagagatagaatcctagagataaatctactcttacttgtattgtactccaaagtctctatcccctatgtactcctatatataccccatgagagagtcgatgtaatagattagaaaacaacaaaatacaacagtttagatttttccacatggtatcagagccaaagaccaacgttgcttgatccgtttctaccttccgctcgcgccgccccggggagatgagataatcgccatatcctccctggggcgccacatctacaatcctcgggagaagagaaggagcggaagccacgccagtatgaacaggagaaaaaggaagcaatgcatgaatcaatcccatctagcagatcaagaaagaacaaaaggaggaaaaggagatcggtccaagcaatcatgccgtacgatggaaaatcaatctcgccgaagcatgctctgacagattaatctgcaagacgcttcatcaacgatatcgaccgcgtcctctacgacggcaacgaccgcgacaccgacgacggcatcgatcacgtcatctacgacgacaacgactgcatcaatccagcatcaccattgtgatgaccgctacacggcgcagaaggaccaaccaaagtggtggcctcatcgccaacgacatcctctgatatatgcaagacgtccccaacggcatcatctgacatctacaagatgcaagatgctaacaattgcagtttttgtcttcacaccatggcgtaaatattttttttcgccttcggctatttgcggctacatcaactaccacgaccacggctacttcatgatcggctacatcgacgaacatctacaacaaaaatcattgatggaaactccagtcaaaagcgtccgtgtcatcgctatcatccatgacactcccgctatgactgcgggagggaatagaggagagtcaagggacgacacagaaggggacgcaggcaccaggtggaggaacgaccatcagagatgcaatcgatgatgatgactcaaagagatgaagaaatagaagatttcaaatccagtcgcaatcgttagctttgctcccgttacgactgagggggaatgttagaagtataatatgttagttagagataagagtcaaatacaaatatagagataagatatatcctagagataagatagagtcctagagatagaatcctagactccaagtctctatcccctatgtactcctatatataccccatgagagggtcgatccaatatatcagaaaacatcagaatacaacatattagattttccacactgatcgccgaaaaaagtacacaagaactcccactatcctgcttacttgcttcctgatttgagtatgaaaccgtcaatttcagaacacagcaaacacatgatatggcaacaaacacttgaaaatttatgtggctaagtttgtcacacggcaatgcttcttggaagcaccatactgcgatctatcttaatgtttcttttctcggctctcggtgcaatttccccctctagtactgactttcccttttcatctcagctgcaatcaagaattttgttcatcggtactgggtcctgcttccaatcaagctcaactgggaatgtgtacagctcaagatatataaaattgcatcctagtttgctggacatggcagtggccatgagcctatcctaagataagatatcaaccaaatctcctgagtaatttggtcacatggaatatctgttcatctctcctcaactaggccagatccctatttggaatgttaaggagtaccaagctgccattcatctttgagctctgcatttctgccataattcctgtgagatgtgacagtaatcaccttgacactgtagtagtcagagagaaattcttcattctccaatcctgcatacgcatgcttctgtaaagttgcaacaagatcagagtttacccctatatatagtgaacttggagtcttggatcatcatccatcttcttcttcccattgagtccattcatccacatttttcttctgaactcgcacacaagaggtcacgagaactgctcatgagggtacacactcgattctctggttcttctgaacttttttacatcgaatgacaaatgctaattcagcaatcgttgctgctgctggttctacttcggtttcaggctctgaactgggtgcagacaaggctccacgggacgaggaaacaagatcacactgcagtgtcatctcgacgtaagtgacgatggttttttttttctcctttcagaattcccagcgtttcagagtttcagtcacgtaattgttgctgaatctttgatctcttgcaggcgctcatacctccggtgatctccaccggaacggcgacgagctcgacgacggctgggcggcggcgatgctgtccataggcacgttagggggaccgaagggccgtcatggttctggcacgccgtggacgacggcggcggcgggcgccgacgagctcgacaggctgcaggaggagctcaggctgctggttcgagctcaggcggtggtgaccggaggcgaggacgacgacggcggcggcggcggcggcaggcaacgcaggtcactgagccgcacgtcgagctccacgaatggcagagaggtggtggccaagctgaagcagagatcgatcaggaagatcatggccgctgctctcggtggcctcctgcaccggccgagctgcagggagacgatgcctgaagcgactgtcagtgaggtagtaggagtaggactactccaatataaagagcatatttgttcattcgattttcagaaatcagaaggaaattcgtattggttcttgtgatttcatgctgatatgtttcgcagattatatggtcattgttgcacaagaacacgcatcctgaaaaaccggcgttgccacatactgtgatgaaaggtgatccaacggttccgacgccacagaaggataaacaagagggcaccaaatggatcagaacagattcagagtgtaagttcatgttcgtctgacagaaaatgagaatagtatattgtagcggttcttgcaggctaacatatatagaatctgatgttttacatccttgaattcattccccagacattgtgttggatctggagatatagacacccccggtggcagtaaagaggcaacaagaacaatttcctggatttttttttcttttcttgagagaggagactagcgtttcttttttgtacgaccgtacttcagtacatgtacatgtctgtttacaaaacgtgttgtcaacttctattacaaaaaagggtttcccttttgcttaccaaataaaatatcaaaggagattcgagtcaggtcctatatcaaactaaagggtcagttctagttgtcatacatcctgccttggtgtaagcaaacaaaaatatgatatggtctctccccaaccttcaaatgtacatatgccatatgctcactcaagtgcacagtgcgcctataatctctggaatgaacagatgttcaagcaagctgtaacaaatacatgatttgcctacctgtcgaatgttatcatgcatttcaacctatgacctgcaatttgagaaagggaaggtaaggcttataatctatggaatgctgtcatgcatttcaacctatgacctgcaactgcaaatttccttacgaaagaaattggtaaggcatactcaggtgactgtaatgaccatatttagtcatttaggttcaagatccgacctggttcaccaaggggagtgcataacgttcccattctgtcgaccatttggaagatgacccagtattcaaggcaccaaccttgagggatttcaagtcatcgcattcttccggaaaccccttaaagagcatctgcatggatttgcgattgcaacaattaaaatctagacacagcactttcaacaagtatttaaaaaaaagatatgaacataaaatatggaaataaataattaaaagtgatcatcaccataagttcatcggcaagctcagaagatgttgaaaaaagaagtccattattatttatttttacaagctcatcaatgctgcacatacgaaaaaaaaattaggacatacttttaattcaaacgacatgaaggtcaaagcccaaatgtaacaaatcaaacatacgggaaacatggattaccaggagaatgaagcagcacaaactggtaatccacaaccgaacatatcaaccacctaaaagcaaaatcgtcaagttacacgcaacagataaaaaatgcctattttttcaacagagcggatgcttatgagttataccttcataggtaggtctagccctgaagaggaagtatgcaatgatacacctagatcagccgatcctgtaattattcaaagaatcagcatttatgctacaacatggaattcttttggcaatcaactagtttaccaagcaaaagagggtagtcctctgatgcaagccacatagtccggaaggcaacacgcctcagtttcaacctctttatttgctcctcatacttcatcctatcaggtcctttgccttcaaaattgatattcatggatatcataacaatactcaaaaactggttactggagctaattagcagaatgcacaaaccagtgataatgaatagcagtcttgggtagacaaattgcttcccgttcttgatatcaatccaaagctttccctcgtccattgaatcatcttctcctaaagttgcagcaacacgtctatcgtacataagtgctgcttccagaagtatgctgaaatcttcatctggtgtcctgaaatatgtggcaaaggaaaagattcttaattttactttcattttaaccacatgtgctgagtataaataatgatacaactaggatcacccagatcaagagaacagaccagcttgtgctgctgacaacaagagctggtctattaggcttcaagaaaatttcaccatcgacccagcttgtaaatacagtagtgttcctgtcttccacttctttctctgtgttgtaagagcaaacagtagaaactatatcaaagtgaaattttcttacagcaatcaaatatttagagtggctggagaacataccaacagaaatgcaatcgtcattgcccatagcactacaaatggaattccccaacctgctaaacaactatttcatctaatggtcagataggcagtacagcaaagatgaggaaataaatgaaaacagatgctcacctcatgtttctctgtcaatgaagcaggatggaaaaattcaggagattgatcgtaaagaactgttgcgctgaaatccaaccagttaagttaatataaactgtagctagcgacttcaaaaataaaagtagttgtgtgctaacacaacagccttaaacatgaaaagtgcctgaaagtttgatcttacttgattccccatttttgatcaagctcgtgtttcattgcttttgtaacacagaaggcaccatcagccatccgtccaaaatgcttctcgaacctagaatgcaaagaacacaccactatattaacacacacaatcagtatgctacatctagcagataaacaaacaggacaggaattaccagaagtagattttaacaatgatatggcttctgccatgagacaacccaagcagtgtatatccaaagttatgccagtccacaataaacttagcacctcttagccagctagccagttttacagcagccaatgttggaacagagggtggattctgttggacagaagatgatcgaataaaagaatcagttccatgctagtgtgtgagattttcgaattaacaaataaattgtaagtatcaaatagaaggatttctaggtaataaaagtctatgtcagttagtaaggccaaaagatactatacaaaatgacaaaacttcgcctaagtaaaggctgcacttatcatagctgaaattttgaattgaaaatggtgtaatgaataggtactgcataagtataagtctacagcatgacttgctaattaagctgtgcaatactttggtaagaccatggatttactagcgtgattgatagatgatgaactatagaagaattccacactattgactgatagtaattgcagaaaactataaattgtccatgtaattctgaaccatgcatgcgactaaagaagctcaatgcaattttgtgaaaactgacctgaacaatgaagacatcagggcgaggaatcttgaaacaaaggtaccaaatcaatatgataaactggatggcagctttaagtagcagtgtcagggcaccggatatctttaatattcctgttaactgcactgatttctagaaggtacaattcaaaagttaatagtacacaaaattagagaacagcgtaatgctttcaaacaatcagtaccatttcatggatgtgaattgatggattttctctcaataatagatgcgggtcacttcctgctcatttacccaaagcagaacataggtcaaatttcaacaaaagacgcaacagaaggtcgaaagttgttggaaactcagcctgtatgatgtgcactaagtggaaggtataaatgaataaaatccaaaagtacaatgaaactgcaaaaagaataatacctccatttgcaacaatgtccacttccataccagcctgtcaagaaaaataaagaatgactaattaactaaaacatagagacatatgcacatagagttggttcttcccaacacatagcatgtcccaatatcacaatttttttgccacttgaagaaaatatatatgcttagtaaatgcaaggcaattttcttctcttcatttcaaaacctgtcttatctaacaggactaatatttgcacgtgtaatcacactttcagggagaaaaaaaagacacatttttaagggagaaccaaaaatcaagggcattaatcaacccgaagctatgtccgctcacgctttcagggggtgcaaatgaccaccactgcattagttacttcatctgtgcaatcgcacaactgacacacaccacatctcctttctttactagttattaccctgctatctaaccgaggaccatatgctacactagagaagtgatgaattaagtgcaaaattcatgaaggaatattaactatcacagcacatcgaaatacacctacagctagctggagggactaagctttcccaatcaaaacaaaacagaactaatatgagatgatgggtttgggaaggggatcaatacctggttggcgagggagagggagtggtactgcatgcgcgggctgcgcccaatgtctcccagaactaccaccgccgctcgcttcctcctccctgcctctagtgccacggccattgcctactagccttccgagtttggaaatttcagattcaaccgccaccaagaagtgaggttcctgaaaaggcatttaatttagctaggtattagctccaaacatccaggaagggaggagtagataaaaaatggacaacggttctcttggttatttttctgttcaccgcatttatgctcaattagagaatacgtctgtactattttacatcaatacaacaatgttctgttgacggaacaagaatgtagggatgcaatatatgctagtgagtttatactcatgtaaattaattcgttgtttcgcatattgttgaacgcaactggagattcattagtttgtacgaatgattggcaaccaacactcggatagtatcggtactgtgtattccacagttctacaagtagcaaaggggactagtcctaatcatcagcaatcgcttaggaacatacatgaatttcattgtcctaaagtcaagtcaggttgttctgacattgatctggaatgggcaaaatcgagcggaagaggggcgagtttctagggttggggtgggtgggcatacctgctccgccgccgcacttcgggtgcgtgggggagagcggcgccgcctgcttccccacccgtgcgctggatccgatcgccgtgcgaggggagggggatacagggggggacgccggacgacgggacgattcctccggctgcctccgacgggcgacggctcgtcttcttgctcctccccgaggagtccaaccaccgcgactctcgtccttgtttggcaggccagaattccggcccattcattgtaagtgggctgggattttaactaaaggaaatcccgtcctatatatgcacgtggacgggctgggattgaggcccattcagaaatggcctttgctgtatttttacttttttagtcaacatggatggtctggcgtcctggcgatatcatcagaactttgtcgcattctttgcactgtaactccctgacgaacacaccttccatccatgggaagtacttgggatttgggaacaggcgaacgctggcagcagtctgaccttggggcaacgggttgcacagcagataactgtgcagaatctcatgtaatcgtggctatgtgacgggctgtgatcgccagagtttttatcacgcttattgtattgtttccgcaaccgctagcagtagatgcggcagccagttgtctggccggctacccaacgcttcaagccgaagacggtggcctgaacctccctcggggaccgatggcagccggaagatggcaggaaatacgacgacgagacgcatctcgtgcccgcgatcaattggatgccggaacgcgtgttcgcgaccacagctgggtctctccaagtccacgggaaccatggggggctagcttatagctctcgagtcacgagtccagactcgatcatccacaaccgagtatggaatagtaggtagcagagctgtccagaaaaacgggagcacatgaacgtcgacgcctcctgtttgggcctcacaagtcgcgtcacgttcgttgggctctcaggtttttggtaagacgggacaaacgttccgcgagacacacagctaggtacacacgtactacgtacgtagcgtcgtcacacgcagcacggctcctatttatgtacgtaccagccgcacggccgtacaatacggatcacaggatgtttgcctcgtactaatgtactccgtactgttcttcggaggtgctaccgttcataaggaaaaaaaatggagaaaaaattatgcaacttgcggtagaacccagtcagtgtctcatactttccctcgcgaagagggaaatgagaaccgtactcatttgcgaattgcgatgcggattcaactagctgacagtgacaatgaacacgtactcaacgcaccaccgcccaccggcagcatatcgagcaacacatttttcttcgccccctcctactactacccatcagctcgctcgctcgctcgcgcggtcacacgaaccttgcgttgcaacaaactccggcattagaggggacacgctttctccccccgatcctgcaggaggcaaacgcatccatgcatggtaaaacgaactagcccctcctctcacctttattccggccgcgtccgcgtccccgtccaccaccccaaattcgctcccacccgcgcaaccgcgtggagctggaggccgcctctatcggtctcggcacaccgttaaaaatccgcttactagttttatttcccatatggtaatataaaatttagaagaaaaaataataaattaaaaatgagataaacaggctaaaaaaaattcgtttgcccgtcccgtttgcatccctacgcgtgggtcggtctctcacgggaaacgcgccgcgcgagctaaaacccctcgatctgccgcgtgatcgatgagcgagatcgacggccgggtcgcgtactcgcgtcgcgcacgcgggccatgtgtgtgtggatgcgatcgcgcgcgcgcgcgcgcgcgtcgtcgtctcctcccgtgtgcggtgcggtgccgggttgttaggcagctgcacggtggcttggccgcgtcgacgtcgcggccggacgcgggtcgcggggcgagagatgcccaacaattaggcgctcgcgtgacggaaaggcagggctggcacgggaggatgccatatgcagatatgctagctgcgcgatgattattgatgagtgttgagtggtacgcccagctggtgcatatctgctttgtcgcatgggaaacaaaatctagcaccgatgggaactcgagagaggtgccggccggccggccgcgcgcacatgtaacatgttgcccatgatttcgccagttgattaagttattaattaacttcccccttgttgatggattattgattggtcccgtacgtcaagttgggcagagaaaattagcgagcaatacacactgtctagcgcatggggcacttccaggagtaaggctaactgctacaattaagtgttaacaatgcaggagtatgtatgattgtttggtattagcatctgttgccggcaatggtcactagcaataatatcaatatagcagaacaactatgaagtagttttgctcaactgattaggtttttttgggtaaaacgtatccaactataggaaactatttcaatccctcgagggatgccctctcatttgtctaaaaaccattcaaaccgttataaaaatttcttgaaaaatatgacaacacttatacaacatatatatatcactccacaaaattttaactcaaaactcaactcacacatcaatatataataaggacaaattcagcgcacgaataatattcacgtccgaatttgtcttttttgcctcaatgtgtaggtcgaattttaacttgatttttagtggagcggtaaatatcactatgctctatattatcattattttttcaaaaaaaaaatacaactatttatattgaatttgaaagcaaaatttatgcaacagaacatccactcgagttattagaatccattccccattcaattgggcttaagttatagatttggaatgaggctcacatttaatatttgctataaaattcagtagctatcaagtactgtacgttttacctatcaatgtcttggaggtctctagtgctggctcaatctcttgagatgtgcgtttgtgcgctttacggtccttcaagcaaaatttatactatactataaaagtcggtatctatcaagaacggtaaattcacctttttcttttcgcgtacactaaaagaaaaaagttagtttaaactcacctttttcagaaacatatagtatctctaacctttaaactatgtttatttacttattactactatgttgttttaaaggaaaatccacaaagctcattcgtattttctttgcggggcattcatatgactatatgagaaaccgatcatacattcatacctagcagcagaagaattatagtgctctataaatcatagaacaaatcaccaagcgtaacgcagatctatttcacacgagtgctctataaatcgtggatcaaattaccatgtgtaaagcagaatttctcaggagtgctatgtaaaggttgtgtttagttcctgaaaaaagttgaaagtttggggaaagttggaagtttgaaaaaaaaagttagaagattatgtgtgtaggaaagttttggatgtgatgtgatgcgatggaaagttggaagtttgggatagttggaggtgaactaaacacggctaaaatcacagaacaaaatcaccatgtgtaaatgcaagaatttcagaacagtcgaaggaattttatatcattaatcaattcagtccccataggaatcgaaaaaaaattcaaacgggatacaatatactacagtacttgtcagatccatacacccctctctagtcctgatctaccgactcaaggccattgcgcttcagtgaccgtgcttaattatacgccgcgataactagggtaactgctaatcacgaaatcttcatacttccatggtaatcaactcaaggtcaggctcggcgaaatcaactcaaggccgttaatgcgacgagaaccatcttccaactcgaccggccttgcagcatcggctaccgggtgaccacatggcgatcaatcgatcgagctctcaattctcaaatcgcagacgtgacgtcgtggcgatgatcatcagcgcgagtgcatgtgtccaaggcttcccagcgcgagccaatcctcgcgcctctccacggccgccttcgctttcttcgccggcggctgctcctcctccgccgccgcagcacggacgacgtacgacgaccgcgcggaggcgggggtggccttgcgcttcgccaggaaccgcttcagcgacgccttcctcgcgatcggcatgtccaccagcgcgggcggcgcctctggcgcgccgccgccgccctgcgccgccgacgcgaaccgcatcagctcggccgccatggccggcgtgcagcggtcgatcaccaccaccttcccggcgtagaagatcgtgaactgctgccccccgccgtccacctcgcatccgggttcctggaccacaggcgccgcggcggcggcggcggcggcggccatgaggccactcacaccttgagccaccggcgccgccgtcgacggctgcgaggagttggccttgacgtactggctgagcacgccgcacgcgacggcgaagcggcgggtcatgggatccgtcgacgccattgccgtcttctagcacggacaactaagcacaagcacaaagagagacgagaagtctaactttattgcgaacgatctgtactgtacgtcgctgatcacatatggttggttgcgaggttggctcaaccgctctatatagagggcatgcggggcgaaacgtgtggtcgattgattagtggaggttgcgcgcgcgcgcgagcgtgaggaaaacgtggccgggcgcgcatgacgcgacgaagacgcgcgcgcgaggccaaccgccatgcaaacccaaccccctcctgattcggtttgaaatggtctttcctccgtttcgcgtcgacgtacgggtaaccgcctcctcgttccggggagaaacacgtactacgtacgtacactctcttgcttttggttgttacatcgatcgataagatcgacggccagcccaccgttagatatctgtcaactcgcccgacaggttcggaccatatctgttaactcgatcgatctgcatgattcagatgacaacgaatatttctttttagattcacaacggattaatcaatcaatcaatcaattaattaataatctgttgaaaatcgaaatgagccacttctatatactccacatgcgcaaaagaatttttgcgcaactcgcacggtgccattctattcgaggaacccaggaggcctaaaaccaagccgaacacggcctaacctgcacaacccagcacacggcctaactagatgaggctactactagctactagtagctacgttacctgccgctcgcggcccgtccattcatccgagcctataaaagaaaaaaaaaactttgccggaagcagcaatgcacgttgttcccgtttggttcgtacgccgcgccttgccgttcgttctgtcgatcggccggggaggatgaatggacggacgagttggggaaaaaacgcctacccggcaaagcagaacacagctgcgcgatggcgacacgcaacgccgggtcgtgagggcctaaccggctaaattctctgttacgtacgtacgagaacggatgggtcgttcacgcggcaaaagcggtagaaacccaaccactcgatgcctacgatacgacgtccctcgcttaatctaatgacgttttttttttatctaggactcgcttaatcaaactgatcctcccctgcgccgctggccgatagcttaacatactaatggggacaaaccgatcgctcgtaaactatgcttagcgtgtgatcagcttgcagcgagttgtttgttgttgcaagatgctacaggccggtgcatgcgcgacgtgtacgcactcactagcttaagctcgtttaattagtttttcttctctgtgtttctttctagcagccgaaagcgagagctgggggctgcacgccaacgcgacgaaacgtcgtctcgtcctagctagcaaggaactttcttgcccggttcgattgttgccgtcatgtggtcgttgatcgataatactatgctagagaactatggtgcgcactggtgcgccatggccccacatgtaagcgactgcggcgcccgggacgatcgccatgtgggccccacatttcgtacgctgctgtctgtaaccgcgacgactctgaaaattgaacgaccggattttgtgacatgtgtgccctttggagcgtgtcgtcttcggtagtgtcgagttttcttcttcaaagtacacagttgagtgctggctaattaagcctcgggtgcagtggccgagtggcgccaccacctctgcacgtctcgtgcatggcattggccttcatgctgttttccttttcgatttctaatcgatcgtcacttgctttttcagagactttatttctttgatttaccctaatatacatcattctgagaattttctgttgttaattagttgaagtattttattaagagaacgtgcactttgcaaccttgcaagtacaaaatattcatcgagacggctggtcgtgcactcatgcatttcctagaagctttacgtcgggccagttctcgtcgaaaaataatccttcgcatgcatagactctctgagaaattataacagtttgccagttctcgtcaaaccttggaaaaaatggagtacaactatcaaataatttctttttattctaaaaacatgacgcatagcttaactgtttttcctaaggcaacgagacaactctatattatgcatgtatgacggaattggattttttttttcattttttagtgtctctgaaccatggatttgcttggttgcgtaggctgttttttttaacggctcacatcaaacagtgcaaagtttatattgatagagtagaaaaaattataagattacaatcataggaggtcataaccagaaaaaaaataaagaaaagaatcgttcattgtaaacattccatcaatgcacctaggtgccacatgcacagtaacacatgttatatataagttggtttgatgccaagaaaaaatatactacaatcgattaaaatgccatcttcaaccaatcttcacgttttagtcacagtcaatattgtttagacgaaagaaaaggagggtttcctgtagaaaaacggatagtcaaaagaaaatctttttcacccccacctaattttggatcgtgcacagcctccagcctcagactcaacgtgcacacgggcgcacttgcttgacacgtttctttacacacgatggagcatacatgagggcccaaacggtgcccaaacctaaccaccatgtgcgtgcgtgcgtgcgtacgtactgtacatgccccgctagccgtagccggccagagtaaaccaaaaattaggccatgtgtagttttaggggtgaaaaattttcacgagtcacatcggatatacatacacatatttaaaagcgtagactaataacaaaaacaaattacatattccgcttgtaaagtgctagacaaatttattaagtataattaatccgtcattaataaatatttactgtagtacaatattatcaaatcatatagcaattatgcttaaaagatttgtctcgtaatttacacgtaatctgtgtaattttttttatttaatactctatacatgtgactaaacatttaacgtgacaaggtgaaaagtttttacgtgggaactagatagggcctttaaccgataagagcaagattaataatacagccaacttactggctataaggttctttatagtattctctcagcgtacctttataatatagttagctttttatcattaatattgggtacacttgcctctctcacagagtttcttggttcttatgtccaaaccggctgttaagtttacagctcgcttctcctctctctcctctcttctctcctccaccttatcatttagcaggcttactattatatttgctctaacccaaaaccaaccagaccattttcccagcgttgtcatttgccccattcgcacgccaccaccaccggtggatttacaccgcatcgctggcgcggccgcacgacgcacgtgatcccccccacgcagccacgctgcggaggcagaggtagcgcgcgccgccgccgaaacaacccaacccaacccaacgtcccgacccgatcgaacaaccaccgcgaaaacagcgagagacgtgcggcgcgtgcccgcaatttctcgtctttttttccgcgcgggcgccgcgcttccctccgctcgcgtttcacgtgccgctttcctacccgagaaacaaagattatactaggcgtttaggcctcgtcttccttccttccacatgtacacctagtatataacaagagggagacaggctacagattcacgggaaggtttcgtcctcgtttcgtttcttgcagcaggaagccaaagtgtatttcccgagctttgatgtgagctagctgattttgctagagctacaacatggccggtagtagcgagcagcagctggtcgccaacgcggcggcgacgacggtggccgggaacgggagcaggttcgcggtgacgtgtggcttgctcaggcagtacatgaaggagcacagtggaagcaacggcggcggtggcttcttgccggcggtgacggccatgagcctcatgaccggcggcgctgatgcggaggaggaggcgccggaggtgaggaagaccatggagctcttccctcagcaggctgggacgctgaaagacacgcaagaaaggtacgagcaaacaggccggaatactggcacctagtacgcgagagttcatcgacgaaactagtagctggttcgatgctaaagctgcaagtgtttttttcttctttgttaggaaggagatcaccgagaaggcgcagctgaccatcttctacggcgggagcgtggtggtgttcgacgatttccccgccgagaaggccggcgagctgatgaaactcgccggctcccgcgacagcacggcggcggcggccgtctcagacgccggcgccgcagcggggcagccttgcctaccaggtaggactagtactccaaacacacacgtacacatgcatgcaccgggcaaagttcactgacgacccgatccacactgatcacctcaccaaccaactgacgtgtctacgtttctgcagacatgcccatcgcgaggaaggtgtcgctgcagaggttcctggagaagaggaagaacaggatcgtcgtggcggagccactgccggagtcggagaagaaggaggcggagtcgagcaagcgtgccaagaaagacgatggcggcgcgtcgtggctccaggtgaaccccactctcagcctgtgagccgaagaaactgaagatagctggatcaaacaaggaaaaattaattactactactagtagtactgtattgatttaccatttgatttccacgtgtctgtggaaagtgtggaaccgtgtattattgatcgtttttccccatttcttactattttgcaacagttgttggtttcttccgggggaattagtagctaggtagcagctatgattggttaaattaatctgtcagcttatctgtttgtttgagaattctttgattatttgaagaattctttcatgcatgctgatcttatatgtaaggatccatgcacacggattgatgcctgtcggacctatggcttgtaaatccaaataaaatggtcaacaaatggtattatcctcttctgatggttcatgttctcatgccatgttttcaatatgatcaatctcgacggctgcatttggctccgcatttatagcttaggtagctagagtgtagatgtagttgtggttttcgtctttttttttaattaaccgtgtaatttaagatttggtctcgttttccttttaaaatgagacatccttttctttatataaaacgttggcaacggtctaactgttcggaaaaaaaaagatataagcagcatgatatatattccagatgagataatgtgatattgggatgcatggtatttgaattgtgatgcgaatacgtgggaaaaataggattataatattgaaaattgatatgaatttagggtgtaatataaaaaaataactgttaatcaatcacataaatgccggggccttgatggaaagtaggttcatacgtgtaaagtttcatgtgccgaggagtaggaagtaggaacgagtaagaaagaggagacgtgcatgaatgtgtattatttgtagtcgttacacgtcgtcttccccgagacttggcgtgcgtctacatgtttaccatttcaaagctccgactaagctaattaagaaacatgcgtcgtgtttaattacgacaccgaacatcgggtcagtgtagcgtgcgtgtgcttgtagtcaagagtgagggggagtaaactaaacgggagttgatcacaatggagagccaagttcaaccagccttctctggttctccaaaaaaaaaaaaaaaacagccttctcttgccacgatattccatattgcgcgtttgcagattctgctgaatattcgaaagtttcagaggaaaatgtacactaagaatctttcctttatcgctgatgtaccagcatattacatcgttagcgtttggaatatataccactccgatatatagtttgcatttttgaaaatgcatcattaattttgcaccgtatagtgtagtataaaaggtggagaggtataaaaaattgcattataatatatattaccttgatacctctttaaatagttttttaaatgcacttgatagtatagtggcaaggggtatgtggtttcaactataagatcccgtattcaatgtccaacatacttacaatttcttctttaaaaattgtttggagcaacgcttctttctccttgcatcattttttatactctttaggcagtatcaaattcatgatgaaaaaaggattgactatagcatccccaaatatttccaactcaaagaggaattttacaaatacctctttaaatagtgtcaagttcatcaatgaaaaaggattgaccatagcatcccccaaatatttctaattcaaagaggaattttacaaagaggtaacgatcaagtatttctaactccaacaattaagtctttctagagtccccaaatggcagccaccttaatcctccaccagtcatgtatcagcttcccccctgtttcctcctctgcaaccagctgttgtcatgacttatgttcagaatatcggtttcgtaaaacatatcgttatcttgcgaatgttcaaacctatttttaaaattttaaaatgttttttaaccaacagtaaccgattggttgccagtatacgagtagtactaattgggtgtgttcggctggtatctttcaactgtggctgcagctgcagtagttaagaattgctgcagcttgcagcaaatttctgatgtagcagccgcagcagcttgtatggctgccgaatagagccattgtcgttatttagccagaagaaaattttgggaaagactaaaatataattttcatacatctaatatacatatccaatatactaagagtatggtactttttaccggcatatatatttaaccagatatatgcagtcattttaatttgaaaactttgtccctcaaataaccaaatctaaaattcacttatatagatatttgaactcaaaacattaggatcctactcgggtcactacaaccagagtatcagagtgttcttccgcacccaatatgcttagtaatggatcacgatagtttgaaaatttgacgtgtctctattttccttccgctgactccaaaaagaaaaagaaaatcattatgtggatatgcaccatttctgtctgcaaattagaaacatgggtgctgctgaatgagcgacctgtatagctcaacaaatacgaccacgggcttagaaaagaaaaacaattgagcgaaaaatttgtctgactagttcaataatgatctactccacgtctctaccactacctactgctgactggttcgtagctgcgctcctggaatcatggaggcccttgcgtggtgatgatcgatcatcactgcaattaacatgcgtggttgactccaattattcccatttacttatacttttctatcacaacaataatacgctcatccaatgtactagtagtactggtatctgcaaaattttcaacacaaaagtactacgaagtcatgtagcagacggctgcgctcgacggatcaaaccaaaataaaaaagaacaaatcaattacggccctaccacgcctccacagccgaaagaatcaatccaacatcgtgtgcgctagctggtgcgagaaagctaaacttgctcaatctgtctgcctcttttcccttttcattttccctattaatgcaacaaattgcttaattatttacgactaatgtttttaataagtttgatcatttatacagtttattaaaaacatacgtatgaatgttatttattttattgtgactcgttttatcaattaaaaatattttaaccattacttatactactaacttataacttgtagtatttgttgcacatctaccctaaacttttaaatgagaagaatcatcaaacggtatatccaaaaaccagcaacatcgtctataaaagagaataaagggagtaatttaaaaattattataataaaattccacgcacgttgctaaacacgtgactaatttaatccggcagcatgacgccgacctcacgcggcaacttaattattttctcccctctcccttttttcttctcttctctgcaagttgggctacgagtcgctgtccctgttccccgtttcgatgaaattaagccaaatgtgcgaacacatgaccccgtacaagcaagcagtataccaccgctccaaattaaattaaattagataagttaacacggcttaatttaccaatcaattaggccggatatgattattgttagtataattaattagatatattcgatcccagttcgatcgctatcaaattaatcgttcacgtacttgagttccctcgtgattcataagtcgaggccgtggagtacgtgtacagtgtacaagagggggtagcgagaataaagggattgaaacggactttgatgggatgagatttatcccgtgattcatgagcaaaagattaaagattcatgagcaaagatttaagattaagccatacacatggacaagttgggggagaaaaatgtgaagggtttgtacggttttcacttgattttcgtttgggatcttgactaaagcatatgcgctacgtccacgttaattacggagtgcgacgccactgtgtgcgcgctagctagtaggagtaattgccaagacatacataacgcatgcaatggtgtgtgcaaacataagaaaagagaaagaaataaagagaaaatagatggaccactatccgcgaccaacctcgtgataaaaattagaaaagaaaatgatgaattgaagaagaaaaaaaatcatgtactcctacatgcggttgttagggcagtcccagcccataacactagacatggtttctataaactccacatcatcaagaaactagtactagacactactattccaatgcaaacaccactatttcatacttcaatttaatgctacttatatcacatgatatcttggatgttgtgtagaaaccatatctcatacaagacatggtttccttctctttcctcatttattcacttgccacatcattttttattctaggtggtaacttatttaatgctatggacaccatcctagtcattgggttgggaacgcccttgtgctcgccgtttagtttttcttaacttttggttaattactccctttttttctctggacatttcttaaggggcgcacttatggcgcatgcgtactatagaatgacgtgtgcatgcttgtgcgtcatttatgtaattgcaaaaatcatgtgcacatatcagataatgttatttttcaccattcgcattgtatacatcacgctctgatgtatagaaaattttatgtgtactatcgacattttttcctcaaatcctagaccggccgctctatccctaattctctattgatgttgtatatttccacaaggttcacctgttggtggagatcacaattatatctctatttatctttttcagctttaattaatttatatctccataaataatacatatattggtaggttaagactgtttgccattgaggtggattgcgataatttgtacaacttcttatgatattttggcttatccacacaatattttttttatatcttagatataaccaacaatattattgcatatattttgaaacaattggaagggcatgatagatgaataaaatatttggtctaaaattaatatgatttgtaatacaaaccataattatatgtttcatctctacataaaattaaaaatataactgtcgtgcctgtgtccgacttatactcaataaaacccccctatgtgaaaaaatatagatgcatttcagtttgaataagtttttagatgttgttcataaaaatagattttcttacaatatatggagccaacatttttacaaaccgatatatatttttgattgatataattgttatatactaaatatacttataatttgattaagattaattgttgatgaaaatctataccttttccaaaatataacatacttcataatatatttctatggaggaagtacaactcaacacaagtacacaactataaattaatcctatgtgtaacctaatccgtgatcattcattcatcaaaaaatagatatttcatgtgggattgagggcatcgttttggagagctcaagtgagacatgccaatcacattttagagtcttgtaccatgtgacacggtcaacgtttcataataaacggcacaagttccttttttaccatctctcttttccattgttctctccaatattatctaaacatatgtgacgtaactttttcatggaggaagtatgcacaactcaacacaaactataaactgctcctaattatgacttaacccatgatccattcatcaaaaatagatatctcatgttggattgaggatatcgtactaaaaacccaatcaagacatgccgatcacattttacattttacagtgatatcgatgtaccgtttaacacagtcaatattccataataaatgccacgagttcctctcttaccaccccctcgtttttctactgttctcctctccaacattggcgtagtggtaaacaaaatcgttctcctcaatgcaattgcagcacagaaaaaaaaaggcggttaaaccatattcttagtcttataaaagaaattgaagaggccgtaacattttacacgaggtgcgaattaaaagagaggcaaaccagggaccgtgaagtcgtgcatgtgtgccttgcaccacagtacacatataatttgatttattttttgttcaaagaatatttttcccaaatataaaatacatcgtatttttttatggaggaattacagctcaacattatcctacacgtaacctaatccgtggtcattcgttcatcttaaaaatagataccttatgtgggatcaagttcatctttctagaaagccaaaatgagacatgccaatcgcattttacagtctcgtaccatgcgaaacggtcgacatttgtagcgcccgttccgtcgtggcgcctagcgggaaaactatctcttaaaaactctatttgtgaaatctgtttctttgcttgttgtctagtgtccgtgccatctcagatctcaaatccccgatctatcgccgagttcaatcccgaatccaaatccttcccaaatcaattcctccgcaaaagtctaatttgcctccccgggttcgatgggccgaatctctctcggcccatctccccctccctccccggcgccctctctctctctttctctccctccccctccgctccgcccgcgcgccgcgcgcgcgtgcgcgagagccgcgccgagcgctcccccctccgctctgcccgcgcgcgtgcgcgtgagccgctcgcgccgagcgccctcccttcccctcgctctccttctccccgcctccatccctggagagctccccgcccgcggaatcggccccgcgcgttgttgttcgcgcgtgcgtccacgtggtcgtcgcccgcgtcgcgcctgcgccgtctgcgccgcccggccccgctgccctgccgctcctgcagccgcgcagccgctcggccccgcaagccagcgcgcgtgcccgagctgtgccgctcaaaccgccgcgcctcccgttgcaaccgcgcgcgcgtgccgtggtggccgaccgcctggtcgccgccgccgtcagcctctgccgtgcctgcccgcgcctgccgcccgtgtcgtcgccccgctccaaaccgccccgccgtcatcgccgtcgtcatcgcccggcccccgccactccgcgcgcaagctgccaagggacggaggcagagctcctcctccctctgccgagtcgcccccgctccctcctccttttcccaaagaggcaaggggacaagcccccttttatctccctcttttcccctttttcctcccgccggcgtcatcctcctccctcctccctgtcgccgctttggccgcgaccgccgaacgctagccctctcctttgaccgccctaagtcggttcccaaactgacattgccatcctataaacccaagcttccctcttttcctttcctctcccattcgcctccacgccattgccgccgcctcccgtgctctgttcgccgtcgccgttcgtcgttgcgcgtgtcggaggagccggcacgagcaaggacgcggaaggggactccgagcgcgccctctccttcctcttccccggcccgaggccggagagattactcccgcgccgtcggcctctcgtcactgcgcccgcccgcacggtagtgcatctccccgttctccctcctcgctccatctcctccccttagactcgggtagtagcacgagtagcctccccgtagctagccggcgtcaccccgaccgttgccgccgctcgccgtgtgctcgccgtcgtcgtcgcccgagctcggaagcgccgctcgtcgccggcctcgctcggcgcagctccgcccaatccaacgctagcatcagattcccgtagccgcgtagataatctcgccgccgggaattggcccctcgtgacctcgtcgccgtttcccccttctcccgccgccggttgccgccgccgcaattcgccgccgtcgggcatcctctggcgaatccgagccgttggctcgtctcccctcgtcctatgcaaccacccggtgtgctcgctttcgcctgtatcgccatggttcgctccgccgctcgccgctgtcgtccgccgtccgttccggccggcgtcgtcgtcgacctcccgccggcccgcgtggcagccacgtaggcgccacgtcggcgccagctcggccaaaaccgggtcgagtcgaccccggttagccgctccctccccgtgcgcgcggtccaccgcgaaccgtgaggctgcgcgtgggcccaccgcatccgcgtcctccacgaaccgcgcgcgtgcaccgcgtctctcccccatcctagcgccgcgccgcgtgctctctccgcacggtgagccgagccgctgacaagcgggtcccactcgggaccacgcgaggtgagcccggtccaccggctctctctctcctcccctcccgcgcgcgcgtgccttgggccggccggcccatttagctcggccgagccgccccttttctctcgggccgcgccctagccgcccgagggaagtctaatttccctccctcttttcttttcttttctttttcaaaaaggatttaattaagtccttttcctgtagaccaaaaatccaataatcttagaaattcaatatcttcccaaccgtaaatccgtttgactccgttcaacttccaaaatccctcaaatctcgagatctatctaatggcacgcttagaggtcattaatagggctttattttcgccgtttgttgagttgtcccgttttgcgcgtagtttcggagcccgaagacccgcagtgcgaggatttcgaggatcaagctccagatctcgagcaaggcaagccacctttgaacatcttgagcttatatttgaatttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactctgcacgagtatcgacggtcgccttcaaacttaaaatctgaaaaacttcttaggtaaaacttgggttttacaaaagacttggaaaacccgacacctgggtcggtgcttgcgaactaaatgaattttccaaaaccgcggaccggggaacgtaccgggtgtacggtttcccgctcttgcacttaaggaccgttttcttggaatttcatccaaacataagacaagtacgaccacatgggtggaatgggacacccctggctgagtaactagcttatcaggggagccttgatgccgagagacatgtggattcgccggggtggtgtcggggaggacccctgggtttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtggataaagtgtaccccctctgcagaggttaacaaactgttcgaacagccgtgcccacggtcatgggtggatgtgaggtgattcctagcgtagttttgtttgactactgcttgtgaaattgctgttgtggaaaggggttcgatgtttgaaaaatctgcagctgatgggatcagctaggcccgggtggccatttgaaagttgttggcccgggtggccgtttgaaagttgttggtcgggtgccaatcttgatcaattctaaagactgatacatttgcacatactccgaccggacaagacgcactgtctcatccatgtcgtttgagaagcactcacttagttgctttcagaaaagagttcaaataaaatcaattgcaaaaacaacagcctttccttgaagcctgcattaaacacttatttcccatggcttgctgagtactcccgtactcacccttgctctatataaataatctcccccccagttgctgaagaagatgaagcggatcccgctgacgaggagttctttcaggagcaagccggctacgatgagttttagggtttcggcctagttcccaagtcgcgcctgtgttgtttggtccaagtcctggcttccgcttcccttttgtaatgcagttgtgagctcgggatctgtccgcagcccgacttgattgtactcctactctataataaagagacctctattgctgtgatattctgtcttcctgtgataccagcactgtttcctgggactggtatcgattaataggttaatttggagcgtcacgggctagttccggtcggtactagttctgggcgtgacaacattccataatagatgacacgagttcatcttttaccatctatctttttcagtgttctccttttccggtatttatctaaacgtgcatcataactttttcatagaggaagcacacacaactcaacaaaagctataaattgctcctaagcataatttaacacacgatcaattcatccaaaaatagatctcacactggattgagaacatcgttcaaaaaaaaaactcaaccaagacacaccaatcatattttacagggttgtaccgtttgatacgatcgtcgttccataataaacggcatcagtttctctcttaccacacctcgtttgagtttatctcttaccaccccctcgttttttttcactgttctcctctccaacaatggaataacggtgaaacaaaaccgctctctgcatttctgcaaacagtacaattgcttaacccgtggtaccagccgttttttagtcttgttacaaaaattcaaaagaagccgtaacgttttacatgaggcgcgaattgaaagaggcgcaaaccaggggccgtgctgccgtgcgtgcgtgcgtgccctgccccccaacttgacaagtggatggagggaagggggacaaccccggtcgacatgcgagcggatggggaaagcgggccgcaccaccccccaccacccgatccatgggcagacgcagcaaaaaaaacatcacgaattcacgcacgcacacgcatccacagctcgaccgttctcccagtcccctcccccacc

SEQ ID NO: 75301 - DNA, 2835 bp, Oryza sativa
  unsure (1)..(2835): unsure at all n locations
cagaaatgtcatcaagctgccatcatcgtcgttgctgtgatgccgtcgtcgccatcgccgtgatgccgaggcgtcttcaagccgacgctctcgtctacaccgccaggcgatggagattgctgtccatgcgatcccgccggaggttgccggcaagccatcgtcgttacatcggtcttcgcccatgccgtccaatggagtggagtcgccgtcaaccgggaggccatgacatccactttgtcatcgacgctctaaatctcgccaacctcgtcgagccgccagtgacaccgtctgccgaaggccatctcgtcggaagacgccttcgtgccgtcatcgccgcaccaccgttggactctgagcatgtctcgtcattgagactccgccgaccggcaacactttcacgctcgtcgcggtatctgaggcgctgctgatgttcacttgatcgtgttcgacggtgctgtctcctccctcacgtgttctccgttgctgtcgttgccggcgccgtgtgattcacattgccgggggctgccgtggagccgatggccaagcctggagaagagcacgccatctgcagcaactatggcaaaaatcatcacacgctaatgtttcacgtgtgcatgcatgctactgtgcgcacagtgacaagcaaaccaataaaatggcttattgctaagctatactcatttggccatgaggatgtgtatcgttatacactaatttctcaagtgcaagtatagtttggtggtctgcatcgaccatctcctactactcctttctttcctaatatgatcccgatgcaattgttatgacgtcgagccgtccaagctacgcgattccatgcatatcttcttcaagcaatctacaccgacacgtcgttcaagaccgacgaggctagacgacgagggcgggcgaagccgacgctaaggctacgtcaccaacaccggcgcacggaccgacgaggccgtggattgctgccagtgcccacatctacatcaccatgacaaccatgcatggagaatgcgaagcgaagacgatgagacgaccactagcagcttaatcggaggttctctgcaggcctagacctgcggaggtaattaaccgggagctttacgaggccccaggaaccaggagaccacattgctcaagtcagatatgtccaattacaggctatgaagtgcgtatcattatatgggaatttgtatttataatccttgagattaataaagtgcatgttccctatgttttgtttattgtgtacttagttacactggcacgcctgcacatatacatatctctaaataaagagatcatagacgttattttccaccctaaacaaattggcacgcccggtgggacctggttctcctcccatctttgccgcgcttcagtggtcgtcaaattcgtcttcgccaacatctccaaccatcaccagcatgctgcatgatgatatttggtgtgaatatctcatgactaaggtctccttgcaggaggaccttccatcatcgagaacactccgatgccctttgtgatccaatttgggtcgcaaccaccagcggcggtctttgagtatggctccaagatctattttcagcaagcctaagacacggcttagttccaagagatccaagctaagaagcagcgcaagcgtgcttctgccaaggctaagaaggagcgacgtgccctcatgcttgaagtccggacccttttgaaggagttcgttgtagctgagatcaagggagacatccaggctgcgcaaaagctgcgcacaaaagcggccaacaggtgttcaagtactgcatccctgcgcgcctctactccgacttttgctccaaagccaccctccccaactgtgcaacatatggaagtggggttgcttgaagctttggaagccgtctctgacaacctacatcgacacatatcccatgctcgacacatggatagtccacatcctctgcgcaactacaggaggaagtaccacaaggtgcagcgtctacatcaactggttagttcgcgcatcgcccagagttctgtcccggaggaagattggtctcttgacacatccatcctcatcggcaaggtgtgcaaatatccgagcatcttggaaccaccctatgacttgttccctgatgaatgggcacatgagccaaccaagatcaaggagaaagtcaggcgcgccatcatgaaggagtattggaagcggcgttatggggagcacattctccttcccggaccaacgatctccttcgactacaacacatacgccccttgccagcagagcacatgggagccatgcctccacttgtncgnggtaagaagatcgtccgtgtcacgcccagaaattagcccaaatttgcagactattttgtgtattaaatccctgtccaggaccagccaaggtacacaaaacgacaagtgatanacagttccaaacgtaaataaagcgtagaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacactactgaaaaggggaaataaaagcaaaactgagtacaaccaccgtactcagtaagccacaccaacgatgtagatgtgcaaggggatacaaggatggtttgtagctatttgcataaaggcggttgtaaaacattttattgagcaaaccagtaaaactgttgagtaattacagtaacattaaatctccactgatcaacgctacaccatgttgaacaggcccaaccaacccacct

SEQ ID NO: 75302 - DNA, 18372 bp, Oryza sativa
  unsure (1)..(18372): unsure at all n locations
aggtgcgaatttttgaatctcaatgtggatcactcactcagtatggcatgaaatacatgagagcatttgcaaacatatgcaacaacggtgtctctgaggccaaaatgatggaagcaagtatcaacgcttgcggccgttacaactcggcgagatggagcccaatgactgaaggaggacacagtgcttgatccccggctatatacaggtaaaattgaataccaaaggccccggaggtttgcagacctcatttgtgtgaacttctgtatataccatggagacaacaatatagctagcgacccaacaatatggccccttgtgtgatggctaatcagtaggtgtcatatgcttgttgtacccaacaatatggcttgtgtgtgatgtggccctctgtaaattactcgattagcaatcgatccaagaatgattatgaccaaatatgtgcatgatgttgtcttcagacttgataataaacaagtaggccaattattagtggacgaaaaaacgatgacccaaagtaaggtagtgctgctccgatagccctaccaagatctcgcttacatatctattgctggaaaaatgatattacaagcgatatgaagctcttgccaacgtcatgcaagcgaagctctctttacaagtcattctcagtttctcacacagaatgcgaggactgaaactgaaactccttccagacatcaaacgaagctagcctgcagtttagagtgatacatcatgtttatatcaggttagtgaagcttgcatatggaatgaaagataacgtgccagaggagcagatacagagattctcctactaatttatgatctagtagtggtctctccaaagacaacaaaacagagaggatttccaagtcaaggggcttacatgattttctaaggaaagagatgaacaccacgaggatcgccagccctgccaagatgcctacgattattgccacagtccgcccgacgtcatcttgcgaataatctgcagcacaaagcctactattatcaccagaatccaaaggaaatcagacagagattagagtagcacggcacatatgtacaggactacaaaaagcagagtcacttgcagagtgcccctttccgttttgtttatcgcgaatatattcagcatgggaagtggttgagtggctaaggcgctaagctaagcttatcagccgccgctcgccgtcctaaataaatttgatatgcttagattgattggaattttgtttagtggccatcactgggtcagagaacccctttctaatcggtatatccagtacaagaaaagcagtggacaattatctagcttacggtttaagcactgtcctgtaggaagctctttgcatccctgcacaagagacgttgaaggaaatacgaatctcaggatatttaacaagtcagctctgttggatcagagagaataatttgcattgttagtttgttactgtcccttgacatcaacttttcagtactagaatcatctttattactcttcctttttctaggatcggaaagaatagccccttttgttactgccacttgatcatctggtattctgattaatgctgatgtcccaccaaagtgagtctaatgatactgtcatttgcatgcagtccaccagaaaagccgaggtgattagccgtgcaaattttattagagtaaatttacaanacaacttgtgttttatggttcaagttacagaaaaccacacatattttgacacttggcacttaagtacatatattttagtagtttaatttcacaaaatcacactatcgatgaatgaattcacctgtgagatgatgtggttgttccatctaggatgaggacgtggttgttccacactcgaagatgacatgtcctcgtcttaggtgaaacagtcacgtcatctcgcgggtgaatccattcattgatagtgtggttttgtaaaactacactaccaaaatatatgtacttaagtgccaagtgtcaaaatgtgtgtggttttctgcaacttagactataaaacgtgtagttttgtgaaatttactcttttctttattgcaggaaaatgactgaactgtgtcgttggagcttcctgcatatatgacactgacactgtaacttagatataagtctgtaagttatggggggttgttggcttacaggcagtagtctatagccagcaagctaaattttggtttgtcagtagcgtggctgccttcaatcaagtgattgctctcgtccttagctgagcaagctgagcaatttgatcgatagccataggtggctaaataaatttaactatatgtagtttacccattctaccttatctctctatcaactttggtaagtttacccattgcccatcggaatcaattcccgtcacaacttgctcagctaaggactctccatactgtactttacacggttaaacttacaccatctaaccgagatagcttaggacaattggcaacttgcaaatggtaagcttgatcacttgatcaggataggttgctggagaattggttcgggttcttgctctctgaaacgcaaggctgaaaaattcttattcgtgttgcactattgggcgtaccttgtgacgggcggaagtagaagccgttggcccagtacctgacgtagcactgcgcgaggtacacgtcggcggccagcgacgtgccgcaggtgcccttgagctggccgaccgcctgcgcaaggcacgtcgtgcagtcgccggcggcgaggtcgccgaggcactgcgacacaccctgcacgttgccggagctgctcaccttgtacccgttggcgaggccgccctggagcgcggcgaggacggcgtcccggttcttgaggaagtcgccgtcgccgctggtgctggtgctgcacttgcggtacaccatggcgttgtcgggctggccgacgaagttgctgctgtcgtagcgcacgtagcacccctccagctgcagcgacgccgcgtacgcggcggcgcacacctcgttgagctgccccacggcgtcccgcacgcacgccgcgcagtcggcgttgcccaggtcgccgcggcactggtacagcccgtacgccgccgcgccgtccccggtgccgttgctcccggccgtgaagctgttgtacccgccgttgggcgccgcgttggcgatggaggcgaggagcgagttgaggttgccctcgaacggcgtgcccggctggtacttggacggcgagcacccggcgtagatgaacgtgccggtggccgcctcggcgaccgtcgcgccgatcacgacgagcacgacgacggcgtagcaaagccggtcgagctgatgcatgactgaactgacggctctcgcgctagctagctgctggcttgaagcgcgctacgcaacgcccaggcttggctgggtcgaagcaaagcggcgaatgcttttttccgagtccctgtcgcgagagcgaagagaaggtggtggggagcacccagaataaatgcgagctttttagttaagctaacgcttcctcgatggtctgtggtggtgcgcgcgcgcggcgtctctggaatttatacgtcgactcgacacggcgatgcatcctccttgcaccggttggacctcgtagcggttggtcgggtgactctggtcagtggtctactggctttggtccctcccgataactatgctctgaatgattgcttcggtacattcagttatccttgtgctgtaccagattggggtaagacggtatgggcagtgacaggatgcaacctatcataatctgtggcatatggtctgaagataaccaatgccgtttcgacgagtgcactcgagcaataggctgtttgactgaatgctctgcctcttcagtctagactgggaatccgggatacggggatgggaacaggattttgagtatttttgcttcgccaataagcaactgccatttccacacaggcatacagctgatttcatcgcggctcctgcaggctgcggcccttttcacttgggtgcggttgcgtccgtggctggtacggatgatacctttgtaattctgtattccagccaacaagctcgcaaccctaaagttgacatgaaggggtcctttgctgcacacaaactaacgtggtagcgaacgtgtagcttccaaaagtgtaataagcgaatttgttttgggaagatttaccccctgccaagtgccaaccgagagagctagattcgtggagataaaaagaggaacgcgtgaaggtgaaactgtgaaagggcccgactttgcgcgccgaggtttcattcgggcgcgcaacagctgtgggcgagagcgaccggaccggtgtctcgcgtcaatgcgtcatatggccaccacccgcgtcttttcagctcctctactagtacctcacggctcacgctcccgaacgttctcttcaggcacagtaacggcaaggcccacctgcgtgcggcggaggatgaccagcatacgccgcggccatgcattcgctcgggcggacgcgcgagaattccggcctcgtttcggccctgccgcgcgtcgcgttgcggactagcggttatgctgccgcgcgcgccaggcgccaccaacaccgacacgggcctcatcgatcggtactgcaggtgcaacccggggatgctgcgtatgcgcgtcgttgcaaggtctcgtcgcccggtcgggggattgtctttggtcggtccaatgaagtaatgaacggccagtttcacgagagctcagcaagtctccatcaccacctagtcgtattatttggcacttcttcttgggtacttcagatgccaccacctgtacggtgcgtcggagctcggaggtgggcgcatcaaagaccgcattcggttagaaacggtggacttaggacaacctcctctacaaatactccctccgtttcaaaataagtgcagttttgcactattcacgttcaacatttgaccgtccgttttatttaaaaatcttttatgattagtatttttattgctattagatgataaaacatgaatagtactttatgtgtgactaaatgtttttaattttttcataaatttttcaaataagacggacggtcaaatgttaaacgtgaatagtgcaaaactgcacttattttgggacggaggtagtacaatgtttcgacgatctagggaaagttttatttctattaaggcccggtttagttcccaactttttctttaaaattccaacttttccaccacatcaaaagttttctacacatataaacttccaacttttttcttcaaacttctaactttagtcaaactttcaattttggcgtggaactaaacacgcccttaagcgatcgctttaagtcagggtcggatccaaaaatagattaagacacaagacgctccataaaaatgttggccaaacacaaatatacatggtgaaaaagtgaaaacatataagtccttgatgggtcttccatccttgtcttaagccaatcgcttgtggaaacaatggtataagcgtttttggcaaaagattcgatgccgtaaattctaacagctgatgttgcatcggtgcatgaatgtggacagaaataatcttggccaggctaggctcttgccctaaatcacacggttgcggtatttttctctctcggaagatgttcaatctgactctttcaactataggtcgagtctaatccatattaaaaaaaagatggatataattactcatccaagtattaaaattgtgtaaaataattttcttgtcaatattaaatggtggttttcactgatgtggcatctacatggtatgttggtatggtctgtgtgctacgtaccgcttacatgaaatcatactcaacaaaaaaaaaaaggacccacatgccccttctcacgcggctcccctcccctctccctcggctccagcatgacacccccactagcttgcagcattgacaacggcaattgcctcctccgctccgagcggctgtcttgcactacctctttcttgtcctcctctcatcgcataacgacgggtgccgtaccttaggaagaagatgtggcgcgggagaagggaggggttgtttgatgacattttgtcattctatactaagcaagcaagattatttagctaagaagctagcttgttgtttttgcatgaaatgcatgggccatgcagactgtgcacgtattggtgtatatatgcctatctagccaaccatatatatggcccatatgcattctgctatatatgcatgaaccagcaaacaatgattcgaacgatatataagcagcttatacgtgagcactcgtggccgtacgcctatagtatacgtatacgtgtatgtataccaaataatcctccctaggattaaaccaacggcaagcaaaggctagtacatgggctgtatatgggccggtggatcaatgctgcatgctcatcgtacatatgcggctggataaccacgcgtacacacgtacgtgggcaggatttctcgccaacggcaagttactgatgcggagataacgtcagtcttatccggtcatctcgatctgcagcaactgaacccggaagagccggatcgatctaacgctcggccgcggcggcgccgagggattcgtagtgtgggttagggctccctgcgcctataaaaggagaccatcactcactacacaggagacgcacacagccatttcactctcttcacacagccatctcagtcatctcgacgcagccatttcactcctctcttctcacacactcactgacgtagcctcgccggagcagccgagtgggatcggctcgacgggaggagactccgtcaggaacaggagtggtgcacgtcgacggctgctcggcggctggaaggagaactcaccggcgataggagtcggcgtcagatcgcaggcgtcaacaacttttgtacgatgggtgagaattctgtgattttcttgttgattcttcttttgcagttcacgcatgcatgagatggcgacgagacgagaatgccggagcaccgctgcacggcgcccgcacgccgtcgttgagtctgccgagtcatgcaagagctgttcgccggaccggggagcaagccgccgtccgttgtcttgtccggacgaagggcctcgtcatgctacctcgccggaatacgctgcctcaacatcgcgaacgccgcccgcagaaccatgacgcctccctcgccggagtcgccgtgccaaacgtctcgccgaccgtcttcggcggtgttgtcatcttcctcacgccgttgcgccgccggaacacgggatatcctcgtctggccggtggcgacctctacctcacagcgccttcatcggtgcgcgccgtcatcctcctcacgcgcgctgtcgtcgagtccggacgtgccatcctccacctcgtcgaggtttgctgggttaacccggagaaggccatctccgtgccgtcttgctgtcatgccccgaactagtaccgaccggaactagcccgtgacgctccaaattaacctgttgatcgataccagtcccagaaaacagtgctggtatcacagggagacagaatatcacagtaacagaggtctctttattatagagtagatgtacagtcatgttgggctgcggacagatcccgagctcacaactgcattacaaaagaaaagtggaagccaggacttggaccaaataacacaggcgcgacttgggaactaggccgaaaccctaaaactcatcgtagccggcttgctcctggaagaactcctcatcagcaggatccgcttcatcttcttcagcaactggggggggggaattatttatatagagcaagggtgagtacgggagtactcagcaagccatgggaaataagtgtttaatgcaggcttcaaggaaaggctgatgtttttgcaattaattttatttgaactcttttctgaaacaactaagtaagtgcttctcaaacgacacggatgagacagtgcgtctcgtccggtcggagtatgtgcaatgtatcagtctttagaatttaaacaaggttggcacccggccaacagcttttacaacggccacccgggccaacaacttttcaaacggccacccgggcctagctgatcccatcagctacagatttttcaaacaccgaaccccttttcacacagcaatttcacaagcagtagtcaaaccaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacgggacaacagattatgtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcaaaaatgaagccctaataatgacctctaagcgtgccattagatagatctcgagatttgaggaattttggaagttgaacggagtcaaacggatctaaggttaggaagatattgaatttctaagattattagatttttgtctaaaggaaaaggatttaattaaatccttttttggaaaaaaaaagaaaagaaaagagggagggattatagacttttcctcgggcggctaaggcgcggcccaagggaattggagcggaccggccgagttaaatgggccggccggcctaaggcggcccaagtgcgcgcgcgcgcgggaggggaggagagagagagagccggtggactgggctcactacgcgtggtcccgggtgggacccgcttgtcagcggctcggctcaccgtgcggagggagcatgcggcgcggcgctagggtgaggtgtggggcgcggtgcacgcgcgcggttcgcggaggacgcggatgcggcgggcccacgtgcagccttacggcttgcggtggaccgcgcgcacggggaagggctgatcggggtcggcccgacccgatctcggccgagctggcgccgacgtggcgcctacgtggctgccacgcgggccggcgggaggtagacgacgacccggccgcgaatggacggcgggtggcggcggcgagcggcagagcgaaccacggcgatacggacaaaagcgagcacaccgggcggttgctcgtgatgaggggggacgagccaacggctcggattcgccggaggatgctcgacggcggcggattgcggtggcgtcaaccggtggggagggaagagggaaacagcggcgaggtcacgagaggtcgattcctggcggtgagagcatctacgcggcttcgggaactcgacgctagcgtcggattgggcggaactacgccgagcgaggccggcgacgagcgggtgctacggagctcgggcggcgacggcggcgagcacacggcgagcgatggcaacggtcggggcggcgccggctaactacggggagtctactcaagctactaccgaaagctagggggaggagatggagcgaggaggaagaacggagagaggcactaccgtgcgggacggggcgcagtgacgagaggccgacggcgctggagtgatctctccggcctcgggccgaggaagaggaagaagagggcgcgcccggagtccccttccgcgtccacgaacgcaccggctctcccggcgcttggcgatggacggcggaggcgaggcagagcacgggagcgacgacaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggagagaaagggggctcacccctttgccgattccggaaaaggaggagggagcggggcgactcggcagagggagaggggctctctgcctccgccccttggaggctagcgcgcggaggggcgggggccgggcgatgaccacggcgatgacggcggggcggtttggaccggcgcgacgacacgggcgacaggcgcgggctggtgcggcaaagggtgacggcggcggcgaccgggcggtcggccactcggcacgcgcgcgcgggaaacaacgggcggcgtggctgggcagcgggaccgggcgacgcggacggcgcaaacgacgcggctcgggcgggaaaccacgcgggcgcgcgcgcgagcgacggcgcgcggggccggctttgcgagcggggagctcgcgcgagaggagggggcgctcggcgcggctctcgcacgcgcgagcagcgagcggggggggaaacgcgccggggaaagcgagagagagagagagagagagagagagagagagggagcgcccgggagagagggggccggggaagagatgggccgagcggaattcggcccatcgagccacgacaagcaagacactagacaacaagcaaagaaacaaatttcgcaattagggtttttaagagataattttttcccgctaggcgccacgacggaacgagcactacagaccaacccccctaacaagaatctcgaccccgagattcagcacctaagggagcagctccgggaactcggcgcggagaagatcttcttgctcccaggttgcctcatcttcagaatgattgctccattggactttgtagaacttgatggtcttccttcgagtttgacgttctgcctcttcaagaaccttgatcggtctttccttgtaggttagattcttttccagctcgatattacccaggggaacttgctcttctggaactcgaagacatttctttaactgggatacgtggaacacgttgtgcacatatgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcctttttcgaactcaaggtcacgccttggattgtcagcgtaatttttctgacggttctgcgctatctttaaacgtttcccgattagcttaacttgttcttctgctgccttgagtatgtcaggaccgaataccagcgcttcgcccacctcattccagcacaagggagtgcggcactttctcccgaacattgcctcattcggcgacatctgaatactggcctgataactgttgttgtatgagaactccgcatacggcaaacaacgatcccaagtgccttcgaaatccagggcacacgctcatagcatgtcttctaggatttggtttactctttctgtctgaccatcggtctgcggatggtaggctgtactaaaatttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggtccgcaccaaactgtgccttgatcgtctatggagaaatttgtgtctttcttctcctgtattctttttattaattcttttatcccttcgtcgtctttctgagcctcccggatttgcgactctagggtaggctgtactgtcaagctggcagggacacctgactgtaccacggtcagtcttaacttctccaattctctgcacagatgatcttggtcaggccgtatttgagctacattgcaataggccttgcgacttagcgcatcagcgaccacgttggctttaccaggatgataatggattccaagatcgtaatccttgattagttccaaccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacaaaagatctcgaaatcttttcggatatctggcaaggtgagaactgaggcagtggtcaaccttttcttcatttcttgaaagctgtcttcacaggctgcagaccattgaaatttcttttccttctttaacagctcggtcataggtctgactagcttagagaatccttcaatgaatcttcgataatatccagctaagccaaggaagctgcggatctctgacacattcttgggcgggttccaagcaagtacagcttcaaccttgctgggatctacttcgacaccgttggaggagatcacgtgtccaagaaatgctactcggtctaaccagaattcacatttcgagaatttagcgaatagttgatgatctctgagcttttccattatcagcctcaggtgttcagcatgttcttcctcattcttggagtatatcaggatgtcatcgatgaacaccacgacaaattggtccaggtattccataaagattttgttcattaagttcatgaagaacactggagcattggtgagtccgaaggacattactgtgaactcgtatggaccataacgcgttgagaaagcggtcttcggaatatcttcagacctgattttcagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactttccagctcttcgatttgtcttttaacttctgctaactcattagctgccattcggtatggtctttttgcaattggtgcagtgcctggtgccagttctatggcgaactcaatctctcggtctggtggcatactcgttaattcttctggaaatacgtcgggatattcacagactatgggtaccgactccaaggaggtgacttgtaaacaggttaggatagaccgacttacggtaggggtgttaggggtaaagcggacttgctttcctccaggtccttgcaatgtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagaggtaacgctgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgctgcaggtcctcttagctggtgagaggcgtagagcgtcttctcaaccggagtacactgcactaagttgagttttctatcaacatctttcagccaatcgtcagcctcgacgggctcgacggtctgagagaattctggcggacgagacctcagaaaatctgtcagcttggacctattgttgctcatgtgagggtggccatttccatgcgcattatgctgaaaaccggctacgactgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcatcacgggaagctgtgcgatgcgagcggttgctgcggcggggttgctcaacttctgcattgcgggaagcagtacggtgtgaacggttgctgtggtgagactacacattagctgactcatgatttgcttccggctcggttctaccatcttcaaaaccaaagcgggctggtgcacgagctgcacggcgggggcggctagccatctaaactcccagaaaagggcgggggaagagtcagataagcacttaggagggcaaggagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacgcccacaacaaactcacgcacgcactacctcgcgacgactccaaaagagttggcggcggaacaaaagggcctaacacacggacggctgctgaagactgcctcctctactcctcgtcggcctggctacctccagtagtcggctcctcagtcgaagaaacgtcgatcggctgacgcgaagggatcggcggaacctgtcgagggccggcagcagcacgggccgctggcggtaggggagctgggtagtggaaacggaacacggtggaagaaccaacaacacgcttccgcgcggtgcggataaagcgtgggccacggcgggaggaagcaagtggggtgtgtccgggggtgtaggaagggctaactgggtgcgggtagggggagtacactggtgagtacggcgcacgcgagctgggggagcgcgggccactgggagtgcgggcagagccgcgggagctgtgggaggacaggtggctggcgtggcagaggcggcctgactcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagtactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacatagagagctcacagtgagggggaacacggtccacggagtaccccgtgtactcgggacacgacaagccaaggaaacgggcgaggtcacgaagctgagcgacgtggtgaccctcaccaaaatcgtgggaactgaagctggcgttcactgccatctacaattttgaaagagggagaaagatcagtaactgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgccccaaattaacctgttaatcgataccagtcccaggaaacagtgctggtatcacagggagacagagtatcacagcaacagaggtctctttattatagagtagaagtacagtcatgttgggctgcggacagatcccaagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactaggggggttatttatatagagcaagggtgagtacgggagtactcagcaagccaggggaaataagtgtttaatgcaggcttcaaggaaaggatgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacctgggccaacaacttttcaaacggccacccgggcctagctgatcccgtcagctgctgatttttcaaacatcgaacccagtttcacacaacaatttcacaagcagtagtcaaaccaaactacgctaggaatcacctcacatccgcccatgaccgtgggcacggctgttcgaacagtttgttaacctctgcagaggggggtacactttacccacacgacattactaaccaggatcacccagcccgtggggatcagccacgtcgggagacctccaagctttcatgacaaggcatttcgaaagccgatacaggtttaccatatgccgacgagaggggtcccagaccaacaacaggttatgtcccagaccatactgtgccaggaagccca

SEQ ID NO: 75303 - DNA, 1516 bp, Oryza sativa
cggcccgtcacaggtatcccctcacctgtgacgggccgaaaggaaaacccgtcagaggtataccagtgacgagttttgcttccaacccgtcactggtatcccctcacctgtgacggctttcatttctggcccgtcacaggtgagcggataccagtgacgggccgttgaatagaagcccgtcaaaggtatgagcaatacctttgacgggctttttttatctaacccgtttgaggtgtgttggatctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtaggggctgtaagaatgaacagatgatcgaagacaaggatgaagtgcatgctcatttgataatgaatggattcatgaagaaatatacctgctggaccaagcatgaagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaaaattgccagataccgttgtatgatggatgcaagtcgaagcacagcaagttgtcatgcgtgttggaactcatgaagcttaaggctagtaatggctggtcggacaagagttttacagaactccttgaactgttaaaggatctgttgccagaggggaacaatttacctcagacgacatatgaagcgaagcaagtattatgtccgttgggcctggaggtcaaaagaattcatgcatgtccgaacgactgcattttgtattacaaggaatacgctgacttggatgtctgccctatctgtggggcatcaagatacaaacgagcaaagagtgaaggtgaaagaagtaagtcaaagaggggaggcccagcaaaggtggtgtggtatctcccaattgcggagcgcatgaagagaatgtttgcgaacaaggaacaagctaagcttgtgcgctggcatgccaaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataacctt

SEQ ID NO: 75304 - DNA, 8794 bp, Oryza sativa
ccccggggtagatgggccgagagagatttcggcccatcgaccctgggggaggcaaaatagacttttgcggagggatttgatttggaaagatttggattcgggattgaactcgacgatagatcggggatttgagatcttgagatggcacggacactagacaacaagcaaagaaacaaatttcgcaattagggtttttaagagataatttttcccgctaggcgccacgacggaacgggcgctacacgacacccctccaccggtggttcccctcagcacgctaacacctcacagcccataatagctccaccaatgcgctagccacgagggctagattgccctcttaaccacctccctcatcatggagaaccccgtgactggacctagaagcaaactgtccctagaaggagaggagctcctcagagaagtggggactgtctaaagaggagctgatcgtcgctaccattcaagtaatccaagatctgcaatcgtcgctagaatcccactggtcatcaccactaccaccgtcaaggcacttcggtatcgtcgagcttagctatttccatcaccgcccactagtctcccactgagtagatctagatggaatcgggctcagcaactatggattcagtgcctgcaaatcggttgcggcctccaccgcagtctacagccctggccgttgtctccaccactacctggtatccaaccacaacatacaccaccgcctgttacctcaccaccacactccgccagtagtgcggtgtccgtgggcgtcgtctctccagatcaagccacggcgacctatagatttgggcaatgcagtgctacctctacctaaagacgtcgtggtgctcccaaccactctagcaccaccaggggagaaggagccctaccaccgctgtcttagccggtatggggctacccttgtcgccctaaggctagagcgacgcaaggtttcatgaagctaagagagctacgagattaattgcatcattgcatggacatggtaaggttccatgatttattacccattaaaaatgtgccctagtatgacatactagtcatctaggatatggctcagtgagtgtaacaccgtttacagaaatgttatcaaaaccacatcggtcatacacatagctgcgttgcccaaatgaaggagaagaggaagctgatcctcccccaaagaagaatgcaggttgtgctggtggctgaagctccatgttttctcgggtcaacatgaaaatgacagatgatatctgaggtctatcgttagggtctgactggacgcacaacagcgcaatgtggatgcatcgcagtgcttggctttgagaatatccgtgaagcgattggtcaatcatttgggaaaccgtcccttttgtccagcaattccagacctgttagacggattgacatgagtttgttaatcggaaacttgtttgagagtactttcagatttgaaatcatgactagtttcagtatgcaaatgcaataaaaatggaagcatatatactggagtaaggtatgtcagcattactcagcacttacatcactaaggagattcacaagatcatgatcatcagaattgcagttccttctcctcgttactatttcgaggaccaacacaccaaagctaaaaatatcgatcttggttgacacatttccatctattgcatactcgggtgccatataaccgctgcagaagttatcagcattaggcttggaaacatacattgatcaatatatgtgtgattagtcgtgagtgaaggttttattatgcagatgaacttacaatgttccaacaactctagtcgtcctagtatgagtatggccttctcctagcagccttgccaatccaaaatctgcaattttcggttccatatcctcaccaagtaaaatgttgttcgattttaggtcccggtgaatgatcctcaagctcgagtcctcgtgtagatacaatattcccttggcaattccaagaatgatgttgtattgttgctcccagtttaatgcatttcccctattgatatctaatgtgacgaaatgttcaacttaatcaaaatcactcacctataatacaattcagaaagtgcaaattctgttcttaagcatgtaacttgtttgccatatttgctacagtacttaatgctttttcttaatattgttccacatactttgtctgaagtaaaatatttctaatcgcagtgttatagatttagatactccactctaaagaaatgtgtgattaaatggtccatgaggaggtacagttgtcagttgataccataatttttaatatttaattattggtaggggcaccaaaatctacactgaaagatattataccttttggtatctcctcaagaagtgtaaaaaaataagatatgtttgaatgggaagtaaaattaccgaataggaagttgtccaggctcccgttcttgatgtattcataaaccagtaatgtctccccctgatgcaagcaaaatccatgtagccgaacaaggttcttatgctgaagctctgccaataacagaacctcattgtgtagctgatctaatccatgcccacttgttcctaaaagtttcttgactgctacttcttgtccatctgagagtactccctgaacagattattattcagagaatgaacaatatatagtcctctaccgaatgatcaatggcatctgaagctatttttcatgcatataacttaccttgtatactgaaccaaaaccaccttctcccagtttattgttctccgagaagttctcagttgcctcttgcagcgtaggcagatcaaaaatcatgcattgtgctcttgttatcttcttcaatgctgttgccatttgacaagaaaaattacgtcagggaacagcaaattccagaaactgagcagagactgtatgctactcacggtggtcagcctcgacagccttggtcctcctcttgaaccgaacgaatgcaaaaactgcaaggatcaacagtaccaaaactgaacaagccaggcctgcagcgactcctgctgcactctttttcttccctgctcaaacaaaacatgaactctttatattcgcacaaccttgatcgagtcatatttatttgttggaacataactaaattgcacgctcctgttcatcatactagggtttgaaattacggttcgaaatttcggtaattttgcccccccagcaagctcacatctcacccaaaattttcggttttttgcaattttttgtgaatttggtcaaattttattcaaattcattaaaaaacagtcaaaatttcaactaatttcggccaaaaaatttcggtccccccagcaaaaaaaaccaatttcgaaattgaaaaccctgggtcatacctgctccagcctcaaccggagtctcgacgaccggtggtggcggcggcgagagctgcagcgtcgcccggcctccgtagaacggccgcacgctatacatcagcctgcaccacaccgaatagataccaacccaccggaggctgttgcccatgtacaccgttttcgcattatcgtggaggctcctaaggcattccttgcactgctccggcgtcaggaccggcacgcactgcgcgaacccgtagatcttggggttgaagctctcctcacccgtggcgaaatacttgatggtggtggtcgagttgttgcccgtcgtcgtcgtcgtcgtcgtggcccaggcgtgctcgaccagggcggcgaggatctttgccacggcggcgttgaaccagccgacctccggcaccttgacgttccccgaggcttggccgggaatccaactgtttaggacgaggagcaaatcagtttctctgattccaccatggatatggttaggaagaaatggtcggatttatatatagaatagttcagtacgtcatctgggagacctgccacttgtccggcctgaggaaatccatgaagctctggccggtgaagcggatcaagcaggcgtcctcgtacagggagatgccgccggggcagacgcccttcgcgtcgacgaacgccgccgcgacgcacgcgcggcaagccgaggcgttcacgtcgccgcggcagagcgccagcgcgtagacctggtcgggcgccgcgccggcggtgcggacggcgaagcccggggcgccggcggcagaggcgttggcggcgagcgccgcggcgaggaggcccaggttcctgtcgaaagcgctgttgccggtcacgttcgtgttggcgacaccggggtcgcattcagcgaccggagccgccgtggccggcagcggcagcgtgacgacgacgacggcgagaacgacggcgaggatgccaccaccgtagacatagccggcgagcatcggcgcagcagatggggagagagaggtttctacccttaacgaacggcgccatggtttgcactaaagatggcctagctagctagcgccgctgtgccgatagctacgtatgccggattgagtgcgcaagtgtggagtcaaacatgaccggctcgcccgggaatgtttgcaaattcgcccacttgaagttgcattcaaccatttgccgctatatgatttagcctgccgcactacgtggggaaaagggatgtggatttccacgaggggatatccctcgttgattgcatgtcatctaaataattatcaaaaaattttaaagaaatgacaacatatatagattaatatgaaatatatcactccacaaacatataataccaaattcaacttttacatgttgcaacaaaaagaacaaattgaactaaaaatagttattgtacattcgcagctatatttgttatttttgttacaacttgtagaagttgaatttaaacttgcatgtttgtagagtgatatatttcatattaaactatgttaaaaattttttaaaaaatttttagtgactatttaggtggtatgtacgaaacgaggggatatctattgatgaaatataatcactttcccggggaaaagcaacaacttgcatcgctttgttacactagggaaagatagaggatgtgcttgcctttcctgcttgggcggccgtgtggcagcaaagcatgcatggccttggaaaatcatgtgccaatttttctgtacttagttatcacgagtcattgactcagatgtcattgtcgcggtatttttagcttttccggagtatattggtacacgaatactcgaggatatgacagcataatatggtttcaatgaaaaaggcaatgtgatcgattgatgattttgtagtcgccgcctttcagactttagaccccgcgcgtgcgtactttccagccacaacatctgattatcagagcctaactcaatggttttaatttccacgagttttccggccgatggtgacaagagcaaaggcataggtgatgttgctcagggattcgggtcagctgcagtcactactgtgactgcaacttaagcagcagtagtgcatgtcattggatgcaaattggatggtccagattgcatgctgtaccgcgcatagtactatagaaaaaaatactgtagctccgatctgaaccgttgatcctaaaaatagattgccaaaattgtgtgcagttttatcttgcagttacaagtgtaacccgatctcaatccgttgctcaggaaccttgatccggtatggaatctggaaagccatgcgcatgcagatcgctcgctggaaaaaggaagcatcgatttttttttgagggaaaaaaaaagggagcatcgattgatttgattagcatgaagcttggacacacggtcagaggagcgcgcggcatttgacgtgtctattggaaaggaatgaatgtgggaggaagcgtcactaccacattaacgattttcgcataggggcccctctctagcttaccggtctgctactcggctatgacatcatccgtctgtgataatattatcggcccgtatgttcaaaaaaaatattatcggcccgggaggaagacaacacactcgtatgtaaaaatcaatttttgcatgtcagtctcaccaagccagctgccccgttccctacttccctcttcatctctttttctctctaatcttttttaaaaaaatctcctcactccacactcgtgtgtccatccattctcctctcctcacccgctcctctagcacccgtcccccttcccccaccgcctatccatgggagcgatgacaacggtcgtgacgacagcggcgacgggaatggccctgtgatggtcagatctgacgccagtagacagggcgacaacgacgacgacagtggtgggtagggaaatgatgacaatggcatatcgcgactcgcgcgagggtggtaaagtggctaatctaccatcccctgtcccgggaggggcgcatccaccgtcgtcggcctcgggagcgacgacgactactgcggtgactgcgtgcctcagctcttcctcctccactatcgcgagcgcctcaattcctccacggtcggaagctttgcaacagccggatctaacggtggcggctagatctagcaatagtggcctcgtgacaattggatccagctgtggcggcgctgcgatggttggatctagttgaggcgccccctcgacgggtgggagctgccagcagcgattggcccggtgacagatgggcacctgggcttctccactgcagcgcacctcggcacctccgccaccggtggcctcagcttctcgacccttgacggtaagattttacagatttttgggattatttatttgtttttgccaaaattctagtgcaggcggatgacataacatgtccacttgcgaaaaatagtgtttgcgtacggttgtagtgttgatgtgcgaaaatcttcatttttataggcacctggctctaggcaggtggagcaccgtttgtgaaaactgaaaatgcctgcttgcgaaaagcaattatgtagcagtgcgtcatctacatcgtgaatgcgttgatcgtacccgtctgaggatcctctgagtggtttctcgaaagaagctcaaagaagatatgggatgttcactactctcatagttgccggttcaattcgtcagcaccgatgcctaactgcataggtgccagttttaaaattggcacttatagagattataggtgtcggttctatcagtataaccggcacctataatcttcaaaataataaaacatatgggctaggagaggtgttgctaccgttgggtggagctccggcaggaagacaccgtcgcgggagagcgacgagcgggatgacgacgccgactcgttgttgtccctccaggcgtgctcgacaatggcaccctatcaccgtcgacagcgccaccggccgccaccactgcctccatctccatattgtgctcccccttgcctctggccttatctccttgtgcgtggggaggggaagtggcctgaagtggcgggggtggatgggcgcagacaccaagctctaagaccttgtcatcagccagccagggtagactaacgcaggaggggaaggggaaggggagggagaggaggtagaccgcaggtgggagagggagtgttgacccccgattttggaaatcggaaatcttctgtgtttatccgtaccaatccctggatcagtagttggtacacacatacatagttggatcacaacatatcacgaatgaatttaggctaaaaagaattaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactcccctaaaagatatataaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatagactgatcaaattttagtaccagtgttcactttaaacaacgacggttcggtccaccatccattgtcatcccaaggatagcttcccgccattgaatcatcatggttttctgaggatgtccaccttccctcctctcgggatgtggctccatcagcataaaattcatcatgcaatatcccatcccccacaagttaagaatttagagtctagccaagtgtaatacatgtcccggtgctcaataaccgcgagtacggctattcaaatagatttagtttactcacactgcagtggatgtacactttacctgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggctgtcccattgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggatggtactagccttttccagataccacccaaatcctccgtccgccccagtcga

SEQ ID NO: 75305 - DNA, 12625 bp, Oryza sativa
gatcaccccccatctccccctgacacgctcctctcccccttcctcctctccttcttttcctactacaccataaatttttaaaaaataaaaaaacaaagttaaaaaaatttatgtatagaaatactatatataaaaaatatttgaattcaaatttaaatttgaatcgggtatataaacttttgacttataaactttggttctataaacttgagatgtataaactttagatgtatagaaaatactatatataaaaaatatttgaattcaaattcaattttgaatcggatatataaatttgaattaggtatataaacttttgacttataaactttgggtctataaacttgaggtgtataaactttagatgtatagaaaatactatatataaaaaatatttgaattcaaattcaaatttgaatcggatatataaacttttgagttataaactttagatctctaaactttagatgtgtaaacttgagatgtacaaactttagatgtataaatttactaaaataggaaaataaagtaatacggtgccaaagaaaaaaaccacgtggaggagaggtgagcgatcacccattaggaatctcgaatgtctacagtctacgtacgctgcattcatccatgatccatccggagaggaaaatgacaaatcaacagtcatgctaggagtgctgtggttatctcaccacatcttttggttgctactccacttgctataatcgtgccatgccaaaaaaaataaaataaaatccttggtcgacctagcccggcccagttgcaaattaacctgtatctctagttctctacacagactacacaaggccactaggtcgcaggcacgggacgggacgcatgcacatccagaaacgaaatcacgagtccatgtctccatgagccttgttgctcgctataaattcccatcgcgctcgcgtcttccagtatagtcgtcgtcatattttaccctgctttcctctgccactcgatcgccacggctcgcaggacaagaggccatatggcgctcgctctcgctcacctcatccttgccgccgcattgccgctgctcttcctctcacgtgcaggtaaacggtgtagttgcagctctgtatcaacggcagtgtggtgcgttgtttttttttgtttttctttgcttataatatatcgacgtgtaattcttttgcgtgttcgcgaaaaatgtttttcttgcactgcagatgggggcgaggtgggcgtgtgctacgggagggatgggaataatctgatagatccaccgtccgtggttagccttctcaaggcaaagggtatcaccatggtgaggatctacgacgccgacccgaccgtgctaaacgcgctggccaaccaaaacatcaaggtgatggtggcgatgtccaatagagatctagtagctggctccgccaaggatttcaatagtgcgctcagttgggtgaaaaactacgtgttgccgtactaccgttcctcacaaattaacggcgtggccgtggggaacgaggtgtttcagcaagcacctgacctgacctcacagctggtatcggccatgaggaatgtgcaggcggcgctggcgaggctgggcctcgccgacgcaataaaggtatcaacacccattagttttgattcagtcaaggtgtcattcccgccatccgcaggtgtgttccaagataacatcgcccagtcggtgatgagtcccatgatcgacttcttgcaacaaaccaactcctatctcatggttaatttctacccatatattgcctgggctaattctaatggccaaatctctcgtgattatgctgtatttggccccaacgcctctcctgtggtcgatcaagcaagtggcatcacataccatagcctctttgatgctcagctagatgctgtttacttcgctatagaccatgtttcaggtggtagtgtgagagtctcaatggcccaagcaagacgggggcgcccgtctccaaggatacccgtgaaatgttcagaatgtgggcatccctctggtggtcggctccctcagttgtccacactagatgatgttcaagtagacgtggctacaaaagccaacgcccaagcttttaacaatggtcttatcagtcgtgcactattcggagccaccggtatgcctgatgtctccgtatacatctttgctcttttcaacgagaatttgaagggcggagcatctgtagaacaaaactttggcttattctacccagacgggacggaggtttaccaagttgactttcacaatggtggtggtggtaatgtttgccctacaaaagcaagttggtgtgtggcaaattcagcagttgggagcacccggctgcaagcagcgttggattgggcttgcagtaatggtgcagattgtggtgctatccaaccaggcaagacatgctttgcaccaaacaccttggtcgcacacgcatcttacgcgtttaatgactactaccaacgtaagagccaagctagcggtacatgtgacttctctggtgctgcttttattgtctacaagccttcaccaagttagtttcctctccatccttattaagttttcaggatactgtttctacatctatgcatccatttcttattcgctatttgttaaccaaaatgtataaaggtatctgcgacccgaacccaagctggtgcattgcgaaaccggaggttggggacacacgtttgcagaatgcgctagactatgcatgcggtagctgcgcagattgcagcgctatccagcgtggtgcgcaatgctttgaccctgacaccaaggtagcgcatgcaacctatgcattcaacgactattatcagactaccggtcgtgccagtgggtcatgtgattttaacggcgctgctaccattgtcacacaacaaccaagtgagttcacgttcattttagaatgcgttcaattaatatatctcataccacttaaatcacatccttgcctgaacaataattgaacgctttcatttcatgagcagtaaatggttttcaccggtgctcatttaatcatattttgcagagattggaaactgcgtactctcaccaaacaactcttgaatgtacagaagactcggcagtaagaggatgggattgaagaataagtccatattctctaagaaaggaataagtccatattatggtcaaataaaaataaggacgacattgtatgtattccggtttggaattttaagtaagtaataaatgtatcgttcactcgtgttgaaatgaataagaaacttaattactctatgaaattcccagttaaacattaattccagagagatacatgtacatgaaactcctacgtggcttgttcgcttaatccgagagagagagagtgagggggattggagggaattaagagggaataatcccacaccataatagttatggaataaatcccctcgatccctttgtgggaggggttaatcaaacaaggtctcaacattaacagcaagtatgcaatgcaaatgcactgacgacattgttcaaggcgtttcctcatcaaagttttagaaaagatttaatggccctcgaaaggtgcggtactacaaatgtaaatttggtactatagtatctctcagttccaagaggataccctcctgctacagtcttaaggcccctttagaatttctcaagttgtattatcccactgggccatacatttgacagcatattacatcatgtaaaaaagaattaacagtatatcaagatctcgggatcaaaaaccttgatctcccttttctataatgaaagaaaatatttaaatgttgatgagttggtgctgaggtactatatataattatttttgcgtggatagacacctatgtgcatttgtatgatatcacataaaaggacatgttcggctgcgaaacatacatacggtgcggcaatcacaaagacagcagctgtagagctggcctgccaaacaggcccaaaatttgatgatcagaaaatattaagtctccccttttgacttgagaaaatgatggcatttggcttgtatagctaggcatggcagcgccaatgactctagtggactgaacgatagatatttatgtgaacgaaattaaagctaggagtatgaaaataaacaggcactagcgcatacgggtcaggcatatatatgcactataaaagagaagaaaacggtacagtggaatggagatattgttagttgttacttgaccttgtatctgcgccttttccacacgagtagacaaaatgtggaaaatagcatttgaccccgaggaagacctgcatatatatgccgaatgcattgcagcaacgtgaggatccacacaacatacaagttgggcagcaataaaccagagaaggtatagaaaaaacagcttataaaaatgattatattctaagacggagggagtacttcagaacaattcaaatgaaaactttatcaactacaaaggtttatatctcagagttctacaagttttatattggaaatatctccctccaaggtcggatgaatttttcaaagtttcgtttttaaaaaatagatcacaccttataatgtatattcagacatgtaaacaatctctcataaagatattatcaatattaacgttgtagatctggttgagctccacaactttgatatacggcatatctccatccatggtcattagaaaattttgaatttttgttttcttttaaaatatttcctcattccaaaaagaattcaatcctagtgatgaatctgaacatatatatagtgtaggttcagatttatttttagggttgggtattttatgggattgaggaagtcgatctcatcacctatatcatattagggtatgtataaacaatctcaaatgacaattattatcagttataaagttgtagatatcattgaggtactaagatcaatatgtaacggttgttgcactagtgccaggggcggagctagagtcatcagggggttcccaagaatccggtgaaaaaaaattgtaactaaaccttacctattatgatcatgtgtgcgctcctctcaatataaatttaggaacccgtatcaacttaaacttgatataaagtagagtaaattaaacaaatgacactcctccattttattctagctccacccagtgcagaggtactaggattattaatcatggacagacacctgcgtgcgccttgtataatagtattgcacaaattttggtattgataatagcaaaatataagtctccccgttgactcgagaaaatgtcggccgtttggcttgtatagctaagcatggcaacctactctagtggactaccgaacaaaatatttatgtgaacgaaattatagcgcatacggcatacgaaccatatgcactataaaagagaggaaaacagtacagtggaatggagatattgttactagttgtcacttggcctatactacaccttttccacgtacgcgagtagacgaatttgtggaaaatagcaaatacgactacgagtaagtttcttcttccaagtcgcggcctttgacccgagaaagacctgcatatgtatacatgatgcatgcatattgcagcaacgtgtggaacgatacaacctacaagttgtgcagtgtgagccagagaaggtacagaaaaacagctgccctcttgggttacataattcttgaaaaacatctactaacgttttgtacaatcacagagtcttccaaaatatatctttagctatattcttctatcataatatatataataaatatatttttttacttttgttataatacttggtaagacacatctatatatgttattccagtgtctttaaactaaatatttttaaagttattgattgtcaaaattacaaaaataatgatctcaatcttgtttaaaacataaagaattatgggaccgaagggagagtataccgacaactcaaacgtgcatttaggttcgatgattgaataatttttaccattcaacatttggtatcttgagatactttttattataaaatttgatatttttagtgtaaaatttgacacctcaagatacctacctaatacatcgagggatcaaatttttgcatgcaaaatgtggtaataggattaaattggttggtttgcgttgtggcttatccaaaccaaatcccgcggctctctctccagtgtgtcgatctgcctcgtggaatacgacgctacaccaagtgggcacatatttacgcagacatgcatgtatcataggttctatttgagaaattttgctgagattcagataagttgaatgtcagttgtggtacaatattaactggatgatatctgccgtgcttcaaccgcactattttttcataaatctttttatcggtatagtttaaaaaagtttccaagctatttgtcagcattattttctccggtcctgtaattcttaacgttttggacaacgttgagatcaaacttataactttgactatcaataattttaaaaatatttagtttaaaaacagtaaaagaacacgtatagatttatatatacttcctccgtttcatattataagactttataattgcccatattcatatagatgttaatgaatctagacattacgaatgtagacaatgctagaaagtattataatatgaaacggaggaagtattacaaaatacaataataaagtaaaaaagtatttatttattgcatactcccttcgtcccaaaatataagcatttttagttatgaatctggacaactgtatatccagattcataactaaaaattattatattttgggagagaggtaatatattataataaaaaaatatagtcaaagatatattttgaagaccgtgtcaatgcccaaaatatcaagaattatggaattggggggagtaaactatataatatttaattcatctttgtagataattttctatataatttttatcattatttagaaaggagatagacttaatttgtttaaaaaatatgtctaacatattaagtgtaacttaaaagtaaagtgtttttaatgaaatgtttagatgctctctttttaacatatcatgaaaaactattattgctaatacatatattttgtcagtatatcaaggtagctctccttctaattgattcacgttaatacagttcgttacatacttacatatgaattaataaagacaacgaagatatatgatcccttctatatgcgttatctatagttcttttttttaaaaaaaaaactagtcaacatgggttctaaaatttaatttaagagtaataaatataacttttaaaccaattatgtaatgctacgttagtgtggcttatatatgcaataatatatagagaaactaaaaaataccacggtatgaatagatgaaaggccattaatatctaatcacttaaaaatggttatgacaatggaaaacataatgatcttttgaaaagtaagaaccaattctttttaacgaatttattagattttctccgtatagctcaacttagtctccgttgacatgttctattttatacaagtcttattttaagtttaaaaatatatgtattatggatgttgaactattggtttaatatattataaatagagcaacatgtagattataaatcagatgtgtagtttacaaattacagtcgttttaatattattaatggtttcgcttttagtttgcggaaagagtgaaggttcaatagaaacaggcagagggaggtgtggagagcggagaacccgaaccaaaagaagaggggggcgcgtgtaatgttgtgcattggggcattgggaagattggagagggggaagtgaaggggacctttatttttctgatttttcagaacgatttaggtgaaaagcgataatcagatgtgtccatgtttatattggtaatattaattaaaatatgggctaattgtcgttattctacagcacgtaattggcggtcatgttctgttctgatatttacatggaatataagtcttccctaaaccggagaaaatgatggtcgttggcattatgtacatatagacggcggttgcgcctcctccaccggactggatatttctgtgaatgagacgcatgcatatggaaaaacaatggatcaatccatgcaccaccagtaagagatggaaatattagaatggcagtcctactgttaggcgctttaagttgacttgtcttagggcaagtacaaaaggtagagaccgatatagtctctatgttaattagaggctatcacgttacaatagttaagagaatacggtctctaaccattaatgtaccaaaatattttcttactagtcgtctttcctttattagactcaaaaatgcaacaaaaaaaattcctaataaatgctaagagtcgactctatgctgttgtcatgcatagcaaccatctttctttttcttttttcctccctcttccacgtcatcagatatacttacatgacaataaaaagagaccgctaataaagaccattgtacatgcccttatgccttttttccacacgagtagacgaactgtggaaaatatcactgctcgttaggcctctcaatagtcaatgcatatttatacggattttccaagtccgctggctttttcttgagcaatattgcacgcaacaaaagctagcaattaaactgatgctagggttgctagcttgcagttgcatgtcacgatcgaggaattggaaaatcgatggactgatggagtccactaaccaggagatcaggatgggtagacaaagcataggcgaaccgtggatgacgggggtcaccaccagccgctcagggccgagccctttggcgaatggcgccgtagtgcgcgtgcgggagctaatgcctctcggacacatatgtgccgacatcgacgacttgcccgcccgtacaagtcatgcacggacatgcacgccaccggccgaaattgtcaatttggcaacgccctgatgaaaggatatgcagcggcgtccgaagacatcgccattgctggtctatagaaattaacctaggctaggctttcacctgtttcctctctactactactctatcatcgcagtgatatttcccacaacccgtgacctgtgcaaacatgagtaccttgccgcaccagcactcctccagcggccatcccctgcccgccttcaaaacagaatactggggccttccactccacaaccgccaccgtgttgacatgtaacgtcccgtctcccccaggccgggcccacttacatctgatagttttcataggtcatagactgcccgcttaaccctggagttctttggagattggcttccgaaaaagaagttgcaacttgttcatatgagtattctattaatcctattaagccctaggccgggatgttacaccctcacccccttaagagagatcgacgccccctcgatcaaccctaagccaggaacgtcctctcttggccacgtccatgtgtccagtgccagcgcatgtgccatgctgtgtaaccactcccggtctacaccagccatgcgcaccatgcctgcgcaactgcgacacacgcgcccatgaaaccgcgagagtcagctctgataccatctcttgtcacgccccgaactagtaccgaccggaactagcccgtgacgctcccaattaacctgttaatcgataccagtcccaggaaacagtgctggtatcacaggaagacagattatcacagcaacagaggtctctttattatagatagagatacagtcatgttgggctgcggacagaccccgagctcacaactgcattacaaaaggaaagcagaagccaggactaggaccaaacatcacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacgggagtactcagcaagccatgggaaataggtgtttattgcagactttcaaggaaaggctgttgttttagcaattgattttatttgaacccttttctgaaaacaactaagtgagtgcttctcaaacgacacggatgagacagtgcgtctcgtccggtcggagtatgtgcaatgtatcagtctttagaattgaaacaaggttggcacccggccaacagcttttcaaacggccacccgggccaacaactttcaaacggccacccgggcctagccgattccatcagttacagatttttcaaacatcgaacccctttccacaacagcaatttcacaagcagtagtccaacaaaactacgctaggaatcacctcacatccgcccatgaccgtgggcacggctgttcgaatagtttgttaacctctgcagagggggtacactttacccacacgacattactaacccggatcacccagcccatggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaattcatttagttcgcaagcaccgacccaggtgtcgggttttccaagtcttttgtaaaactccagttttacccaagttgttactcaaaattttaagtttgaaggcgtccgtcgatactcgcgcagggtgcacgaatatcgagacgcaactagatggttacaaggggacatggtatcacaattaacaaaggaaggatcaaatgcaacaaattaggtaggtccgccaatctgccttgcagacgggacaagcagattaagtgcagtcctatcaatgcataatatttttcaagcaacataattaaattcaaatataggctcaagacgttcgaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctggagatttgaggaattttggaagttgaacggagtcaaacggatttacggttgggaagatattgaatttctaagattattggatttttggtctaaaggaaaaggatttaattaaatcctttttaaaaagaaaagaaaagaaaaggaaagagggagggaaaatagacttcccttgggcggctagggcgcggcccgagagaaagggcggctcggccgagcttaatgggccggccggcccaagaaggcggcccagagcggcccaaggttcgcgcgcgcgggagggaagaagagagagagccagtggaccgggctcaccacgcgtggtcccgggtgggacccgcttggcagcggctcggctcaccgtgtggagggagcacgcggcgcggcgctagggtgggggagggacgcggtgcacgcgcgcggttcgcggtggacgcggatgcggcgggcccacgcgcagcctcacggctcacggtggaacgcgcgcacggggagggactgaccggggtcggctcgacccggtcttggctgagctggcgccgacgtggcgcctacgtggctgccacgcgggccggcgggaggtagacgacgacgccggccggaatggacggcggacgacagcggcgagcggcggagcgaaccacggcgatacaggcgaaagcgagcacaccgggtagttgcacgagacgaggggagacgagccaacggctcggattcgccggagggagtccgtcggcggcggattgcggcggccgcaaccggcggagagaaaaggggaaaacggcgacgaggtcacgaggggccgattcccggcggagagagcatctacgcggctacgggaatccgttgctagcgtcggattgggcggagctacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaaggggggggagatggagcgaggaggaagaacggagggaggcactaccgtgcgggcggggcgcagtgacgagaggccgacggcgcgggagtaatctctccggcctcgggccaaggaagaggaagaagagggcgcgcccggagtccccttccgcgtccttgctcgtgccggctccgccgacacgcgcaacgacgaacggcgatggcgaacagagcacgagaggcggcggcaatggcgtggaggcgatgggacaacgagggagaagagagggagggcgcctgggctttaaagggcggcaatgtcggtttggaaaccaactttaggcggtctaggcgcgagctggcgctccggctagcggccaaaacagcgacaggaggt

SEQ ID NO: 75306 - DNA, 8155 bp, Oryza sativa
agggttcacggccttgtttaataatactgtgtagctctaggatcgtctttataaaatggctttgggcaactaagtgacttttaaatgctgcttttcagcaaaacttaacccctatattattaccccttgtacccccttgcattaatcatgcatctgtcggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaattattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttacccttttcttccttcttcaaatttcaattagtactagttggtcagctttgtgaagaagaagacatcgtcagttgtttgccgaagctccggaagactgcaagatccgctagcgaagcaaaggaagcagtgaagccagctgtgaagcaggagtgaagatcttggaaaacccatcgcagaacctaagccaccctctagggtagagtcgtttgtcgtgtgtttccttgcttgtgtgtgtagcgcgtggtttgcatcagtggggtgtgatgtaaccatgctaggttgtttgcttaatcaacttgcagaataagtgaaacaaacagcacatcagcaagaagaattagttcctttaaggtcttgtccctagttctggtctattcttttcttgtatgcttcccctctcaacctctaccttgtgacagatggataatactggtaacaaaggctatgggaatgatggatccgatgactcaagaacccaagccaatgggaatgagagaagcaccaacgaaacctcaccagagctaatccaagttgtggttaaccaaaccaacatgttggcaacagcctttcaactattacagaattggagcagcccagcaggggcaaccaacgttcaagtgcctacagtccagcaacagtgcaagttatcagaatttctcaaaactgagcctccaatctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaggcatcacggccagaaggacataccatcacctggaacgagttttcctctgtattcaggagatcacatgttcccgcaggaatgatcacactaagaaaacgagaatttcgctacctgaagcaaggagatttgaccgtcacagagtacctgcacgagttctatcgtttggctcgctatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgtcaacatcccagtaattccatgtggtaaccaaagacagcgcactgagccacttcagatcaccggatcttctgttgtgcatcaagagttcctgccccaagaagacggacgcaatgcagacaacaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcagaacgatcgtcctcagacggatagctcagcaaagaagacgttgatttgctacaattgcaaagaaccagggcattactcgagggactgcctgcaaccaaggcaaaatcgacctccacattaccgccaatttacacgaagcagacattccaattgtattgtggtcactggagcaaacgccgtacccgtaaggcctcgtgttaatcagaacccatagcagaaacaatgcaccaatgctcctcctgctgcacctgactcggcaataaatcatagcaaccattctctgcaccgacagcctcagcaaagaattgtcgtcgatggaagaaattgtgtctctccccgatctactccaggccgagccaagggccatcaacctccggagggcgataccaagcagaagaccgtcatccgcttcaaacagcaatcaaaaggaagcttctcctgtgaatgatagcattatgcagtcctatcacatcatcacagaaccaatcaaggatgcagtcactagaacaatgcccgctttatctctccaaaatcaaaatgagcagccacgcttgtggttttcagttcgctacctatcattgtgcagtcgaaagtttgcagcaatcatgtaattcataaatataatcatgtctgtaaacagtgagcttgctatgtttagagatgattcatgttgaggatacaatgtaccgatgataagcaccttccctttttgtttaaggcagtgccttgtattcgtgtgataagggagaaatgtgtaatacagacaagttctaagaggattcttttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggatgaaacccataagggtacctgccatgcctctacattgataagttcggatatacctgcaaacagttaagaagatccaggagacatcaatgtttgagaacatagtagtcgatggttggtaattagtctatcaagtatcagaagagggtcaaaggtgatatggcagaagaacaatttggatgctccccatctcgaggaagcactaaggatgatcatcggcaattaaaccctagtggtatagatacaaatagcaggcaatgtatttccctgaaggtagtcagtacagctttttgacgaaccacatcaaggtttcaccgaaaggcagcaagccaaaggacctcatcgtccccagaagcgtccgcaatccacattaaagaataccacctgttagagataggccgaaagatgattgataaaagagattggcaaagatgttctctagcatgaaagaagtaggccgaaaggtgattgataaacagaaacatgttctgcatcgctcaagggagacccctaattgtaattgccccgcaacagtcaccttgtcattaagtaagcaagatgacctaggtaaaagtgtttttatgaaggcaaagagtgaaatcttcaactcggtatcagatgctacacggagtgaaaagtgcaagcaccggttaccaggcaatgccatgacttgggaagatgatccaatgggaaagaacacatcaaggttaaaggtgtaaaggaatacgttgaatgctaactgaggacaacctgaagataataaggggaagtaaactgaatgtaaagaaagtgaatccgagttgcttgttcgtgagggctattcccagttatgaatcaagtgatatgttcgaagataatctacagaggtcagattaaaagcacatctaacaacgaagcctcagatttgacagggtaatgattagacaataacaaatccagcaataaagccattggagaagacgtcaaagtatgtcaagtgggataaattggttctcttgggaagcataacttatagttagagtggtcgacccttgcatcgaatagctgaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactgaactaccgcaacctagtctgagtcagccaaaaggtgcaccctggtccaagttaggtgaagagaagattccatccgcaacaggaggtcaagccaagcagttccgagtggtaaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttcccccccttcctctcttgggccggctcggcccaactccccctctctctctctcctctccccccccgcggcccatcggcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgccgaatccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaagggcggccgagatctccgcgcccgtttcctccctctccggccgcgctctcctcctcccggtgctatataagcgtcccccgtgctcttctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccatcggcttcgccgcgtccccgtcgacctcggccacccctccgcttcgctcgccgactgccggagcaccgtcgccctcgtcgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccacgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtaaagaacccatttttgtgctttgtttctgttgttgtatggagtttattagagtaaaagcctttttcttttccgttggtcgtgtagacgctgcagcttcggaagatccgctcttcgtggaagtcgaagccgtcggttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctacctgtcccgggtatcccggccgtaggtgggattgggtcggtactcttgtctatggctaggatgggttggaaactatgtcacgtctttcgtccgtataccgtggtggtatgtggcacgtggtcacacgtgaggaagatgtgtcttgtgggtaaagatgtacacctctgatcagagtaaatctattcgaatagccgagccctcggatatgggcaagcctagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgcttttcagcaaaacttaacccctatattattaccccttgtacccccttgcattaatcatgcatctgtcggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaattattatcgatataataaagatgtgtcttttatatcatgtttgtgtggtgtaccccggcttttcctgggacggggattaatacactagcgttcgggaaaaggcaattttcccggtcgcgacatgccgccgccttgcgccccgcgccgccgctgccacgctgtcgccgcgccgcacgcccgcctgccgccgtgcaaccgtcccgtcgccgcgccgcgcgcccgtcccgtcgcgccgctgtcccgccgctccgcgcgccctcgcgcccgtcaccgaccgtcccgtcgccgcgccgcgcgcccgtcatgtcgccgctgccgccccgtcccgtcgcctcgcgccccgctcgccgcctcgcatcccgcgccgctgccgcgccgcgttgtcgtcgcgtcgccgtcgccgtcacacctagccgcgccgagccccgcgcgccgcc

SEQ ID NO: 75307 - DNA, 17263 bp, Oryza sativa
  unsure (1)..(17263): unsure at all n locations
gttcccgtgccgccgcgctgccgttcccgcgccgccgtgccgtcgctcatgtgccaccgtgccgccgcttctgtgccgccgtcgtcgtcgccgctgctgccgtcggtgagccgccctccttccccctcgcgtccaccgccgccaccgctcgggtaggagggagagccgagagagagagagagccgagagaaggagaggaagaagaaaagaaaccgagcgagggagaagccgaggaagagagaaaggagccgggagggagagaagaaagggaaaaagaaagagaggagagaaagaaaagaaaaggaaaagagagaaaaagagaaaaagaaaagggagaagagaaaagaaaagaaaaaggaaagggagaaaaaggaaaaggaaataaataggaaattagagggagtttggggaagtttagaaaatttaaaataattagaatttaattatagattaattatagtcgtagaattgcaaaatttaatataaattatggattattcttggtaatttctataagaaatcaattcgcggtagtaatttagatgtaattaataactaaacaaatagatgaattcttacagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaacgaaataattatacccgcaaagtagtttaaatcgaaattgggtttgccgtagtttgcagatagtaaagttaataaaaaggaatcgactttatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacaatgggacagccgttgaggtagggccgagaggcgtaccctacatcggtgtcgccattggtaggactgccatgagtgtgttagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatatgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggaggggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagacactcgtgtatgtgcacttgatattccagctatgaattcgtgtgtaccaaactacttgatccagggaaatggtactgtttacacgattgattcctgttataaaaacaggggtccacagcgcgccgcctcccgccggctgtgccggcgtggctgccttcgggcgcaccgtgcgcctgccgtgtggggcccggccgtcagccgcccgcgtcctcgggtgcggctgacgcgtgggacccacggcgccggccggtgtgagcccgggtgcgcccggtctatcgtggaccgtgaggctgccgcgtgggccccactcccgtggacccggtccgcgcgcccttcccctcggctgacgcaataaaccttttttttaattaaaatttaagtgaagaaattcgcaaatattcatttaaagagcatataaacttcaaatggccataacttggccatttgaactcggaattggaccgttcaagtctctaatttttccttaataagtcaagaacccatttttgtgctttgttacagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaattggtttcacacctccccctctattcaaaaccctcaaaatggttttaggctgggctcagggtgcatggttttgatagtagcacctcggccatataaggaccggtctgcgggcctctgttgcaaagcactaccgtacttccacatgtctagtgggtaaggcttagtttgtggctcagtctggttataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctacctgtcccgggtatcccggccgtaggtgggattgggtcggtactcttgtctatggctaggatgggttggaaactatgtcacgtctttcgtccgtataccgtggtggtatgtggcacgtggtcacacgtgaggaagatgtgtcttgtgggtaaagatgtacacctctgatcagagtaaatctattcgaatagccgagccctcggatggagatggacgaagtcgggggtcgatggacatctctaggacaaatgaagtctacacgagctgcggcccggtagtcgagatgtcatggcacagggccggtgtcctgctgctaggggctcagtcctgcctacctgtcccgggggtcccggccgtaggtggggttgggtcggtactcttgtctatggctaggatgggttggaaactttatcacgtcttccgtccgtataccgtggtggtatgtggcacgtggttacacgtgaggaagatgcgtcttgtgggtaaagatgtacacctctgatcagagtataatctattcgaatagccgcgccctcggttatgggcatgccgagcaatgtacccaagttagtgttttaaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacgaccttgtttaataatattgtatagctctgggatcgcgtttacaaaatagctttgagcaactaagtgtcttttaatgctgtttactgcaaaccctaaccctttatatcttaacccccttgtactcccttgcatttatcctgcacttgtgggtgtgtcttgttgagtatggtggttgtactcaatcttgctcaatttttcccaaacccagaagaggagcccctggaagataaaggctttggtgtctagctcgtgcctgctgtcaagcgcctgtggtcgtcgccctagtcttccgttgtttcccgtttgtctttgtgtgtgctgagccttcgctgcccatgtaataaattaactatttacgcttccgcttgataaactctgaaatgtatcaacttttggtgtaccttgcctcctgggacaaggaataatacacgcatgtaaggaacgcccattgggttaattccggtcgtgacaacttcctcaggagcgtaccgagccaacttgttgaacatacttaggtactcattgacactgctgttgccttgcttaagtctgttgaattcatctttcttcatgtcaatagtgctttcaggcacatgagctgcacggaaagccgtagcaaactcatcccaagcaatgttagtgggttcagggtgtgcattgcagtaattctcccaccaatctgcagcaagtcctcttagctgttgagaggcgtagagcgtcttctcaaccggagtacactgcactaagttgagttttctatcaacatctttcagccaatcgtcagcctcgacagtctcgacggtctgagagaactctggcggacgagacatcagaaaatctgtcagcttggatctattgttgctcatgtgagggtggccatttccatgcgcattatgctgaaaaccggctacggctgcggctaatccttgcaagatttgtgtctgaactgccatcaggtgctgcatgttgttttccacatgaggtggggaagggaggcgttcttctccagaattgtgactggcagggcggtgagagcggtgagactgttccatctctgcatcacgggaagctgtgcgatgcgagcggttgctgcggcggggttgctcaacttctgcgttgcgggaagcagtacggtgcgaacggttgctatggtgagactgctcattagctgactcatgattttcttctggctcaactctaccttcttcaaaaccgaagcaggctggtgcacgagctgcacggcggggacggctagccatctaaactcccagaagagggcggggtaagagtcagataagcacttaggagggcaaggagcaaagtaaatagcaactcagatagcacacacttggcataaactggatttttcaaatcataaaaacacctgatacaacgggtgtggacaagtcacagagctacgccgagcttgactgtgcgcacaccacctaggagaaccagactaccaaacaacacccacaacaacacacgcacgcactacctcgccacgactccaaaagagttggcggcggaacaaaagggcctaacacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcagtgcggataaagcataggccacagcgggaggaagcaactggggtgtgtccgggggtgtaggaagggctaactgggtgtgggtagggggagtacactggcgagtacggcgcacgcgagctgggggagcgcgggccactgggagtgcgggcagagccacgggagctgtgggaggacaggtggctggcgtgacagagacggcctaagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccgaaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggtacacagagagctcacagtgagggggaacacggtccatggagtaccccgtgtactcgggacacgagaagccaaggaaacgggcgaggtcacgaagctgagcgacgtggtgaccctcaccaaaaccgtgggaactgaatctggcgttcactgccatctacaattttgaaagagggaggaaaagatcagtaacaattttagaaacaaactattggaaataaagaaaacaaaagaaaccttagcttttcgtaagtagttttgaacttagtatccttagggtcgtcctaagcgtcgggtttcgccctagggccaagcctatgctctgataccatctcttgtcacgccccgaactagtcctgaccggaactagcccgtgacgctccaaattaacctgttattcgataccagtcctaggaaacagtgctggtatcacaggaagacagaatatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagccggttccgcttcatcttcttcagcaactgggggggggggattatttatatagagcaagggtgagtacgggagtactcagcaagccatgggaaataggtgtttaatgcaggcttcaaggaaaggctgttgtttttgcaattgatttttatttggacccttttctaaaaacaactaagtgagtgcttctcaaacgacgcggatgagacagtgcgtctcgtccggtcggagtatgtgcaatgtatcagtctttagaattgaatcaaggttggcacccggctaatagcttttcaaacggccacccgggccaacaacttttcaaacggccacccgggcctagctgatcccatcagctgctgatttttcaaacatcgaacccctttccacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcaaatccacatgtctctcggcatcaaggctcccctgataagctagttactcagccaggggtgtcccattccacccatgtggtcgtacttgacttatgtttggatgaaattccaaggaaacggtccttaagtgcaagagcgggaaaccgtactcccggtacgttccccggtccgcggttttggaaattcatttagttcgcaagcaccgacccaggtgtcgggttttccaagtcttttgtaaaacccaagttttacccaagatgttttttcagattttaagtttgaaggcgatcgtcgatactcgtgcagagtgcacgatttccgaggggcaactgggtggttacaagggaacatggtatgacaattaacagaggaaggatcaaatgcaacaagctaggtaggtccgccaatctgccttgcagacaggacaaacagattaagtgcgatcctatcaatgcataatatttttcaagcaacataattaagtttcaaatataggctaaagatgttcaaaggtggcttgccttgctcgagatctggagcttaatcctctaaatcctcgcactgcgggtcttcgggctccgaaactacacacgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaataaaagaaaagaaaagagggagggaatatagacttttctcgggcggctagggtgcggcccgagagaattggggcggtccggccgagctaaatgggccggccggcccaaggcggctcaaggtggcccaaggcgcgcgctcgcgcgggagggaggagagagagagccggtggaccgggctcaccacgcgtggtcccgggtgggacccgcttgtcggtgattcggttcaccgtgcggatcaagcacgcggcacgcgcgcgcgggcggggctgggacgcggtgcacgcgcgcggttcgcggaggaacggatgcggcgggcccacgcgcagcctcacggctcgcggtggaacgcgcgcacgggaggggctgaccggggtcagcccgacccgatctcggccgagctggcgccgacgtggcgcctacgtggctgccacgcgggccggcgggaggtagacgacgacgccggccggaacggacggcggacgacagcggcgagcggcggagcgaaccacggcgatacaggcgaaagcgagcacaccgggtggttgcacgagacgaggggagacgagccaacggctcggattcgccggaggatgcccgacggcggcgaattgcggcggcggcaaccagcggcgggagaagggggaaacggcgacgaggtcacgaggggccgattcccggcggcgagagcatctacacggctatgggaatccgatgctagcgtcggattgggcggagctacgccgagcgaggccggcgacgagcgggtgctacggagctcgggcggcgacggcggcgagcacacggcgagcgacggcaacggtcggggttgcgccggctagttacggggaggctactcgagctactaccgaaaactaagggggggagatggagcgaggaggaagaacggagggaggcactaccgagatgaggaggggcgctgtgacgagaggccgacggcgcgggagtaatctctccggcctcgggccggggaagaggaggaagacgagcgcgcccggagtccccttccgcgtccttgctcgtgccggctcctccgacacgcgcaacaacgaacggcgacggcgaacagagcacgggaggcggcggcaatggcatggaggcgaatgggagaggaaaggaaagggggaagctcgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaagggggcttgtccccttgcctcttcgggaaaaggaggagggagcgggggtgacgcggcagagggaggaggagctctgcctccgtcccttggcagcttgtgcgcggagtggcgggggccgggcgatgacgacggcgatgacggcggggcggtgtggagcggagcggcgacacgagcgacaggcacggcagaggctgacggcggcggcgaccaggcggtcggccaccacggcacgcgcgcgcgggaaacaacgggcggcgcggacggcgcaggcgcggcacgcgcgctggctcgcggggtcgagcggctgcgcggcagggcagctgggccgggtggcgcagacggcgcaggcgcggcacgggcggcgaccacgcggctctcgcgcacgcgcgggcagagcgagggaggagggctcggctcggcgcggctcacccccccccgcaaaaaaagcccgagaggagcgggncgcaggnacagcacccanccagagcnagnnccgccgccgnngcanaggncccgcgcaccgggggagatgggccgagataaattcggcccatcgaccccgggggaggcaaactagacttttgcggaggaatttgatttggaagggtttggattcggaattgaactcgacgatagatcggggatttgagatcttgagatggcacgagcactagacaacaagcaaagaaacaaatttcgcaattaggtttttaagagataattttcccgctaggcgccacgacggaacgggcgctacagaccaacccccctaacaagaatctcgaccccgagattcagtacctaagggagcagctccgggaactcggcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactaggatacgtggaacacgttgtgcacatctgcgagacctttaggtaactcaagctgataagccacttcgccacgtctggtagttatgaggtaggggccgatgtagcggggtgctaacttgccggacatcccaaaccttctcataccacggaggggtgatacccgcaggtatacatgatctcctttttcgaactcaaggtcacgcctccgattgtcagcgtaatttttctgacggttctgcgctgtctttaaacgttctcggattagcttaacttgttcttctgctgacttgagtatgtcaggatcgaataccagcgcttcgcccacctcattccagcacaagggagtgcagcactttcttccgaacattgcctcatttggcgacatctgaatgttggcctgataactgttgttgtatgagaactcagtatacggcaaacaacgatcccaagtgccttcgaaatccagggcagacgcacgtagcatgtcttctaggatttggtttaccctttctgtctgaccatcggtctgcggatggtaggccgtactaaaatttagatcggttccgagggcttcgtgcaactgcttccagaaccttgagatgaactgagtgcctcggtctgacacaatattcttgggacagccaaatctacatacgacatgggtcatgtagagttctgctagtttctttccatcaaaggtggttttcactggcacgaaatgagctgatttcgtaagtcggtccacgattacccaaatggagtcgtacccgctaggggttcttggcaaaccggtgatgaaatccattccgatctcttcccatttccactcgggaatcggtaggggttgcagcagaccagctggcctctgatgttctgccttgactctttggcaaatgtcacacaaggctacgtattctgcgacatctcgcttcattccagcccaccagaagtatgccttgatatcttggtacatcttcgtacttcatggatgaatggagtaggcggactcatgagcttcctttaggatgagatctcttaactccttcttggccggtacacagatgcgtggaccgcaccaaactgtgccttgttcgtctatggagaaattggtgtctttcttctcctgtattctttttattaactcttttatcccttcgtcatctttctgagcttcccggatttgcgactctagggtaggctgtactgtcaagctggcagggacacctgactgtaccacggtcagccttaacttctccaattctctgcacaggcgatcttggttaggccgtatttgagctacattgcaataggccttgtgacttagcgcatcagcgaccacgttagctttaccggggtggtactggattccaagatcgtaattcttgattagttccagccatcttctctgcctcatatttaactcggtctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgccgggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgtagaccattgaaatttcttttccttctttaacagctcggtcataggtctggctagcttggagaatccttcaatgaatcttcgataatatccagctaagccaaggaagctgcgaatctctgacacattcttgggcgggttccaagcaagtacagcttcaaccttgctgggatctacttcgacaccgttggaggagatcacgtgtccaagaaatgctactcggtctaaccagaattcgcatttcgagaatttagcgaatagttgatgatctctgagcttttccattatcagcctcaggtgttcggcatgttcttcctcgttcttggagtatatcaggatgtcatcgatgaacaccatgacaaactggtccaagtaatccataaagattttgttcattaagttcatgaagaacgctggggcattggtgagtccaaaggacatcactgtgaactcatatagaccataacgcgttgagaaagcggtcttcgggatatcttcagatctgatttttagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaggatagaccgacttgcggtaggagtgttagaggtaaagcggacttgctttcctccaggtccttgcaaggtgatggacttttcggcacaatctatctgtcctttgtgcttagccaaccaatccatccctaggatgatgtctaagctttgtgagtctaggactatcggtttggataggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaggaatgggaagctcccgaatcaaacagaactattgcgggtacggagttgacagagaacatacccatcacaacgtctggagcatcctgagcggtctcagcttgaatgtggttcacccggcctcgaccaaagttgttggaagcacgtgaaccttgtccacttgcctgagagctaggacgagactgagctgccactggagtaggagtcctggcagtgctgccattagcatgccctgagttggtgttggtaggattctaagggcactgtctggcatagtgacccatctggttgcactggaaacactgaactgctgacggtccctgcggtgtcttgaaagaggtaacactgtttggcgcagtattgccactaggggcacgctgctgtggctgaggtgccggacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcatcaagtagaagtgccttgttgatcatatgttgaaaagtgggaaagtcatgagcgagcaactagagtctcattccaactgcgatccctttcaagaacttcctgatcttcttcttgtctgtgtccacttctgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaaaatcccctttccctccctctccctcttgggccggctcggcccatctccctccccctccctctcctctccccgcggcccatccggccttcccccgcgcgcgcgccgctgacgggcgggcccgcccgccaccctcgctgacgggtggggcccacccgtcatccccttcctcccgccgcctcgcccgcgccctagcgccgccgccgccgcgaatcccgccgcctcccgccgtccccgcgtgcaatcaataggggggaattattccccgtgattccctctccctttccccccacttttccctctctctctctcgcgttcaaacgggcggatttgcccccgcaaatctcgccggcgccattgatggcggccggacctcccgcgcctattccttccccgccggccgccctctcccccttccaaccctatataaaccctccccgcgcctcctccgtccgtttccgcctctcgccgcccttcctcctcgacggaatcgagctcgcgccgtcgctctctctctccgccgtcgccgtcgagctccggtccgccgtcgtcgtcaccccggaccatctcccaccccggcgtcgcctccttcggcttcaccgcatcctcggcgacctcgtccacccctccgtttcgctcgccgaccgccggaacgccgccgtccccatcgacccgagccgcgccgccgccttcctccactacggctgcctttccgtcgtcgccgtcgacctagggtgagccgtggaccgccgcttcttttcccccgtcccttcccctctctcggccgccgctccgccgtgcctatggccgctgccggcgaccataggggcgcgggcgcgtgtaacaccctgaaaattcgaccgacaaaaccaaaactctaaaaatacggattttcaaaaactttttaaactaattgcatcatgccaatcttattcgtctattttatctggagttgatctcgaagattattaatcgtgagtaaagaatagctaattagaaataaaccttaaaaacaaattggtaaaataaatataaattaaaaataaagattaggtgtggatagtaataaataaaatattatcgcgaccatgtttggatcaattaaatttcattgcgatggaataagaattaaccctaattaaagctcaaataaattatataaaaataaaatatgagtaatattaatctagggtgaattcattagttaagataacacgaatattgagtaaaatgcatatatgtaaaattaggaattgtggaatcaaatttagatggaaaatacactaaaatcgggataaataggaaaagtcactgttcattgcgcctaaggtgttcgatgtggtccctagccttccccctcctctcccacctctgcccctagccgccccgagaccgtccatcgcggcgccgctgccgcgccgcgtcgccgtcgcgtcaccgtcatcacgcgccgtgcgccatcgccgtcgccatcgttgccgtcggcctcgcgccccgtgccgccacctcgagccccgtgccgtgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttccccccttcctctcttgggccggctcggcccaactccccctctttgtctctcctcgccccccccgcggcc

SEQ ID NO: 75308 - DNA, 4778 bp, Oryza sativa
agcccatgacattattggaccttttcctgaaactatatacttctctgtttcttttttaactatagttgcttctcttaagcaaaagaaggaatatcataagatttaaactctgttgcaactcacgggcaccttactagtttctaggatatgttttgtgagttcctcttgtgttactatatggacagatgctactcactttgcaacaccctgactcccgggtgtgcctgtgccctggcccctggcatgtgtgcaaaattgcaggttacctgctgcctgtgctgcaaaatgactcgtaacgcaaaatataatgatcctagcaatatggaattcagtatagacacacatgaacaagtttggcaagtacacttgtttggatcagtcaaaatagcatccttgtttggatcaatcaaaatagcatccttgactcacaaaattcagcttgtagcaatttagttagtctactagttcttgccagaaattttctgacccccaaggaattgaattatttcccgagctaattcactagtaacagtcatattgacactttcccattttgttagctacccttccaggctaaagaacttgtaaaattggttgctgtggcttgtgcaactgaatatttatcactaaacatgtaaggaccatctggccatatggaagactgtctctgtttgtatgtctgcactctgcactctgctatctacttttttttattttttattttagagaagggtattttttacccggcctctacatccaaccagatatatacggccaactctgctatctacttagggacatctcaagcttgtagctgtagtcgtttaggataattggatgtgatatttatgatgaggttttcatcactagcatcttgatagagagcgcacaatgctcccagaacataatatgcatcttgtcctatttggacatgttttcgtgctgatatgaagtaacttattttgtcagctaactaaatgtttttcatcatgctctgttaataatgtactgtcatatgtattgcaattatggagccctgtatttgtataacaaaaactagaaagtagtcattgtccaaatcattttcagtacaatactctttgctctgctttctgcaattccagttgtatagttaaatcacaaaattaataagacacacaaacttttattcattacctcaaatacatacaacaacatgggatcgggacgggcaagggctaacatattacagcttattataaaagcatatagtttcatgaccggctgtacattattgtcacatcatatgattataaccagctagtatagcagcttatttatcatctggcgtatcgtacccaataggcttatttactatttcccttgttcctcacaaagtggctgcagactgcatcagcgagatctttaaaccggcaggtcggtattctcatcaaagggaaatggcgccaattttgggtgtgctgcttgtaagatctttccaattggcatttctggcatttgatcttgcaaaggctccaatgggtcaacatttgaattataatcctgaagcaacattcataattttatttaaaaaaacatctcagttgcaaacaatacatgaattctattttgcatgtttttggttttgtagggtggcactcaccaggttagcatgcatcctcttgacgaaagttttgaatgtgctgtagttctgtccctccagcagctcgtctgataatcggaggtaggtgaatccaaatagcttgtgctcaggaggtccattcttgttgatgcctgtcggccttgaattccttagtattgtgttgtaagctgttgcatcgtatcgaccgagtgcgttttcgcatgccacatgtaagccctctctccatccagcactcaggacctgccatttcatagttcatagccagaatattttgataagtgctcttgtgctattctagaagaagagcaatgcagaagttctaacttatagaccagtaagtactagtatgtaatagtccgttatttacctgttggactagttcttctggtgcactctttgcctctgagctttgttcagaatccctcatctcagcacatgtgaagttaacgcaggcacggtgccttgtgagcatgcgtgcgatggttctgtagccatctctgttgtccaagttgtagtatccagcagtgagctcagctgcatggtttggaaccctataccaccaatgaatgccggagatctgccagcaaacattggagcatgtgtcatttatgttctagattcaacaattaatggaacattatatatatatatctgttgcctattcatctagcctgtagtctaatttgaaatcattgaagtcttcaaaattatgtactataattcgccgagatctttagcatgatacttactttgattgccagctgcactctgcatcccaagaagaccttgtttgcttcatccaagatcttgtctccatgttttatcagcttgtttgagtaccatgtgaggaagaacttccccttctcagtgacatatgttccattatccgcgaagaaccgggtcttctcgggagtgtcattgtactctccagcatcgtcgggcaattcccattcaggatgcccagcctttgctgcttctgctttgaaatctgcctccaggtatttatcatagcactgcagtattttttttattgtaataactgttagagcagtgaattactaccatttgtcatgcattttgtcccatttcatatctgttcagcatatttagaatttgatttcctcttcttttgttgcttaatttcagtctcaggcttgcttctactgttttttttttttctgttagtactgtttttggtccaaacatctttgtgaaccagaaccactttaatatttgtgctcattttccaaagattttttttcctaaaggagatctgcaattggaccatgattgttgtctttggtcatcagccatcacatggaggagaatatttttatcaacaacttatttataaaatgagggcagccataagaatctttactctggtaaagactaaagaacactcactatgaattctcctatgcctgggaacacccatccctggctctgggggtaggaagggtatctcatctcaccagctggaccaagccccacctcaatgtccacaatgacaccagtatccaagaactctgccatgttctccctgaagctcttcatgtagtcagcatacatctgtcacagccacagacaagagaagaatgtaatacatataacgaaatcaaaacctcatttttatctcttttttttttctaaaattcatcggactccatatgtgcaggtggtggtggggcttgcttatcagctaaaacctggatggcagttcttccatggaagagaggctggtcatccactccaagggtgaggtactcgatgttcctcgccccaccacggttggtgtagaagatgtcggggtcgctcgcgccgacatcccgcacccactgcgggatcgggatgttgacgatgtcgccgacgttaccaccgcactggtggaacgacatgatggcctgcagcttcagcccggcctcctgcaccagcctgaacagctgcttgtaggcctcccagtcgtaggacccggggcccttcccctccaccagcccccaccacacgtccaccatgacgccatcgacgccggcctccgtcagcttcttcagctgtgcccgggtctcatcgaccttctcgaacttgttgtccacagtcaccacatccagctacatatctcgcaacagaattcaggtcagtgtaccacaaattcgctcttcttgagcttgttacagaaagtttgtgcctatgttaatgttaatgttgccagtgctgtgactaaaatttgattatccaaatagaactagagcttacggggagcatgacattgacttgaacatagttggctagcaagttcccggccattgtcgctggctgtgtatgctctgagaacactagcttcactgtcttgttgctcactgagctcggcttgatgaaatatagcaggacgctcatgggctatttatacttgcaaaaaggagaggggggctcttctccaccggcgggaaccaaccaatccttttcttccaggtacctacttcctctgagaaaattagagatggtgtactatgcccactatgaactgaatttggttaccgcccctgtcatcccaggcttcgatagttgatatcattcagcatttcagttgttgtgcacacattttgttcatcctcgagtaccatcgattcatgcttgcttgctgcagttcagcaggctcatggtatggtaccgctgtttttacctggttaaaagttttactatagctatgtacgtcagcttgcagtcatgcacggttctcatagggtggttaatttctactccctccatcccaaaatataaacacttttagaatagtacagagtcaaaatatttttaactttgactattaatagctaaaaaataaaaatatcaatgatgtaagaataatatgactagatttatcattaaacaaactatcataatatgtaactctttttatttaaaccatcttatttttgtaaatatttttagtcaaagtaatatctcaatgaccgtgtcaaagttcaaaaatacttatattttaggacagagtgagtagtatttactatcagctccatgaatttactattgctcagtactccctccgtttcacaatgtaagtcattctagcatttcccacatttatattgatgttaatgaatctagacgggctgcagga

SEQ ID NO: 75309 - DNA, 3185 bp, Oryza sativa
cggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaaataggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcgtaaggtgtacgataaagctcatttcacggtactacagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggg

SEQ ID NO: 75310 - DNA, 6965 bp, Oryza sativa
accgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagcgagagcttgagatttcaccctaagcccccggccgaactggcaaaggggggcctgcgcggtctcccggtgaggagccaccagctccgtcatctggcgcgccaggtagggggctcagcgtgtgctttctgagctctcagactcttccgtgtgccccaagtttttcttgttcagcctaatggccgagcaaggaaaaacacacgacctctcgccgagtgtgagcggcgacgacggggagccgaatccgcgccgtcgagctcgtactcctccacctcctccgcgccaaagccctaagcagggggaggcgcttgagagggtcgacaaatccgcggcgtcaccagccgcaggtgatgcaggagaacggcgagacggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgtatccctgcacacgcggtgatctacgcgttcagggggggtgtgcggcacaaccgcatgctcgaaaagatcgcttccaaagagccccagactactgcggagctttttcagctcgcggaccgagtggctcgtaaagaggaggcctggacctggaacccctccggttccggagtggcagcttcggccgcccccggatccgccgctcagacagggcggcgtgacaggaggaggaagaagaggtcagcccataccgacgacgagggtcatgtcctcgccgtcgagggcgctccgcgggccacccgaaaggggaggccagcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggttttgggctcgggccaaccccgcacccccccgggcgtgcagggttggccgggggcttatcttttttctcttccgtatttcaataaaagcgttttcgatttcctaaaggctgtgtctgtgcttttgtttccttttgaagaatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaaggggcccgaaggcctcggaagaagaaagaaaaagctattcaagattggcgggggcctgggggctcactccgacgcgcccgggtcaccagccttgtcgtcgttatcgtccgcaccaccgtcgccgccctcctcgtcggagtcgagggcgaacgcgagccgaggggccgtaccctcgaagctgtgaacgatgtggtcggcggcgtcccggacctgcgcgcgtgcgccgtcctcggttccgaaagggaactcttccagcgctgcccacggggagaagtcagggtccgagaggcccccaagccgaacggcggcccaaggcccccgacggccagagttggccctccgcctgcttgtccgacggtgtcaggcgcccccgaccctcaggatagcctcggggccactgcgggaaggccgcgcctgtcgccctcttaccccgaggatatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgccaaaacccgataccctcgggcccagaagatgctatacgctattctgatggctccgagaaaagcaccatcaccatatctccaggcgaagcaaatcggctcgcccagattcgtgcgctgctcaggtaatgtggcagtcttgaagagaccgcccattatggacagccaagtcaccattaccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgattctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgacctcacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgacgccggcctgcaccaccgccgccgcactcactctctcgaccgccgccatccatctccaccgccatctccaccgtcgccgtctcgacctctccgccgccatctccgccgccatccagaccctcctcgccgccgccctctctgccgccatctccgccctctccgccgccctcgccgcctccttctccaccgccgcctcctcactcactctctcgaccgccgccgtcctctccaccgacatctccaccgtcgccgcctcaacctctcctctgccctctccgccgccatctccgctgccctctctgccgccatctctgccgtcctctccaccgccctctccgccgccgcctccaccgccgccctcgccgccggtcgtcctctccgccgtccgtccatcgacttccccgacctccccgaccctgatctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaatttttaatgcattttgttttctataattctttgataattaaggacctttattaggtgtaggtttgaaatctagttacaagggaagaattgatagattggccg

SEQ ID NO: 75311 - DNA, 17059 bp, Oryza sativa
tttattaggtgtagggtttgaaatctagtcacaagggaaggattcatagattggccgcagatttaatgtagttccgaggttatcaaaccatcacagaatacaaagtgcatggggaatcttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgatcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttcctactctaatttcctgcacttgctcttttccttatggataagaaaagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttaggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaatacatagttgtgaagatgactcctcgtccaagtcgaccgacggagcttacacctcccaagtctaagctatcaattgaggctccccgtggactggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtaagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgcgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcacaggtaacttcacctgtgacggactcgcaaacgtcggaccgtcacaggtgacgcaccttgtgacggctgttacttccgggccgtcaccgaggggttcaccctggaacggctactatataccggggatatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgtactcccacgccccggggtacaacgtcgccaagtgcatggctcccaagctccatcccgcggagctcaccgagagcaagtgcggccggccgctcggcctccggttccacaacacctccggtaacttctacatcgccgacgcgtacaagggcctcatgcgtgtcggcccgcgcggcggggaggcaacggtgctcgccacggaggccgacggcgtgccgttcaagttcaccaacggtgtcgacgtcaaccaggtcaccggcgaggtctacttcacagacagcagcacgcgcttccagcgatcccagcacgagagggtcacggccaccggcgactccacgggccgcctgatgaagtacgatccgacgacgggctacctcgacgtgctccagtccggaatgacgtaccccaacggtctcgcgctcagcgccgatcggagtcacctcgtggtggcgctgacggggccatgcaagctggtgaggcactggatcgagggccccaaggccggtacgtcggagccgttcgccgagctgccgggctacccggacaacgtgaggcccgatgggaagggaggctactgggtggcgctgcaccgcgagaagaccgagacgccgtatggctcggacacccacctcctcgccgtaaggatcggtcgcaaggggaagatcttgcaggagttgagggggccgaagaacgtcaggccaacggaggtgattgagagaagcggcggcaagctttacctgggttcagttgaattaggtcatgtcgccgttgttaaggctacttgattagtttatatagttgcttttgttcagagtgtttattttgttttagatgtaagtattcaatttcggccgaactaccaatgtaataaatttgcacttcatctggatctcctgggaatataggagtatgttgtatattttgatttcatatagaactctagctacggatagtcacactttgctgtgcttgtttaagaatcatgatatttaggacgtgggcgtttttttatagtacattgaaatgctcgtatattcgtatgaccgtgaattgttaggtttaaatttctttcagtaatataagataacttctggctagaataagtactacttgtgatttatgtttcttgtaatgtagcgtacatcttagtgtaaaatcatacattagtagatctatatactagttctacaacctacgtcccaaataacttaatattttacccatctcacacataccaataatgatctctactattataaaaattgaagatgtttttaccgatattttggtacgtcatccgtgtattagtcggtttttaggttcgtttgcttttggaaatacatatccgtatttgagtcggtttttaacatcgttcacttttggtaatacaggtggaatcatataagaaatttgtttaaaaaaactcgcatgctaacttgagacgatcgaactcctaactgcagctcatgattatctaaaaatatatatatccaagcgaactccccgcagtgaatttcatcctaactaaaccatataacaataataagattaaaatagacttcacccgttgtaacacactagcattttttttctagtaataataataaaagaaatactcctaatctatcaaatcccaatgcaactattcctctttttatctactcctaatacaattattttttacttttataaactctgatataatgattcctccaaaaataaacttatttagggacaaaatggactgagctaaaaataaacttaatatgagacggaggaagtagttaacacttactaataatcatttaattgagaagaatataattaggctaatcttgtgataatgaccatataaacatacacatacacactcctattactatgagcacttccaagggacaatcgcacaccacatacctataaacacctcttgcttgacgagtaagttgctatcataaaagaacaattagaaataactacgagcacctatgctaagtttagaacatagggtaatgttgggagaacttttggaacgctcagcttttcttaaaatgaaaagctcctctaattaaacaatttagctttttattttgatttaaaaactataatagtagaattaaaaaaataaactagtaaccacaagtttatattctcactagctgaaatcacatgggctgtttgcctgtttctcatcatctgcctccccccaacccccccaaaaaaaaaataaatctaggggttatggtgcaccaaacaaattaaatgtaggagttatgatcaattcgcttgttgcacgagtaatgctggtatgcttagagtttatcacataagtgttctattctgacttgcatcctatttcgtcattgtaattttttgataggtgaatactctcaggtttcagcatcatagcttgttttgctgctacagctcatgcaatgattttaatgagttcagaatcggtacatgaattcacatgttttttttatgttttacccaaacgaaacggcatttatcgggggaagtatcagtactataaaaaacaatttggccgatacatacgttttatttatttttcaggtggacttaaaatattacttcttgttatcacttgtataaatagcgggaagcccgtagatttaaccccgcctctaaaaatcgatttttatgggcgggttaaaaagaccggcatacaaaatatgggggcactattaaatttgacacatagagagccaaagttttccatctctccttctcccttggctctctcaccacctactccacctccttcccacccgagcgagcagactctcccccatccccatctcctcccccaagtcctccctctcctggccttcctcctccgtacctacctatcacagccaacgctccgctcctgcccactgccgtcatcgaccacgcccgtagttggtgggccttaggagtcaaagggacatcaattgggcctgcaacgatgaccgtgaccaccaccacaacgacaatagtgatgacgactgtgaccacgatcgtgatgacagcgatgtgacctccacagcttgaatccgccgtcaccggcctcaggagcatcaggtttgcaaccatagggccttgggaatctagatccaccgccgccgagcttgacgcaggtggatctgccgtctttgggcctcgagcatgcagattcgccaccacaaggcctcgagaagctctcactcgtcgtcgtggaaagctctcggccatcctcattccgtggccgttgacatcatcgcggctggcctccgccatccttaccgacatcgatgatggtgcgctacttcgatttcttaccttagagactggctgaagaagcaggcactactacagaaagggccataggtgccggttgggaatcggctataggtgccggtttcccaaccgacacctattggtcggcaccaatagtagcaaccggcacctatgaagaaaataaaaccgacacctttagctttgctcaagccaaaaaaaaaaaagggaccggctcagctcgaattgagccaaactcaactgagcactgttactgcgtcatcgcccgagttgctccgaaatcaatttaaaatccccaaatccccaaatcatccacaaatcgctaccaaaatcaattgacatcacagaatgaacatactctaatccacaaatcgaccaaaacatctaaaataaatctacaagagacgagggaggagagccctcttcatgctccaccatccgcttcgtcgctggcgagcccctcttctgtcgccactcgttgcctcccctcccgccagatccggcggaggggagggtgccgccgccgcccgccgcctcccctctcgccagatccggtggaggggagagcgccgcctcccctcccgccggatcccgcggaggggagggtgctgcagccacccgtcggcgaggtgcgccgccgccgcccgtcacccgccgcctcccctcttgcgccgctgatccctcttccgagctgccgccgcgcgcgtgcgagagagagagagagagacggtgagagagatcgagagaaaggatagataaccgataaggataataaataaagggaggccaacgcttatagataaggccgacactatcggctcagtctcaataggtgcctttttaaaaaaaaaacgacacctataatatattaaatgtgctggttttttttaaaaaaatcgatatctataataaccggcacctatggttacttaaaggtgtcggttttaattgttccggcacctatattgccgatccgtatgagcttttttgtgctagtgaggagaggatgccgacgtagggatgccgatgctgatatcctcggctgaattttttttgtgaatttgacaaatcagtttcgaatttcaaatggtgaaattgcattatgaattttgcgaatcgggcgttatttggatctggactttgttttcttgcgccaaaaattgtttttaagtcacttaattatgcgctgatggggctcttagggtggcggcaaacaaaaatcatcgattttcacggaccttaaataacaagcaaagcgtttggtcacatgcaaaattatgttttgtcgtagtgagtgatacagtagtagagtcgtgggtgcacgactccatccaccgtgcggagttgaaaatcccaatgcccacgagtattacagactcatagatgctaattgttaggatgcatgagcatacgtgggtgttacacatgtagtggcgtgtgagtctaccatgtattccgaaagaaaacaatatttaccaaaaaatatttatttttgttttacatgttttcttgttgcacacaaaatacgggcgtaaaggttttgcgcgcgtataaaatttccacgatcccaggaaggcccttggagcacagaaaaaatacgggtgcggaagtttggcgagtgtataatgtttccaggtccaagcaagcacttagatcggctgaatttacgtggatgagctaattaggtccaggatattaaacgggttgattacgtcacccccataaaaatgccgattccgaatccgcagattaatggtctaattacgtcgaccgcattaatcttgctaactccgagtcggccggcttcagtgttcagttccatgacaccaatcggaatcggcgtccgaaactggacgtgatctgcagtggccacggctataaaggaacacaccctcgcagacgcagcaccaatgcaagaagcaaagaacatctgagatcagaagaactcgtgaaagcaaagaagacaatttcgatagtgagacgaagcaaagcaaggcgacgactttcattcatgggcgccgtcctcggcaccgggagggtggggactctgactcgggtggcgctgacgatcgtcgtcttcctgctgctcctgccatcgcacgccctcgccgcggccgtcgcgaaggacacctccgccacactggtcgagacgctgccgctgcccacgacgctggtcggcccggagagcgtcgcgttcgacaagttcggcgatggcccctacagcggcgtctccgacggccgcatcctccgttgggacggcgccgacgaaggttggacgacgtactcccactccccggggtacaacgtcgccaagtgcatggctcccaagctccatcccgccgagctcaccgagagcaagtgcggccggccgctcggcctccggttccacaacacctccggtaacctctacatcgccgacgcgtacaagggcctcatgcgtgtcggcccgcgcggcggggaggcaacggtgctcgccacggaggccgacggcgtgccgttcaagttcaccaatggtgtcgacgtcaaccaggtcaccggcgaggtctacttcaccgacagcagcacgcgcttccagcgatcccagcacgagatggtcacggccaccggcgactccacgggccgcctgatgaagtacgacgcgacgacgggctacctcgacgtgctccagtccggaatgacgtaccccaacggcctcgcccttagcgccgatcggagtcacctcgtggtggcgcttacggggccgtgcaagctggtgaggcactggatcgatggccccaaggccggtacgtcggagccattcgccgagctgccgggctacccggacaacgtgaggcccgacgggaagggaggctactgggtggcgctgcaccgtgagaagacggagtcgccgtacggctcggacacccacctcctcgccgtgaggatcggtcgcaaggggaagatcttgcaggagttgagggggccgaagaacgtcaggccaacggaggtgattgagagaggcggcggcaagctttacttgggttcagttgtgtggagattatgggtaccccatacccacacggcatagttatccgactagttataggggataacttatatatatggaatatgtataagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggtgcgtcgagtttcctgacgacgagtgcgatggaatcaactttatgagtcgccggcttcgtcttcgcttcgggagctccttgattcctcaccgccgacgacttcatcaagacgaatcgccactgctgtcctccgcctgatcttgttcgcatcagcacgacgacaacgacggttcgatggatttgatggtcgtcctcgtccaccaccaagcctactggtccaatctacccaacgaggatgccatggtgttgcaagatggatctacaaacacgaagcatgtcaaaactgatctaatcggatgcaataggagatggctgtagccacgcggatgccttcctgccgtcctgcgtcgtgctaatggacaccaaagccgtcggggccgcgcacgctgctacgccgcccgcgactgcgacctccgcctcctccgctccgacgactgcgtcgcctccctccccgccgtcctcccggagtcgtggatctgttccctctgccgcttcaacgtcggcgaggaccgcccgattttctatggcttctacatctactgctagacctgcgcaggggactgtgcccgcgccatcatcgatcgctaccatggcgcacaaaacgtcgtcatcaacaaggctttgatcgaatggcaacatggccgacaaatgagacgatggcacgtcaccagcatggacaggactatgcaacaggaccatgcagcaacacgcatcctcctcaagccacccattaatcacctcgcattgatatttgtacatttatctttaattaattccttgctgccgctgatcagattaattctttgattgattacatgtgctaccgagacgccgtggtggtcaggatgtcgccgtgctgcagaatgtcgacttgatttgtccacgagttggcagctcattgctgccgggcctctacgcctgtgtggctggctacatccgctgacactgtcgaccccttcaacaagttcacgatcggctgcctccacgccgccgagtccgagtaccacaggagcttggcccggctacgtccaaggcatgcacactcgagcccggggggctccgccatgcggacccggctgcgcctcaccgttggtcgctgctgatgggcgtctacgacctcaccctcggcctgcctccgtcgccgccgactggtgtctccgtctacacggctggcctattatgccgccattgttgggcgtctacaatctcacccttggcctgcctccgtcgccgccgactggtgtcctcgcctatacggttggttggtcacaccaccgttcatgggcgtccacgtcttcaccgaccggctggacttcgccgccgccgactggtgtttccgcctgcacggccggcctattatgccgccattgtcgggcgtccacgacctcacccttggcctgcctccgtcgccgccgacaggtgttttcatcgctattgagatggactgcttcgttcccacatcggctacttctgctgtcaccaagggaatacgataaagctaagtcatcatttattttattctttatatgatatttttccttttcctctgcctcactacaccaattggccttccattgagtagtgagtcgggggctacagatgttatatcatatttttcataacatttatcttgattgcttgcgacataatctgagtacaaaagtacctatcgagttatggagttctatcttcctatgctttccgtttggtttgccaatggatggttgcctttgggtcgattcctagcacccgggggttcgttggatggaccgagtaacgcaaggtgctaagtattattcggaataaatcaaaagcatagagatgagataaatttattttctgctcttaataattgcaaaagtacctaagtagtaaattctgatccgtgaaactttgttccgtgatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcacctatacggttggttggaaacaccaccgttgttgggcgtctacgtctttaccgactggccgcttcgtccaccgccgactggtgtcttcgcctatacggttggttggttacaccaccgttgttgggcgtctacgtcttcaccgaccggcttgccttcgtcgccgccgactggtgtctccgcctgcacggctggcctattatgccaccgttgttgggcgtctacgtcttcactgaccggccgcctcgtccgccgccgactggtgtttccgcctgcacggctggcctattatgccgccgttgttgggcgtctacgtcttcaccgaccggccgcctcgtccaccgccgactggtgtttccgcctgcatagctggcctgttatgacgccgactgatgctatcttcttcacggttggctacgtcgccgtcaccgctaatatgcgtcatcatcttcaccgaccggccgcctcgtccaccgccgactggtgtttccgcctgcatagctggcctgttatgacgccgactgatgctatcttcttcacggttggctacgtcgccgtcaccgctaatatgcgtcatcatcttcaacgcaagctgtctacgtctgccgccgactggcgcttttatcgtcacaattgcgcgtcttcactaccagtttgcttctgtcacttcatcacggcaatgcaactttgtcatcatggatttctacttggacatcttcaacacttattttcaatcaagcaatgactactcgacgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttacttcggagcagacaatctacttcaacaacatcaaatatttcggtttagacgagttggacaacagcatcaactctcctccaagtgaagcatctacaacagctataacattaatttgaaggattattgtcactgacatcatcaccagcacctttgcttcatcggccctgacatctccgctgttgctaatggatgattatgtcttcaccgacttattatttcaccttcacggttgacctactatgcaaatgctgatgagcgtctttgtcattatcattggttgctacactgctattgactggatcaccgacatcgttatcttcatcatgtcggttgcgtttgtcatcgtcaactattttcttcatcttcatgattgatggatttcgtcaccgcctttgatcttcattgttagttgatctgtctgtcgctgactggtttcttcgcctccatggctatgcgacttcagtaattttgattggtatcactatcttcactaccatcaatatttttgtcacctctgctgggcaatattatctctatattggtcgtcttgtctctatgccaactgcgtcagctaccatcaatagacaattgtgactacgacagaaggacaagctatatgctcagaggcttactagttcaaacacaagtattatgtctccaatttggacttgttccggatacatgcaacatgaatttatatcaaccgaatacttgcgccagtcgggattcaatttttatatctattttggagtatcccataagggataatcactcagatcacatggtctatatcacccgggagcatgttacatgcgtcatccttcaaagggtatcgaaggcatattttttggcctaggcctaatatgtctgcagcccatattttcaggtgtggcctgtcacgttcttttagggacttaggcactttttgcttaggccaaag

SEQ ID NO: 75312 - DNA, 41760 bp, Oryza sativa
actggtgcctccgcctacacggctggcctattatgccgccgctgttgggcgtatacgacctcaccgccggcctgcctccgtcgccgccgactggtgtcctcgcctatacggctggttggtcataccaccgttcatgggcgtccacgtcttcgccgaccggctggccttcgccgccgccgactggtgtttctgcctacacggctagcctattatgccgccactgttgggcgtctacgacttcaccgccggcctgccttcgtcgccgccgactggtgtcctcgcctatacggttgattggtcacaccaccgttcatgggcgtccacgtcttcaccgaccggcttgtcttcgccgccgccgattggtatctccgcctacagggctggcctattatgccgccattagtgggcatcttcgctttcaccgtcgacagccttcgtcgccgccgactggtgtcttcattattattaatggacgactttgttcccacattggccacctctgccatcaccgaggggaatattacaaagctaagtcatcatttattttattctttatatgatatttttgtcttttccttcgcctcactacatcaactggttcgccgttgactagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggactgagtaacgcaaggttctaagtattattcagaataaatcaaaagcatagagataagataaatttattttctgctctttacaatctgagtacaaaagtacctatcgagttatggagttctatcttcctatgctttccgtttggtttgccaatggatggttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattctgattcgtgaaactttattccattaatgacaaactcatgtcactcatatgtatgtttgggaagtgcctaggccgactcccgatgcttgggggctatgactagtcggacagagtgtttaaacgtacggagtcatctgcttagggaaatcaaaattgacaagaggagaaatacatatttataaatattttaaaatacttgattttttctcgagtattatatttatatcagatactactcatcctatatgtttgttctgcaggatccagatccagatatgcacaaaagggatacatggctttaagcttatctcttacgctccaggaatggatcagtcagaacatcaccaccggcttgccgtcatcgccgccgactggtgtcttcgcctatacggttgtttggtcacaccaccgttgttgggcgtctacgacttcaccgaccggccgcctcgtccgccgccgactggtgtttccgcctgcacggctggtctattatgccgccgttgttgggtgtctacgtcttcaccgaccggccgcctcgcccgccgccaactggtgtttccgcctgcacggctggcctattatgccgccgttgttgggcgtctacgtcttcaccgaccggccgcctcgcccgccgccgactggtgtttccgcctgcacggctggcctattatgccgccgttgttgggcgtctacgtcttcaccgaccggccgcctcgcccgccgccgactggtgtttccgcctgcacggctggcctattatgccgccgttgttgggcgtctacgtcttcaccgaccggccgcctcgtccgccaccgactagtgtcaccgcctgcacggctggcctgttatgacgccaactgatgctatcttcttcacggctggctacatcgccgtcaccgctaataggcatcatcatcttcgacgcaagctgtctacgtctactgctgactagtgccctcacctctacgtctggtttagacagctaccactactgatgaacatcatcgtcttccgtcgccgactggttatgctgtcgccgactggtgcttttatcttcacaactgcgcgtcttcaccaccggtttgcttctgttaccgccgacttgtgttcacttcattacagcaatacaactttgtcatcatggtggagcgacttcatctttattatcttcggcaccggcaaactctattggtgctacttcgcaagttttgctacttcaccaaccacgacgtctttgtgaacctcgacatctcggcatgcgatgccgtgttattttactacaacaagtggctcttcaatattcaggatttctacttggacatcttcaacacatatcttcaatcaagcaatgactattcgacgacaagaagctacagtctcgactctatgttcagttgtttcccaactaatcaaagagtcgggggctacacaaatacaaggctcaaaatttgacaaattttatgtcaagctaaagaaatcaattcatcaacccacgagtcaaatccaggagtcattatcttcatctttgcttcagaacagacattctacttcaacaacatcaaatattttgatttagacgagttggacaacagcatcaactctcctccaagtgaagcatctacaacagctataacattaatttgatggattattgtcactgacatcatcaccagcacctttgcttcatcggccctgacatctccgctgttgctaatggatgattatgtcttcaccgacttattatttcaccttcacggttgacctactatgcaaatgttgatgagcgtctttgtcattatcattggttgctacactgctattgactggatcaccgacatcgttatcttcatcatgtcggttgcgtttgtcgtcgtcaactattttcttcatcttcatgattgatggatttcgtcatcgcctttgatcttcattgttagttgatctgtctgtcgctgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactagggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaatgtgctgtttgggtttttaagcaattgattggatacaatatcattgcttttcgccacgtaagtgtgcatttttattgaccaatattatggcttaggctgattatatattgtggtcattttctaggcggttggtaaaacctttatgagtttatttactcggattttacaccacatatgccatatatttccgggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacatactcggcggattcaaatccccaaacaggagtagggtattacctctcattgagagggcctgaacctgtctaaatcatttgtctccgcatccatccacttttaggtttcgtgcgctacccccttttattattgccgaattcatgtttcgacactaccctaaccatattttttttcaaattagaatagtaaacgataatttcagataaaattaagaaacttgattgaatattactgaataaagatacatatatagcaaatataaatcggaatgaatacaaccacaaatatttatcgaaacatgaaaaccacttatactgtgcttccaaaatcaatatataaactagatcttttatcaaaagaatatgctaaatttatgctaaatataatatgttgttgtaaattaaactctttgtttttttagaaatttaaaagtatttagcattataattagagtaaatttcacaaaattacatgttttatagttcaagttgtagaaaactacacacattttgacacttggcacttaagtacatatattttgatagtttagtttcacaaaaccacactatcgatgaatggattcacccatgagataacgtggttgttccatcaaggatgagaacgtggcatcctattaatttcgtgcgatggctggcaataggatgccatgtcctcatcctaagtgaaacagtcacgttatctcgcgggtgaatccattcattgacagtgtggttttgtgaaactacactaccaaaatatatgtacttaagtgccaagtgtcaaagtgtgtgtggttttctgcaacttggactacaaaacgtgcagttttatgaaatttactcttataattatgaagttgtatccatattagaatctcaatttcaagtgttatgtgttttactctaaaattaataattaataaatgtaattgatatggaccatttttacaagaataagctattaaattaataaagaatcaatctatttaatacactattaaatatttagtatcaataatattaatatagtctatggtttggaacaagaaaaatgcttgtccggtggtatttcgtagaacaactaatgtttttagaaacacagtacaaacatagatgtttataacacacgcacactcaccccggtaaacaaacatcctgcctctatgagcatctccgaaagatttatctatcatatattgaaattgacgaaatcaccacgggtgtctcgttgtcgatgtgaagtacatcacctaatactaaagaataatttaccgtaaatgtgagcacccgtgtcaaatctacgacttgaacccaggtaagcaggttccaccacaaggaagctaatcagttcagttacgttcactttgacattaaaggtaggttgtagaactgataatctgtcaatggtgaaatatagattcttccaaaaaaatgatctatgctaaatggatggatttatttgaggcaaatgatttgttgctggcctcggtttcttcgagcatgtgttagtgacacactcccgcacggacgtgcttatgatgcgttatgcctgtatatgtggctttcacctaatgatgataaacaagcgcaatgataagctgaagcagtacataattatgccccctaccccgctaatggcatatatgtgctttccttcataactcagttaggtatcaagttcttcattctctactctgtcgtgccatgacttttgttgctttaatttctagcttgctataaattcctgcacctcagtcctgtcccaaccatcaaattcgtcttgatcaaactatcagagcacatatggcactcactcacctcctctgctccctcctccttgccaccgcattgctgctgctctccatctcccgtacaggtaaccatggcaaacgtagaaacgctttcgattattttggactagtagtattatttagatatgcttaagtatgtgcagctttgtaccaacagaaccggtgtttcttagctttccactgcactgtcagtggcagagcgaccgctcggctagcccgggcagtccggctcgccggcgaaaactccattaaattttaatattgatggataaatcaatgagaaaataacaaatactagttaggccctctttaattgaaagaaaattcataggaattttagaggattttattcttataggaatttttcctacaaagccttttgaatcaaagaaatgaaccctatgaaatcctatgaaattcctattaaatacctcttcccatacaagttttggaggaattttaataagagatagaacctcatggaagaaatcctttgagtctttatctctccttaaattcctgtgtttttcctgtggtccaatcaaacagtcattccgtttttcctgtgttttgcaatcctctgttttacactttcattcctgtcagaatcctatgtttttcttattcctccgttttttcatttctgtgattcaaaggggcacttatattgaagtttgcctgggctcaaaaatctatctttctgactccaccactgactgcagaggctggcgaggtgggcgtgtgctacgggagggacgcggacgatttgatggatccaccggccgtggtgaatcttctgaaggagaacggcatcacgaaggtgaggatctacgacgccgacccgacggtgctgagatcgctgtccaacacaggcatcaaggtgatggtggcactacccaacaaggaccttgcttctgcaggccacgatcagggaagtgcgctagactgggtgaaaacaaacattgttccgtactataaccagggcacacaaatcaatggtgtggctgtggggaatgaggtgttcaggcaagcacccaacttgacccctcagctgttaccggcgatgaagaatgtgcagacggcgctagcgagactgggccttgccgacatcataaaggtatcaacacccattaattttgatgcggtcaatgtgtcatggccatcatccaagggtgtgtttcaagacagcatcgcccagtcggtaatgagtcccatgatcgatttcttgcaacagaccaactcatatctcatggtcaatttctacccatatattgcctgggctaactctaaaggccagatctcccgcgattacgctacatttggccccaacgccggtgtagtcgatccgtggagccacatcacatactatagtctctttgatgcccagctcgatgctgtttactacgctataaatcaggtttctggtgatagtgtgagggcctcaatggcccaaacaagatgggggcacccgacaccaagggtgcccgtcaaatgttcggaatgtgggcatccctccggtggtcagttccgcaagttgaccacacaagctgatgccgaagtggatgtggctacaaaagctaacgcccaagcattcaacaatggtattatcagacgcgctctgtttggagcctctggtatgcctgatgtctctgtgtacatcttcgctcttttcaacgagaacaagaaggctggagcatctgtagaacgcaacttcggcctgttctaccctaacggtacaaaggtttacgaggttgattttcatggtggtggtatttgtcccaccaaggcgagctggtgcgtggcaaatttagctgtggggaattcccggctgcaggcggcgttggattgggcttgtagtaacggcgcagactgcagcgctatccaacagggcaaaccttgcttcgagccaaacacaatggttgcgcatgcgtctttcgcattcaatgactactaccagcggatgggccaagccaatgggacatgcgactttgctggcgctgcttatattgtcttccaaccatcagaaagttagttcctacgaccacatatttcttaaaatgcaattttgtttagttctcacaaccatttgataaatctgcctcactgtttatctactaaattgcaggcatttgcgacccaaatccaagttggtgtatcgcgaaccctgcagttggggacatgcggctacaggcagccctagattatgcatgcggcagctgtgcagactgcagcgccatccagcccggtgcacggtgtttcgagcctaacactaaggtggcgcacgcatcctacgcattcaacgactattaccagcgtgttggccgagtcagtggctcgtgtgacttcggtggtgctggttccattacctaccaggcaccaggtgagttcaagctcaacagatattctcatcttgtttgtttcagatattgctttcaaaaattattgcccatgcatttcttctcccatatataatttttcgaagcaaacatagctaattaattgatccatcttctttcgtggcttacaaccacgtgccattttaatctccattgtatgttttgttttgaaactaaatgccattaacaatgcgttcgaaaccttcaagtgctaataatgtacattttgcgtaaaaaaaatacacacttgtttttgtacactacgtgatgattcaactagttaaatggtgatcttaggtgtttgttgaattattttcagagattggaaactgcgtccttccgccaatgcttgaactggacaaagcgtactgaagaccgagggctaagctagctaccatcagttcgcgatagtggggatggatatcgaagaacaagtccacatcgtttggcaaaaataaaatgatatgtttgtagcagtttttccagtcgggtctattgaaataagtaaatataccgttcattcctgttggatgaaattcctcagttacataccctgagcaatttatcatgtatgtgcatatgatcagactcctaagcagaactgaaaacatgaagaagtatttatttatttatttttagagaggatcaatgcactctaccatttccataaccgctgcaaaggtttgaatttttttttaaaaaaggaaaactgcacgagattgtgtttttcattaaatatagaagtacaaaattacaaccccaaggaataaaggaaaatagaaagcactctatacacaatacatggttgggtacgtaagagctcgcgtaagcactttgcacctgccagcgcccacgtcctcgcttcctctttaatttaaaataaaagcatcgccaactgaaacatacccaattcttttcggcatcatatataggtgccatcctattccaccttctaaggcaattcgagcactagaggagaaaggaactagacatcacaactcctgaacatctggaacagtttaagaactcctgaaacacaaaacgaccaacttattattacagaaggttcaacaggcataagtgcaaagcctgaaccagctccaaatcaaaacaacaaaacagttaacagagaaaagtccccccaagacaatattgtggagaattatgggtaccacatactcacatggctaggctatccgactggttatagggaatagatcatgtatatagaatatatataaagactaggactcgggtataacatttacttgtctatcaaggaacggtttgtagtcctggtttgttaagtttgtagattaggtataggagatctaaactataagggatatggtctctatcttataagactactccttcgcctatataaggagggcatgacgcctctttgggggcagattcataaccagatcgttagatctatattacacctggtggattcaaatccctaaaccggagtagggtataacctctcatcgagagggcctgaacctgtctaaattcttgtctctgtatccatcaacttttagatcccgtgcgctaccctgtttatattactgaattctagtttcgacgagtattaaacttgctcaaacgataagttgtttggctctcccctgctaggcttgatgtagatagctactctctctatcatataaaaaaacctaagggattgttcagattgttatcatttcaaaggcataccattttttagagttgtcaaatatttgcatccatttagttttattttaccaaactctaataactacatataaatgctgtcaaaacttggcaatattgttaaattgttgaaattttgatattgtcaaaatttggtaagatttattttagctataatctgaacatgccttaagattggatggaacatatttaatgtgctaggatatagcacatccaattctagattggttttttttatgggacggaggcaggcgccttaggccatgcaatatatgatgcatgatgcaagtagaaaaaaaaatgttgaaagatgggacgaaccaactaattaattatagataagaatgctggatgtgaggagccttacacgccaccatcgaaagctccccatggttgaccacttgacctactaataaacttcgttctaattgcaggtgttggcgtgttgctgattgaacgagaggaaggcatcaatagcgtgggggtggtggagtcctctacatagtacctaaactctagcgaaagataatctactgtaagaattactgacaaaaagctgagtctggtaaagatagaattgctgatatatactccctccgtcccaaaatataagggattttgagttttgattgtaacgtttgaccactcgtcttattcaatttttttttgcaagtataaaaaacgaaaagttatgcttaaaatactgtagataataaagtaagtcacaaataaaataaataataatttcaaaaaaaattgaataagacgagtggtcaaacgctgcaaagaaaaacgcaaaatcccttatattatgggacgaagggagtagatgttttaacgtctatacctacacattatggccttgtttaattcccaaaaattttttttacctaaaaacatcacatcaaatctttgaacacatacataaagcattaaatatagataaataaaaagactaattgcatagtttgtatggaaatcgcgagacaaatcttttgagcctaattagttcatgattagccataagtgctatagtaacctatatgtgctaatgacggattaattaggcttaataaattgatatctcacggtttccacgcgagttatgaaattagttttttcattcgtatccgaaaacccctaccgacatccgatcaaacgtccaatgtgacacctacaaattttcttttcgcgaactaaacagtcctatatattaagagtgtaagatggacctttcccagctgatgtatatgttggtaaaaatagtccaacatatagttccacccactttttttttcaaattattgtgcataagtattacgcaaatatgggtatgattccaacaatattttaatgaggtccaagatttatcaccagtctttgtccgttttggcgtctgttaatgtacgtgggtgtgggattgtgtgtatgcatcttgtgtgtaaagaaaaaaattgagggcaaaagcaagtaatatgtggggttaagaaacaccaaaacaacttccaggctgttttatcaatagttgagataagagagtgatttatttactaggaccgttgaaattcgaacttgccaaaactttaaattttggtttagtctttttttttctaaaaatttatgttgagatgtatattagcacaaacccattataattttcttttgtttcgggtagcggcaggagggatatgctgcagaaggataaatataacatatacagagaccatgtttgtttcttttttttttcagaagttgccaaggtcatttcgaaaaaaaaaaggataaatccgccgaagcgatattgtgataggtggaaaggctgaaagctatgttgccgtcccctaatctgttgagagatgccaattagtctacgttgatcaccaatagtataagtggtcagtagattatactctctccatattttaatgtatgacgctgttgactttgtaaccaatatttgaccattcgtcttattcaaattttttatgcaaatacaaaaatacttatgtcatgcttaaagcacatttgatgataaatcaagtcacaataaaataaatgataattacataaattttttgaataagacgaaatgtcgaacgtttgttaaaaagtcaacgggggagtattagttgccatgtgttgggaaagcgatcaagaggaaataattcaaatggctgcccggttgagactcgacgaagtaggggaaggattttaggtgcataaatgtgagattgtgactctgaagacaccttagcatatcaacatctccactccatcactcttgaaaaagaaaaatgacaaataaatcaattaatcatgttgtgtttatccaccattgtcgactggaagtggttcctctgatgtaaagtcaaagggacatatatcactaacatatagtgcccatcctatcctagagtccatccttatgggcatatatatcaagagacataggttactctattgtaccgataaatatgtttgttaaccgttccaccaaagagtatccaatgcaataggagtagttgagatgctattgctgaagtatttatgctgcaacttagcttctgttttgtcggcacattagctgggtgttagtcaaagatgtagggtatatctcgaattaatacttttttagtcacgtttagtaccgaacgccatgaatcttttaagacttagccaattcgtcttccatctcctcagctttccaagttcttcgctttcctttgcaccattccgtattcaaagatccactgccctttctctttaactgacgggaagacacaaggaagccatcttgacagctctaagatcggacctgctggctgctgctgtgatttttgggtgagagcttgttgattcaaattggaattgttatgattcgagtaggaagttcatggttctaatacaaattttagatactcgagttccaagttagaggcttttgcatagaaacgtttggatattttagttcaaagttatgatttttgtgtgataagtttggggactcgaactgaaagttcaagacaacgagtagaaatattcgaggattttgagtcaaagtttcgatgtccagcttgaaaagtgtgtttttcttttctttcttgctccagatggaccagatgtagggatctccaaagaagcaatcagccctcttgatttacgctgcctcttgccacggtgtgcactgtgcagttgcagagtagagcatggcattcagtcacctcctccacgccctcctcgtggccgcggcgttgccgctgctccttctcccccgtgctgcaggtaacgtgcttctggctttcctgccaatgcagctgatcggcaacgccaaacgatggagtaattccttgctcgtcaatgcagatgctggcgagatcggggtgtgctacgggagggacgcgaacaacctgatcgacccaccggcggcggtgagccttctgaaggcgaacggcatctccgcggtgaggatcttcgacgcggaccagacggtgctggacgcgatggcgaacaccggcatcaaggtgatggtggcgatacccaacgccgatctggccgccgccggccaggatctgcgcagcgcgaccgactgggtgacgaacaacgtggtgccgtatcgcagccggggcacgctgatcaacggcgtcgccgtcgggaacgaggtgttcaggcagagacccgaactgaccgggatgctcgtctcggccatgcgaaacttgcacaaggcgctggagaacctgaacctggcgaacgacgtaaaggtgtccacgccgatcgccttcgatgcgctcaagcagtcgtcccctccatctgcgggggagtttaaagatgagatcgcgcaatcggtgatgaagcccatgattgacttcttgaaacagaccggctcgtacttcatggtcaatctctacccgtacttcgcatacgtggctcagcctgacaaaatctctctggagttcgcgacgttccgccctaacgctggtgtgcttgatggcaataccggcatcaggtacttcagcctctttgatgctcagctcgacgctgtttatgctgcgataaacagggtttctggtggtagcttaacggtctcaatggctcgacgagatggaatccttagtgtgcaagcttcagaatcagggcacccctctggaggtacatttcccctattttccatgctagctgcagccgatacggactcgatagccacgatagccgatgcccaagcgtacaacaatgggcttatcagacgtgtagtatccggagcctccggtatgcgtgacgtctccgcctacatcttctctcttttcaatgaaaacgagaagcctgggccagccatagagagaaactttggcttgttctacccaaatggtcagaaggtgtatgaggttgactttaggggcggtggcggtggcggagcttgccccacaaagacaagttggtgtgtggcaagaacagatgttgggagtgcagcattgcagtcagcattggactttgcgtgcggtaacggcgcggactgcagcgctatccggcagggcagtgtgtgtttcgaaccaaacaccttggttgcacacgcgtcgtacgcattcaacgactactaccaacgcaagggccaggccagcggcacttgcaacttctctggcgccgcttccatcgtattcaagccatcgccaagtaatgttttgctctcaatctttaagatcaatgaggctttcgcaaatgtgcattcatatcttgattccatctcattgtttatttgtcctgtgaattgtttcccgagatataggcatatgtgatccgaacccaagttggtgcgttgcgaaatcggaggtcggggacgcacaactacaaaatgcactagactatgcatgtggtagctgcgcggactgcagcgccattcaaccaggtgcacggtgctttgatcctgacactaaggtagcacacgcgacctatgcattcaacgatttttaccagaccaccggccgggctagtggatcgtgtgactttgccggtgctgcttctattgtcaaccagcaaccaagtgagttttctctcattttactgtgcatgatatatatgccctactgctactaatgtacatattccctaagaaaaattgcacacttctgtttcaagtagtaagtggttatcttattagtgcttgttcaataatttacagaaataggaaactgcgtgctcccaccaaacaatgctgggacagaacaaactgcaattgaagatcaatcgactgcaaacttaccagcaacagcttggcagtgaggatggattaaagaatcacttcatatttttctgcagagaaaaaaataatggtaccattaataattagttgggattgaagagacgaataaatgtaccgttcactcctgttgaatgaaaccctgctgttagtattcaaatgattgaaccaagggatgctctcctcaggcgactctgaggcgacctagctgcgccggcggccactccggcctcggcgtccacaccccgccgctgctggccacctcgaccgcagcggaaagctcctagcgccgacggcaagtctggcccctcgcagccactctcgtcgccgtgacatcgtcttcttgtcatccactatgccgaccaaccaaagagaacctcccaggcttcttcacaggtcacagctcccctcaccgcgcgtctccagcgacttcactcagcccccccatcgctctccctccccagccgcgcccgttccccccttttggctcgactcgccgctgccaccgccccccagatccagccgtgccatgtcgccagatgcagtttcggaggtccctgagaccccggatccgggggctgggacaccagatccgcgccgcctccaactgtttgccgatgtggtgaagcagcccgccttaaaaccccgtttgaaatcgcatttaacagtgcccgtcaagagcaactactacctcgccaaccagtctccaggccaagatcgacagcaagcatcctacgaagctacaaagcgagggagtacggcgaggagactctcccctgtccagtcgaccagcggcaccattaacactcgagacggaggttggacgccggtcagaaggcgcttctggtggaggcaaaaggaagctcttgctcccgagtcaaagagcaattcaaagcgacgcgacggccattcacttgactccaacaaccggccggcaccatccccctcgctctaagcttttcaagcaaaaactcagggccgttgtttcatttgccttgctcgcaatcaccgcgcagctcaatgcagagaccctgtgcgatgcttcaactgcgcacgctccgggcataaggcccgcaattgcagcgcgcgggtgcccacgctgcgttgcgccgtcacgcgacgctcgcctcttccatatccgccgtcgcacccgtcgcaacggccgtcgtgccccagttccagcttgcctttacgcccccctcgacaccactctaggccaccaacaccaccatgcaaccttcctccgcctccgcgccccaccaccaaagcagcaatggctctcctgggtgacccaagaacgcgccccctcgacgacgactgcatcatcctgtcttcgtttgttctccaggaagaacgtcgtgaatgggagaccacggcggcagtcacctgggcaatgcgagcaccagcggccatgacagccaaagacgtggagaacgccatcaaggaggagtttcgtcttcactctggcgacgttgaggtcacccaccaccaccccgaagcctacctcatcaagttctcccggcgcagccactgtgccgatgctctttggaagggcttcgtcaaacggcgagggattgaagtccacttcatcaagtggagatgtctaaaggacgcgatgggcgcggctctcatgtttcgtgtcaagctcttcctggacggcgtcccccgacatgcctggcagccggaaatcgtcgacaagatcgtcgcgcggcgttgcggtgtggagaaaatcgagactaacttggttcacccaagccacacgcgctacattagcttgtgggcttggacctccaacccgagcctcatcccttgacgtgtttggctcaccttcaccaggcgcacgcaggacgctgacgccgactcggtggtggtcacggagtcgccaccggaccactggcagtacggggccaagtacccggtgctcatctacgtcgaggagatccatgactacaccacggcaacgattgacctctccaaccctgacgcggcgtgtgagccgaccaagcgccagctgtcggcttggcaccttggcgtggttgatggcgagcagccgcccccacgcgccttcgatggaccgcaccctctgccgccgcgcactcaagacagggaggaagacgaacgccgcaatgatgaatgcggctgcgatcgcacgcgtggtgtcgaccgtgaccgcgagcgcggaaatagtcgccgaaatgaagggaggcggtacaatgacgaccacccggacgagctgcgaggccagggctggagacgccatgatcgcgatgacgaccgtgacggccgcgacggcggcgacacgcgtggtggcaacagttcaaggcgcgcggggctgaacggcgtgcgacaccgcacgtgctcgccaaggagaagggactccgtaggcgggaactgctatggcagacgacaccatgaaggggcacgcgatccggtggaagcagctgaacctctggcgccggtgtccgaggctaaacgtgctgaccgcgaggtaagtaagctgaaggttctttaccacttcaagttaacctcgttgcaatggaaggtgaaggcactcacagagaaaaatgtccgcgacatcaatgacatatcctttgactttgcctcactcttcggcaagctcaaactgggggcaggggggatgaaggctggtccaaagggcactctaccaagacggagcacaccattcctgcgagccgagctttttggcgcatcaagcaagctgcccagcggccgccgtccatccgtgaggtcgacgacgccctccgtcgatgggaagaaaatggggaagcggccctcgtcgttccatcaccgctggcatcacgaggtgcttctccaaccgtcgttggcgacaacttgccgctcacggtagacaaaggtgaattctccgatccggcttcggcatatttggctcttgtaaatgcagcggcacagggcgataaggaacatggagacatggttgcggctgcggtgcatggtgctgatgcggtgcacgatactgttgctgtggcacatgatgccgctgcggcgcgtgatgaagcggctgttgtggcagccgctgcagcactggcggatgatgtggaacgcggcacggcggcatgcggcactgcagtgcatgatgtggaacgcggcactgctgccgcgcacgacgtcgcggtggatgctgccgcggcgcacgacgtagcgatggaggctgccgcggcgcacgacgtcgctgtggcggacgacgacaccgcagacaaggagcaggatgaggcggctgcagcggcaacggcggttgctgttgcgcacgacgttgctatggtgcacgacgacaccacgtccaaggcgcaggttgaggtggctgcagcggcagctatggcgaccgctacggttcaggatgatgaggccgtcgcggacaagggagaggcgccggtggaggacgcagaggacgaagcggcaagtggcgacatgacaactatgccgcacgatagagtggccgtggtgacccgctctgctgttttgctgccgggcgacatggaccacgctgcgctagatgacatggctgtggtgattccccctgccgcgatgctactgcaagacggggagcaggctcctaccaccccaacatctccagttgtgccgtccacgccgaccatcagagctgctgtcgacggcgccatgagcgtgctgttcaagccattggaaccagcgcttctcaccattccactcgaagaacaacaggtgcaacagaatgaagtgcaggccgaggatggtgccaggcggagcgccagactcgccatgaaacctctcgccggcatcccgatggtcgtaaaggcacaaatcaatgtctgtcgccaaatgggtttccttccagtaggaggagtcctcactaaccaaacacttgctgactacaaggcgatgttcaacacgcccctaccgcaggatgcgatcgacgcactcaacaccctcttcaacctcaacaacgaacacatgcaagaaagagatgaagcgatggcagcctacttggggccggtggacgcagaggctgtcatgggtgaggtggtcagggcaacctagacccatgccaagaagcatggatcgtccgtcctgaagtgtcttttgtttccctcatgtgcgaaaactacaaatgcctaccgacgctggttaattctgcaaatgtcgtcttaatcccgaaaaaagaaggtgcagagtgcatcgcggactaccgaccgatcagcctcatccacggagtagtaaagctcatctctaagaccctggccaacaggctacagcctttcatgaactccgtcgtcagccatgctcagagtgctttcattaaaaagagaagcatccatgacaacttcatgtacgtccgtaacctggcgagaaaattccaccagacgagaaagcccagtctcctgctcaagctcgacattacaaaggcattcgacacagtccgttgggactacctacttgatcttatgcagcagaaaggcttccctacgagatggagagattggataacaaatattctcaggagttcttcttcgcgggtgcttctcaatggagcccctggccctcctataagacatgggcgtgggctcagacaaggcgatcctctatcccccctcctattcgtcttggccattgaccccctacaccttctcctcgaaaaagcgacaagcgaggggctgctaactaaactcaacggacgagctgcgcggctaagaacctccttatacgccgatgacgctgcgatcttcatctacccctcggtccaggacatgaccaacctcgcgcaaatcctgacccactttggtgagatcatgggtcttaacacaaacttggccaagagccaaattgtgccaattcgctgcgaaaacataaatttgcagaacatcaccgaaatcttcccagcacaagtcacccatttcccgatgaaatacttgggtctcccactcgctctctccaagctcaaaaaggtgcacgttcaaccccttcttgacaagtgtcgaaaaaaatggctccatggcaaggcaaacttttgaacgcagctggtcgcatggccctcacgaaatcagtgctgacagcccaaccaatctatcatatgacggcactaaagctaccggatggcactctggaagccatcgataaaaccagacgaaaattcctatgggctggaggagaagacatctcagggggaaaatgcaaggttaattgggaaagcatgtgtagacccaaagagttgggagggcttggcgtcctggacctcttcaagtttgcaagagcccttagactgcgatggctttggtttgaatggactgcgccagaaaggccttggacaggcaccattgtcccttgcgatcagctagacaaagacctcttcgcagcagcaaccactataactattggagatgggaggacggcgaacttctggcactcccactggattgaaggcaaatcgccaaaaagcatcgctccggcaattttcgccgcttcaaaaaggaagaacagaacagttcgagaagctctgacttccaattcctggatcagagacattaacctcctacatctcacatccggtgaccaccttcggcaatacattgagctgtggaccctcattcacaacagagccccctgggacaacagcgtgacaccatcacctggaaactaactctcatcggggagtacaccacgaaatcagcgtacagacttcagttcttgggggcagcaaaatcctttttcaacgagacgatctggaaatgttgggcgccgccaaaatgcaagttcttcgcatggttggttatgcaaaaccaggtgtggacggctgatcgactccaaaaacgaggctggagaaaccaacagtattgcccactttgccacactacattggaaacggcagtccatctcctcgctcactgcagattctcccaacgcatctggctggatatccaaagatggactggtcttaatctcaacattcacaactgggacagatgtgcctccgtggaggattggtggtatctactcatgcacagtcggcaaaatccgaccaaggccgtcaagaccctaatcatcctcatctcctgggaactatggtgcacgaatcttttgacacaatggcagcccgccaacggcggtggtcaacaaaataaaaggagaagtggctacgtgggtccttgcaggggcatctagtctgagtgcgtttactactctgggaggaatcccgtagagtcccccccctctatctgttgtagggccatgtaaatatcagtcatgtttttttactttcctgctctatcaatatatacgaggcaaagcttttgccttcttttcaaaaaaaaaaaaaccctgctgttgcacatttcagagaatgaaagaaatacatgtacgccacactcgtgcagcaatggaccgaaaacacacagctgccgcagcttgtcatcttataagctacaacctaaatttgagttttcagacaaaatttcgagttactctagatgtttttctttattcatcgcttcctgtttttaggccgttggcttgtaaaccgatgaaagtaggagtataaaagtctgctctaaaatcatttctggttattccgttcatttttctcagcttttaaacctacattgtctgcaattgagcggagctcgacatctacgaggacgatggcgcattgggaaccggatcctctgacttagagtaaccaaagtcagagggacatccaatgccgctgcaccgttcgttttccatcagacggacctgagcgattgcagcagaaagaccagctagatctcagcccacgtggctcacaagcaggcttgctctcgcctcttggccgcctcactcgccacagatgccgctgccggcggcagcctgcaccttccgaaggagagaattgtaaccaaggagccagttctcccccattgcaaactgctctagctctgctggtcaaccatgccaccttttaggtgaaaccccctccgcagctgtggaagaatttgttgtcgtgaaagatgtagcgagtgagcgagcgatccttgaacaccttaacaacaacaataataagcaaaatcgcaaatcgggatggcattgtataatcttactcaattcaaaattctaaattcatattgattgtacagaacagaagagcgagcaaacgtatatggactagcctaggacaaaatctgtatacatatgttcagcctcagtctcacatgttcaattcagtaacaccaacacattctaataccaagaacaggagcaggccagcagcctcaaatgtttagctttcttttgcatacatattgattggcatcaatttcacattctcatattcacacaatagtgagtctcaaattgacacaaatattcaatcatcatattcagtgttgaatcacaatctcaattcatatatcaatttagattctcaatctcatcttctcgagctgctgctgtaaccctcatctggaaggcagaggtggtcatgttagtgtcagcaacctgaagaacaccaagccagttgctgaacaactcagtcctcatgagaatgtaactctcgctcctaagcgttctagacttattaaccaaaggtatttggggccagattgggccgtgtaatgtgggcctcgtacctgttgattagctggcaatagttggtaagggagagagagagaggaatacaaatactgtaagacttgtaagatacaactatcctagagatcaatctatcggaggcgaattggcagcggcggcgatacggtctcgttgatcgtatcgaacaattcctctgtgttcttgtgttcttgcgtgaatagctcacagttagcctcctccagagactgcaacatcgcctccctcccgtagtgctgtggctcatggtagtgcactgctgtagatggggcctaagggcttgacaaggcggccgccagccatggggcaaggtgagaaaagagaggagaaaagaggcatcgtgaagtctttgagtgctcgactggtggttgtgcacatgtgggccgaactttgttgccgtgggccgagctgatcgagcccgttcgtttcggctgagctcgctagcttccatccgatgcggatcgagcggaccaatgcggcggatctagttccggcgcattggcgcaatgcgggcactgcgaaagatccagcgtccaccggccggcatgatctccgttgctcgggcctcaggtggccaggtgccactgccacagatcgcttagtcctcgtgacctcgcccatgtccgttggccatcggcagcgatcagcacatcatcatcgagaagacgagaacgccaaggccagactcaattgccacgaagatggactactccatggtgacatcgtggccgccggcgacggcagcttgcacggagaggaagagggtgagcaaggcggcgccgatggaggaggagggaggtggcggtggcgtgttcagcgagatgtgaggcaccatacgcgtgaaattgactgtagacgaagatgtgggtgtttggggattgatggacgatgggagtggaaaccattttaggctaaacccgttctaccatccagtgcaaatccatggatatatcgaacccattttgggccacaaaagttgcaaccaaatctaaatcacttgcatctctcaagtatgagtctaattcgattatcgtccctcaatcgcaaaaaaggaatatacaacatctctcaattactaatatcggttcattttgtgtctcaaaacagtttggatggtggtttagtccttcgtagttggttgcgggctcacatgttagttctgatgagaaagaaataatagagatggagctagccgaggcaagagtaggacgatgatggataagggatccttgcctgccctcattggcgcctagcgctggagctatgacgcgaggattctgctggcgtatgatgtggccaccatcgctgtccgtagaatccatcaaaccaccaaagcctcggtggcatcgcttcctaccatcctcctcccataggcatagcttcatatattttgatcgatctgtcggaattcatacggttctgagttattgtcttcttttgaggtttaattcaaaaaattgccaagaataggatcaacattttagcattgatattgagttattaaccacctgttcttggctggctgctaattcatcttgcaggtcgagttcagcgccaggcgattagcctgctaccgacacgacgtggcccatgacgatggtggccaagaaggggaggcgcatcacgggaggaatacggcgacacattggtcatggcggcccacctccgttgtcaccttaccgtggatgggatggcgaactcgccggctccctcccctctatcctctcctctcctatgctcacttccgttgtcaccttcccgtagatgggttggcaagctcgagctcgccgaccaccactaccgttgattcctcgtcaggagaaataggaaaagaggagagagacagagagggtagggaaggggatgacctatttcactgacagtggggtctatcatattttttagttcttttttgtttgaagtgccacatagacgctacatcaatccaagatctccgtgaatactgcatagggactcgatttacggtagtttcagaagataggaggtgctctatacccggctctactattaagggacgtgaataaaactcacgcataatgaagggaccaaaagtggaccttctccttttctcgtccactcaaacctcttcgatataatccacgtacaacctcagcccagtcaaattcatccaaagccaactcaaaaggagaatcaacacaaaaaagaataccattcccacccaacggacttgtaggcctagcagcagggcaagaggagggatccagtgtttgccacagcttgcggcctaggctgcgttttcactggttatccctgcgcatgcttcccaaactattaaacggtatgttttttaaaaaaaattatattagaaagttgctttaaaaattcatattaatcgatttttcaaacttaaaatacttaatactcaattaatcacacgctaatgattcaccttgatttacgtatcttttcaatcttctcttttcctctcaactcaaactcgatcactgtaatttagtgtgcaacaggatgcccattatatcatggagcggacgcccatttttatcttgggagctgcccgttaccacttttaccagataaacgacaggatcttgcaccttgatctggcctagttggcctatggcgaaattcctgcttcaccacctgcgttgtgagccgatagaactattatggctgactcccacggctcgccgtgggtaagcatgtacctcttccatattttttaaggagagtaaaatttcgcatactatagacctgttaggtttcttttgtacagcttcaaatccaagaccttttgaagctttgatctaactctatgattacattggtaatatttgaataaatcatttttttattaaattgatgatatttgaataaatcattttgtttcattttagatgaaattcaaaattttaaatcactataccttagcatacaaatttcaaatctatcgtgaatatgagatctgaaactgtgccgaacatgaccatcaaatatctatatgagaaagctcccacatctatcaaaagatctctgctagttgattagaaaaataatattattgtgactattagattatattaaaaatccaacatgggtcttggtttccttgtgtggttgaaatataatttcttattagaggaaccgtctcgtagacgacattattgtgacatactgctacggaatttgtggatgaatatatatgttaaatattatataaacaataaatgttaaaataatgcaaaaatgaagtgaggaaaataatttgacatacttatatgttgaggtctataatattatattctaggtgatatatcttacatgagatttaagatatataatagtaatttctagtagatgataatgtagcatacttgtacactgagttttaccttctaataattattaataggtaccatctatattgaagaagttttatttggtgtttcataaatattaatagtatacttgacttgtctaggctttttccacacgagggctgtggagtcttctgtaatattttccaagtcaagtcgttggctttgtccaaattaacgatggcctgcacgcagcacaagggtcaggacgacgatatagtatatcagacacaagtgggcacaagaggagcaggaggctaaataacagaggcacacatgcatgcatagctactagaatccatacgcgaccatcaatgttgtagagcgacaagttgtttggcgttctccccagctaggaatatatattgatacatataggccggtcaatatgcgtggaatgcatgtagaaaaatgttgaaaatcggtggacagaccaaaccgacaaataagttaggaatgcaggatgtgactgcccttgacaccccatcatcagaagctcctttgtttgacctattaaaccacatcaatctcaaacggtgttatcgtgtagcatgttataaacttcgtcttgctcttttctcattaagatttagattttatctcggcttgtattaacacgctattaaaactattaaccgatgtgttccgtgtaaaaactttctctatagaagttgctttaaaatatcaaatttatcaatttatcaagtttctaatagttcaaacataattaatcatgtgctaatggttttcttgatcattttatgtacgccaacttaatcttcatcttcatcagtttcgcctatggacgtgtcatgttatcttccaactgaaaatctataattaattgatcaatttaccattataaaaatatatgtggtgtagctgggagttagaacggtgatccatctagatgtaatggtccaaatcgatagtagagtgatccatatacaaatttttatgatgttaggcaacatacctaggccaagtctaattcccaactttttcttcaaacttttaacttttcatcacatcaaaactttcctacacacataaacctacaacttttttcttcaaacttttaattttagtctaacttctaattttggcgtggaactaaacacaaccctattatagttgaaacttgtgtcaaattttaggatgatccatggcccatggtgtcacctagatatctccgcctaaatatcgcagaaaaaaagcacgaaattaagaaaaggaaaaactaaaaagggtaatatatatatatatatatatatatatatacacacacacacacacacacataaaagggtgaagtgacatataccataggaaaaagtatgtaaatgttttttcttttctttttttttcattattaaaatgggggtttataagagaatctctaaatatataataaatgatgtgagtgtggagataatctttttgcatactgatatctcccctcggtcggcaggcttggtatcaatcttgggaggggaaaaatgacaaattatcagttcagttgtggctatcaccattgtctggcaatcatatatgttatccaaagagtattatacttcaatagttgagatgttatccaaagagtattattcttcgcgcctgctgctggcgcagccgcaacttggttctgttctgtcggcacatgacacgagctgagctagtgttcctgaaactgaaagatgtgagggtatatcatctcagaattctttcgactctgcattggtgtgatcttccattaattttacatcaagttttttttttctctattccagaacgtatggtaaaccctctttgcttgctataaattcccgtcatcgcgtccctgaatcctcgcattcaacgaacaacgactactcttgactccactcaggagcagagcatggcagtcaatcacaaactcagcgccctcctcgtggccacggcgttgccgctgctccttctctccactgcaggtaatacgacgatttggaaacaaattttagctatacttctggcttccggtgaatgcagatgggcagcaacttcagcgatgttgattttcttgctcgtcaatgcagatgcgggcgagattggggtgtgctacgggagggatgcgagcaatctgatcgatccgccggaagtggtgaagcttctgaacgcgaacagcatcacgatggtgaggatctatgacactgacccgacggtgctcaacgctctcgctaacacaggcatcaaggtgatggtgatgctacctaacaaggatcttgcttccgctggtgcggatgtggggagcgcaaccaactgggtgaagaacaacgtggtgccgtacctcaaccagggcacgctgatcaatggcgtggccgtgggaaacgaggtgttcaaacaacaacctgaactgactggtatgcttgtctcggccatgcaaaatgtgcaaatggcgttagcgaacctgaacctggcggatggcataaaggtgtcgacgccgattgcattcgatgcactcgatgtgtcgttcccgccatcagatgggaggttcaaggacagcatcgcgcagtcggtgatgaagcccatgatcgacttcttggtacggactggctcatacctcttggtaaatctttaccctatgtacgctgcggcggatccgtcgacccacatctctatcgagtacgcaacgttccgtcctaatagtggtgtgctcgacgaaaaaaccggcatcatgtatttcagcctctttgatgctgagctcgatgctgtttacgccgcaataagtaaagtttccggtggtagcttgagggcatcattggcccaaggagatcaaatgttagttcaagttgcagaaacagggcattcctctggaaatacatttggtgggccagtggtcgttgaagctgacgcggatttgaatgcaatagctacaatacccaatgccaaagcgtacaacaatggtcttatcagacgtgtgctctccggatccccaggtaagcacgacgtctctgcctacatcttctctcttttcaacgagaacttgaagcctgggccagccacggagggacactttggcctattctacccaaacggccagcaggtgtatgaggtcaactttcaaggtggtagaagtccctgtccaacgaatgcaagctggtgtgtggcgaacccgaatgttgataatgcggcattacagagagcgttggactgggcgtgcaataatggcgcagactgcagcgctatccagctgggcaaagcatgctatgagccgaacaccttagttgcacatgcatcttacgcattcaatgattactaccaacgcaagggccaggctagcggcacgtgcaacttcaatggtgtcgctttcatcgtctacaagccatcaccaagtaagtttttcaaatgtacattcatatatatatatatatatatatatatatatatatatatatatatatatatatatatatatatatatatatatattgcgatcatatcctcattatgtgtttattatttgaacttatttggcgagatataggcatctgcgatccgaacccaagttggtgcgttgcgaaagatagtgtcggggaagcacaactacagaatgcactagactacgcgtgcggtagttgtgccgactgcagcgccatacagcgcggtgcacagtgctttaatccggacaccaaagtggctcacgcaacctatgcattcaacgactattaccagacagccggtcgggccagtggctcgtgtgactttgccggtgccgcaaccattgtcacacaacaaccaagtgagttcattctcattttgtaatgtattagattggtacatttcataccactaaaaatgttcattaagaaaaaaatgcacacttttgtttcaagtagtaagtgattttttaaaggataaatagctatcttattggtgtctgttcaatttatgtacagagattggaaactgcctactcccaccaaacaacgcttgatcagaacaaactgtctaggaagaccaaaagctagcctagctagctaccaaaggcagtgaggatgggattaaagaataattccatattcttctacagagaaaataaggattaaactttttgtatttcccgttggaaattttaaataaataaatgtactgtttgctcctgttgaatgaaattccgcagttacttgtttcagaaaaaataaatgtacatcaaactccttcagcaacggaaaacacagcagtgcaaatgtactgatgtgtccaaggcgtttcccttcaacagtgttaagaaattagcaaaatttatcataggatacgcaaaaaaatgtaattggctgggtgacaccgtgaaacgtgacacggttgatggacactaaaaaaaacatgtaactggccgtaggacaccggtcacattattttattattttcggatcaaaagtggtgggatatttttctaaatgcccggattgaccttctctttccttcttttcccctccccactgacttcgtcgggaacgggcacagcggcctcagagacgcggcgaggtcgtcgcgacgtggtgcagcgacactggcggccagggcggtgtactagatcatgcggcggatcgaggccgaggagatccgcctcgacgccgcgacatggtggtgatgagcaccaagcaagagatcgaggagcagtgggggctctacgatgggttcgacctcaaggtggagtgcaagctctgcatccgtcacatctggtcgaaggtgaggagcgcagtgggggctcctgcacctgctcatcaaccccaacaaggccaagaagcctctccctcccatctggtcgaaggtgctcagtttcttcacgaacccgcacaagccgatgatcctggcgctgtcgcggcaagacccaaaaaagaacatcaccacgctgctcaaggcgtacggcgagaaccgccatctccgggagcgttccaggcgaaatcttggaaggggaaaagaatgaaagggaaggagaaaaataaggaaagggaaggggcaatctaatcatttagaaaaatatctcacctttttttatctgaaaataataaaataatgtgaccggtgtcctacggccaattacatgttttgttaagtgtccatgagccatgtcaagttttcgcggtgtctcccgccaattgcacgttttttgcgtgtcctgtgacaaattttgctgaagaaattaaggcttagttcgaatgtgcattatacttggagaaaatccaagaaatgctatagataagcgtacaattccaagaaatgccatcgacaagtgcgagttccatgaaataccatcgtacaagcgatttcgttcccgaaatatcatcgccgttaaggttccgccatccctcgctgttaagtacactgttcatcctataacacttaacggagggttaataaccaaaccgtaaaggcaatggcatttctgggacaaagtatcttgtatggttacatttcatggaacttacacttgtgaatggtatttcttggaattgtgtgcttgttattggcatttcctggattttctcttataatcgagcttttggtttgcactcaaaacgaggcaaccattaacatatgaaaattgagtattaattattaaaaaaataaaatttggtttatttaataaaatttgaggggctctgattatgggcgctcctacccaaccaatatagcttctagccgctacgagtctatgatctcaccgccattatctatttgcatgtctatgctatattatagtcaccatggttacattgtggtatccccatctctatttaagagagttgtcgggttacagagtccgactctaacttcatcccctaacacctattacaactctaagtccaaccgtaactaaatatgactagtatattgggcacattctaagaatagtgccaataacttgattgagcaaattttatatttaaaccgaacgtgccctggcgtgctaaagaatattcaacggttgaggcactgttgctgaggtaccaaatcattcttcgtggacagacactcgtgaggacaattaatggtataatattgcacacaattgttgcactaagccactaatgatgattggaaattaatctgttgagtcttccccttgacccgaggaaaaagatgcatggctgatgacctgttggcttgcgtaaaggcacgggcacgtaccgcacttccaactctagtggaaaatgatctgttgcgtcaattgttcacgccacgagttttacttatatgcatatacacgtatatttatccaacaatgtttttcaggtttatatatgtggtttaaattatatattttttctagaaaaaagaggaagaaaatgatacagtgcactactgcagtagaattggaaatattgttattagttagtattagttgtcacttgaccggtattcgggcttttccacacgagtaggcaagatgtggaaactagcaattaataatgacaagtttcttggtccaacaagtcgccgcgtgcatatataatttgtcccgagcgaggggaagtcctgcacgcagcaacgtgagggtcgatacaacgtacaagttggacaattaggagttcattaggactgggaaggtacaggagcacctatgtgcacatcaattttttttgaaacactgatgtgtggggccgaggggctcacttatgtgtgggcccgaggagctcacatgtcagtgaacagtactgcagactacctgcatcctgtgcacatccctcacttgtttgtttggtctgacggatcttctgattcttgcatgtgttgtttgctttgaatcgtggcttcctattgtccatatcacatcgagctaagactcctccagatctaagatttttgggcgtggtatccgtagcttcacaaatccatttattcgataacatttggataaattattttgttcttattttaaattaaattttaaattaccataatttaatatatacaaacatcaaatctatcaagaatcaaagatctggagctgtggtggctctttctgggagtccagtcatcacatgattctacatttatatcctagaaaaaaaataattttatagaatctttgaaataaatgattgatttgtaccgatttctttgaaattcatatatgaaatgggcaattcaagaaaaatattagaggaaattaagtattttcttcttcttatatcttgaatttatgtatttttcatgtgcgccaattaaaagcttgtcttgaaattttcttatgttttgatccaataagcatgatattacatccctacatttttttactattcatgtattttcacaattctacgtttcaaaggatcagatctatagagtctacctataccaagttggatgataacatataaaatcattcaaatttcccaccgtgcaatcaagaacgagcgactggggataaaaatcagatgcactgctcggcactagacgggtcgagtagtgcatctgtgacatccaaacaggaaacaggacgtgtgtgatttcctgataggcccatctgctcctacacttcactcctggcattctagctcattaattaagcagttctagccgattatggcctactcgatccttttgtcagaaaaaaatagtcaaacttttatgttgcaagtgcacgattacttaacaacctatctgcaactggtccgactcatcttcatcaatcgtcaccactggaacggcgcccagagggtggtgagcgaggcaggagatcgagcgagggggctaacctccatttggccttcctgtcgatcgatgatggtctcctcacctccaacgacgggaagaacgcagcatccgtaccgtgcaaaacgaatgcggcggcgacctgcttcgtgttccttagcgaatgcaatcggagtggcagcgtaaaagaaaaatgatacgatatctttgcgcaaattgtaacttactttttttaagggattaagattaatttaaactggaagaaagtcgtgtggattcactagattagcttgataaacatggtttgatttttctggttttcgtcttcagttttgtgggttttctttagttttcgtgttttttaaaaaaggttacgctttcgttagaaggttgtttggttctctacctaaccaaatcatcattagtaggaccaaatcaactgtcgatgcctgtccagacactattaaaaatgatttttcatggtgtcaatctataattttcgctggcggtcgtacgtgaaaaccacaagcaaaaccgtaactagggggtcgggggctacggaccgctagcgaaaaccgattttccctggcggccacgctaagaggtccgccataaaaataacactatttttcgaggcggatctcttatgtttccgccagcaaaaacacaattttcactagcgctaggtaaagaggaccgctaaaaaaaattttatgccaataaaatccaccgcccccatcgacaccaaactcgcctctcttctcccttggtctctccgcctctctcacttctccctcgatcggtctctccttctcccttctccaccaacgccggctgtcgtcaccaccaacgctgctggatgccatctcattcaccgccgccgcatcgggagcggatccggcgccgccgtgcctcaggaggatggatccgacgccgcctggcccaagagggtggatccgccgctgccaggcctcgggagcggcgcggggaaggggacggtagcggtggcagctgttctcggcggatccggcgcctcctccctccccaccggggccgtgaggcggcgatgacgagaggcgggcggcggcacggatctgacggggggaggatgcgggcggtggtggcggcgatggcgacgggaggtgtgtggctgggtcgcgggctaccgtcaggagagctttggcgcaaggctgggtatggatctgttctctccctccctccctcttcttgatcaggcggcagaagggaggtagccgctggtggcgacaacaacagagcggtggctgctcgaccattcccctcccctccctctcccagatctggctggaggggaggtggccggcaaagttcccctggcgagctcgtccatggcacacggcggctagggttcttggatttgaatttggggggaaaaatgcttgggagctaggattgctatatgtgaaattttttttgtgcatgttcttctagacgatgcagatgctttgatttgtatttcatgatatgtgtaaataatgtttgatttgtggaaatgatgatttgtatttcatgtttgaatttggtaatgagcagccatatgcatatgcatgtggttttgtgtcacatgaggttcatgtgtttgagaaattgcaaacaaaatgggatttagggtgggtgatattggggattggggatttgtgattggatctggattttcattttttttactccaaaaaatgttttcactggctggtatcttaatattgccattagcgaaatcctattttttatggcggctgtcttaacgtggccactagtgaaatcctattttcgctagtggctgtcttagcttggccgccagcgaaaatcaattttcgctggcggccgagtgcccgccagcacaaatgaataattttcactagcctttgatcactggcggtatagccggccactagcgaaaacctattttggccgacagtaaaaacagttttagaagtagtgagagcacccgataggttttacctgaagaaaagtagaagcactaacacggtgtcttgcaaggagaaatccagtgcccgtcggcaccaggcataaagcaaagacttacgcctagagcttccatagcctaccaaccacaacaaccactgcacacagccataacgagaggaggaaggcattatcattgcccaacaggtcacacatacccaaccccataaacgcacacccataaagcaaatgcgaacaccgtctcgaacgaatgcacatgagccaccactatcgtcagaaaccatgacgaaggagactagtgttatcgttgtctagctcgtcacccgacgcagcaattctgacttcacctcgtccccccaccataccatactatggatgtggccacactatagcgactcccgcaattagacgtcaatagctgccaaacaccaccaagaagctccgagctagccaagccctcctctccccaagagaatatcaaaggattggaacgggtcggcgacaggagctcctaaaggaaggaaggtacaactagctggagatggcttgacgtccaaccaacacactcctgagctgacgtctcaagccagcaccaaacaactatcaaacggccgaagccgaccagatccaaccacacctccatgtacaacttcaaccaactacgctgtcgttgccacccaaaaccaccaaacccaaaactccatttgatttgacctcaggaggccaaattgacaccactggcactccctcacctcgccattactcccagtcccacctaggggccttaggcttccaccttgtgaccaatcgtcagcctttctaccaccacgcgcatggctctagcttccatgggtagctttacgtgaacctgcgctcgctcagcctctacgtcggcgccacctacatcaaccggccacatgccaccagccactcccgtgctggcgcagctactacgccaccactgcctgcattggcgccacctgcgtcttcccactccaccgctatctggcccaccgcctaccgacgtcgatgtccaggcggtggaggggtggagcccaacagtctaggcgacaagcctgatcaccccccacaaggagttgggggccactcttccataagagaatttatgccattaattcaaagtttcaatcagccttgatttcgtttcaatcaatttttttttcggccgctggtgttgtaataggtgctcgactcgtctgggctatttcccacacgggtagacaaactgccaaaaatagcaattaatggtaaggttgtggaatcatctatagtagtcaagttgttggctttgtcccgaatcctgaggagggggtggggaagcaaccatacaagtggggagcaagaggcacacatgcatatgataactttttaagttaatgatgcatatataacttgctgtgttctttttctactttcctagctcatctctctcgttttccgtgcgcacgtttttcaaactgctaaacgatacattttttataaaaaaaaatctataagaaagttgcttttaaaaaaaccatattaatcttttcttaaaaattagtaaatacttaattaatcgtaagaaagtgtgtcgctctgttttatgtgcgtaggaggtaagtttccaacctcacctcttcatcgaagcattagagcaggtacaatagcagactataagccagctataaacatataccgaggagataaaagaatagagagataagcagcgggctatatgtttgtagctagctgcagcacgggctccaatacacagtgtgtgtatgatatgtgggatcagatactaataatgtagtatatatttatagataactattttataagtcggctattaaattgattatatatgatttgaagctaggttggctatactattaaacttgctcttagtaaagcgaccagtactagtactaattgcttgcaggttctgcccagcttggacaggccggtcaatgcgcatgcaatgcaaatgcttgtagaaaaatgttgaaagtttgtaaaaaaaatgttgaaaattgatggactgatcgaatccacgagggatgaatttggttggatggattagatcggaaatagcccattaagttttgcacgtgttaatttgtcttgtgttcaagagttcagatggaatggacaagggaaaaaaaaaaggctcccgtgaagacctctattaatgcttatattgtgggaatatagggaataattgatcagtgataattagtatgttttgtttttaagaaatgcttatattgtgggaatatagggaataattgatcagtgataattagtatgttttgtttttaagaacttcctatgttccaagttttttttggtttgcttaattcaaacttcttttaagttcgatgaaaataaataaatatactgcttgctcatctcagaatgctggcatgcgactcaccagtcaccacggtgcgcgtgagaccagagtatccagacacctcctccagtactgctctgtctcccatgcaggtaacctactgcagcagcacaaacatgtcagaacccaccaaaatatgtttttcctgtttgtattccgtctatatcaaaataacttttatctattttcttactcattcgttaaagactttattttaagcaattaatgcattgagatctgataaagtcaagacaaatgccttgagacttgataaagttaaaataaatgcattcaaacttgataaatatgagaagaaatgcatcaagatttgataacgtaaggaacattctactcttagaatttgtatttgtatgtataacataggtaaaagataaaattattttccccgcaaaaaaaagataaaattattttgtgatagagatagcattccctctacttgataatatttatcgttttggacaagattattgtcaaactttaaacactttgactataaataacatctaaaatatttgtcttagaaaatatgaagactatatatatatatatatattagtcttaaaaaatacttcaataaaatgatatatttattaatatttctatatatatacatattaaaaaatagtgatcaaagttggtttttttttggagatcatatccttgtccaaacatcgataaatacaatattatcagcccggacagagtagttgcttaaatctctctgtaaggggccgaagctatgcttatatgtgtttttaagaaaatgtgtcaaccttgacaaacacttaagtatgaagctaatgcagctgagcggcaaactatttcttacttctcattgcaggtgcgggcgaggttggggtgtgctacaggagggacatgaacaatttgattgaaccactggccgtggtgaatcttctcaacgcaaacgacatcacaatggtgaggatcgatctacggcaccaactcgatggtgttgaatgcattttccaatacaagcatcaaagtcatggtagcaatacccaacaatgatctggcttctgttggccaagatctgggtagctcgacaaacttggtaaagaacaatgtggtgctgtacctcaaccagggcacactgatcaatggtgtggccatggggaatgaggtgttcatccaacaaccaaacttgactgggatgcttgtgccagccatgcaaaatgtgcagatggcattggtgaacctgaacctggcaaaagacatacatgtgtccacactgattgcgttcaatgcactcgatgtgtcgtttccgccatctgatgggagattttaaaactaacattgtgcaatcggtgatgaagaccatgatcgacttcttgatacaaaccggttcatacctacctcttggtcaatctctttcctttctacgctgcagcagatccatctagcatctctattgagtacgcgacgttccatgacaatggtggtgtgcttgacaaaaatacctacaagacgtacttcaacctctttgacaccgacctcgacattgtttacgccgcgataaacaaagtttctggtgtgtctgtcctcgatgtgaaagctacggaatcgaggtacccctggggtatgaagatacccccgttagccgatgcaaacgttgactcattggcaaagatagccaacgcccaggcgtaaaataatggccttgttaaacgtgtaatgtcgagtgcccctggtatgcatgatgtatctatttacatcctctctcttttcaacgagaacttgaagaaagggtcagacacaaagggcaacttcagcctattctatccaaatgggatgaagatgtacaacgtcgacttcgatggtggcaattcctgtcccacgaaggcgagttggtgtgtggccaaagcaggtgttgggcacatggtgttgtaggcggcattagactatgcatgtagtaagggtgcggattgcagcactatccaggtgggcaaaacatgttaccagccaaacacattggtcgcacatgcgtcttatgcattcaacgactactaccagcgcaagggccaagctaatcgtacttgttacttcgaaagcaccgctttgattgtccacaagccatcatcgagtaattttccactcccaatctttaagatcaatgaggtttttggaattttgtatcatcatcgtgattacatccaactgcatatttttttatggattgtttgctgagatatatgtaggcatatgtgacccaaacctgagttggtgcattgcgaaaccagaggttggggacacgcggctgcaaaaaacactagactatgcatgtagtacctacgtggattgcagcactatccaacatggtggacagtgttttgatcctgacaccaaggcggcgcctcgacctatgcattcaatgactattaccagacagttggtcgagagagtggttcatgtgattttagtggcaccgtgtagcgcccattccgtcgtggcgcctagcgggaaaattatctcttaaaaaccctaattgcgaaatttgtttctttgcttgttgtctagtgcccgtgccatctcaagatctcaaatccccgatctatcgtcgagttcaattccgaatccaaacccttccaaatcaaattcctccgcaaaagtctagtttgcctcccccggggtcgatgggccgaatttct

SEQ ID NO: 75313 - DNA, 40261 bp, Oryza sativa
taaatttattctataaatcctaatttttgcacaaattaagtttactcaatatttgtgttatttcaaccaatggattcaccctggattaatattacccatattttatttttatataatttatttgaattttaattagggctaattcttattccatcgcacttaaatttaattattaccaatatggtcgcggtaatattctatttatttctatctcgcctaatctttattttaaattatatttcaattatttattttgccaatttatttttagggtttattcctaattgattattctttactcacgatcaatgaactccgaaatcaaatccaaataaaataggcgaataaaaccggcatgatgcaatttatttaaaaagtttttaaagatccgtatttttagggtttcgattttgtcggtcgaattttcagggtgttacagttactctatatttatcagaatcacacaagtacaatatttgggattgtctatctagccgtcgtcgatatggtggcacgaacaccaacacgtagtcgacgacggggtagtcttcctccttgaatataaactcgtcacgatgagagattgcactagatccctcttgttggtcttcacaggcaccagattggatctgtctaggctaatctctgatgtcgatatctggctttgtcttggcttgtgttggtctcctcccccttctttagggggtcttgtatttatacccatagatgtcccattgtccaaacataactacaaataccaatatggatacaatttgagtagtccatatagttttcatatagaactctacttgtccttacttatctggaactccttctatatacgagtaataattccatataagactgtatataatgggccccgccgagtttagtcgattactattgggtatgtggtatccataaccatgatatatacactgtttaacaaaatgaatagaccactaaaaaagttatagaagtaatttgcgaggactgtaaataaaataaaaaaatttgctccatgacactttgaggcatttgctctataaaacctactttttacagctttaccctaagatactctggttatacggttatctgtcaaaagacactccgataattaatttatatagagagataaaatcttttaaaaaaggttttacctttggacaacttgcaagctttaaatttcaaaattttggctgactttaaacattttatgcaaattaaaaattttcccaaataccggaaataaaaaacagttatttaaatccagaaaatattggtataaattttattttatctttttttttttgcaattgtcatttagacaatttgggacaacttttgaatttgcaaaaaaatttaaatattagctattatttgtttgaattcaattcatacgaatagtcaatctttttttcaaagttatatatgtctctattggaagatggtattggaatagggtctctttttttttaaacaatagcgtgcttgacaatacaccacaaccgaataatgttatagcaaataccatgaatctagagtatcctgaagtcaagagacctcaatcgtggttcctctcgtgcgtaaactctgctaatcccataggatcaatagccttgataaggacagattgagcatatataaggctatgtttagctcttagggttgggcattaatcccttgtacatgtaaaataaagcgacttgaacaacttttttatagaaaaaaaattgtaaaatacacaccgtttaacagtttataaaacgtgcttgcgggagagtggaggttacgaaaaataagaaacacacacagcctaatacatcatttaataataggcaacaactaggagctacaaatatcatgctcccttcagcttttaatatttgacgtagttgacttttgaatgtacctttaactattcatgtaatcgtgttatttaataattttgtgcaaatatgtaaaaatacgagtcatacttaaaagtacatttagtgaaaaaacaaatcacaacgaaaataatattacacatatattttaaaatttaatgacgttaaatattaaacataagagggagtactatatactccctccttatttcttattttaatgtatgacgacgttgactttttaaccaacgtttaaccattcgtcttattcaattttttttgtgcaaatataaaaatacttatgtcatacttaaaaaatatttgatgataaatgaagtcacaataaaataaatgataattacataaattttttgaataagacgaaaggtcaaacgtttatcaaaaagtcaacagcgtcatacattaaaatacggacggagtattatgtagtgtgtgcaaggcacatttctttacgtagaaacaaatcttgtttttcttatttcactcatcatcaatgtcaggcaaaattcacccccattatttacctttgtacatggcctaatacgattgttttgaatcgaaagaggttcaaataattacacttgactaaatgctagtagtagctatcatgttgatccagggatcgtggcttggggtggtttccatgagaatactctcgaccaacttgcattattcctcctttttcctctttcagacgattcagacaatgaaacggacgctacctacgggctatggcagcattgcatgcatgttgccaacttgccaaggaggcttgtactacttccgcagtatcttatcctaaaatgagttacttttttacctaccatattttctcaactaatcattaatattcttcaattaatttattcaacaatttttttctcaatcaaccataatctttccttcaattatttatacctatttccttaaaatttatgttcatattaaaaatacttacaattttgaaggaggaagcatccttttttagcccgattcccgaagctagctaccgtgttaattcgagctactccactatttagagcaggcacaataatagactataaatcagttataaacatattttaaagagataaaaaaaagagaaaagagcagcagactatagatatgtaaccagctgcagcacggattccaagacgtaatgtgtatatgccagttgggattatgtattaatagtgtagtaaacaattattatatgaattggctattatattggctatagatgatttagagctagtagttagctatactattaaacttatactattaaacttgctcttagcttcattccatcccactgcccccaaactgctgcatctacggcaaaaaatgctgcgacgctctttggtcgcccatgccgttctcctcttcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgtcggcccggacgccgtctacggcctcctgctctgccgcggcgacatgaacccctccgactgcttcgactgcggcaccaacgtctggagggacgcggggccaacctgcaaccgcaccaaggacgccatcctcgtctacaaccaatgctacgcccagttctccgacaggggcgacttcctcgccgccaccaacaactccggcgaggtgagcctcctcataagcggcaccaacatcaccagcaccgacgtcgccggctacgaccgcgcggtcaccgagctcctcaacgccaccgtgcggtacgcggtggagaactccacgaagctgttcgccacgggccagcgggtggggaacgacacggggttcagcaacatctactccatggcgcagtgctcgccggacctgtcgccggcgcagtgccggagctgcctcgacggcctcgtgggccagtggtggaagacgttcccgctcaacgggaagggggcgagggtcgccggcccgcgctgctacctgaggtccgagctgggccccttctacaccggtaatccgatggtgcggttgccggtcaaggccgacgagctcacgcaggtaagaataattcaggaagcaaaattctagtaattatcttgccgatagtgtcagttgcaatcatcatagctgtaatttccctctgtatctggaatgcacgtaagaagagaagattggcaaaagcagagcgtcaccccggaagtgagtcctctgcacacaattaggcataaattcttgttaaacattcttataccacgagcatccattaacagtttagtcaaaattatgcaaacttgccagctgatacaaatgaggactttgaaagtgtcaagtcaaccctgttatctctggcatcactgcaagtggcaacggataacttccacgaaagcaataagattggtgaggggggattcggtgccgtttataaggtatggcatgagtactcttaactttttaacttttgtatcattgttgatttctttgagaaaaagttgtgtgatttgatggtgtgaacccagaatatggtcaaaaatataaattctagatggctagaagtacgattgcactactgctcaattgttaattaatcacaaattgtggtgtacttctcttcttgaagtatatcgcagaggtttggtgcactactgctccagcccttggttttagataaaaaaaaaatgtgacgtcccagaataattagaggaaataataataaagcaggacgagaccttagtccttgggcctccagcagtagtagagcaattggcccggttgaccttgggccttcttgacccccaggacgagcagcggcagttgggctaggcaagctagctagctagctggcagatcacacgcagcagcaagccagcaacagcacatcagaaatgttccatatgctgccaaataggattaaatgatcagccaccctaaatctaaatcaaaagacaacatccacgcaaactccaagtaaaacgtgagagtattatagatattactatttgaacattatatgtgatatagtggatatgttgccaataaaagacataaataaaattagaagtagtagtcacatctattataacacttgctcttagtttcaacttaggagtttaagctgatccatgactataatattggtttaaacttattgcgtgaagcgagaacgtaaaacatgatagtgttacagtgtagggtgtattccatttagatgagtcgggtctaaaatcgtttttatctagtcgggcctagaattattttgggctataagcgttatatagtaaaatatatgcatgtgtgtagtctaactaaataagttgagcctagctataaccttttttttttcataatggacgttacaaaaagcaagaaaatatgaatgtctggttgttaaacttattaaaaagtcatctgagtccataaaattacaaaatacacatctctatccataactcttggtttaacgtatcacatgggttccaaagcgcacctataaatatttaagaccaaatttggtcaaaatttcaaattttgtatcatcaataattccttaaatgattaattagtttaaaggattggtatatattgatttgccttaaaattactactctcgtgatattataaatttactagtactaatataaaataaatggtccaaaatacaaaagttgatcgaaacttatcctaaatatcaaatatttatatccaggaggagtaagatactaagccaagtagttaaattattcagggaattcttcatggacaagaagtggctgtgaagaggatggccaagggctccaaccaggggctggaagagctgaaaaacgagctagttcttgtcgccaaacttcatcacagaaatcttgttcgtcttgttggtttttgccttgacgagggggagagattactcatctatgagtacatgtccaataaaagcctagacacctttctttttggtactattagcattaccctttttaacctacatattttgtcttttcactccatcaataacaatttttttcttttggtaattagatgcagagcaaaagagaaaactagactgggcggtaagatttaagataatagaaggcattgcccgggggctacaatatcttcatcaggactcccaaaagaagatcgtccaccgtgatatgaaggcgagcaacattttactagacgcagacatgaaccccaagattggggactttggccttgctaggctctttgggcaggatcagactcgagaagtcacaagccgtatcgccgggacattgtaattaagtcgaaggaacactcattatttttcgctcatatatagataacaaactaaaatgcaattcttctttgatgcagcggttacatgcctcctgagtacgtgctgcgcggacagtactctacgaaatcagacgtgttcagctttggcattcttgtcatagagatcgtgacaggccggagaaggaatagcgggccatatttgtctgagcagaacgatgaagatatattgagcatagtgagcatccctactaattcattgaggaatacatgcctattgtaattactgctgactaaacacatatgtgtgactaatgttgctaggtacggaggcactgggaagagggagcaattgcagagatgattgatcattccttaggaagaaactacagtgagaccgaggtgctgaaatgtgtcaatattggactcttgtgcgtccagcaaaaccctgtagatcgacctacaatggcggatgtcatgattttactcaatagtgacactacttgcactatgccagctcttgcacctaggccagcatatttgatcgatgggacctctggttactcccagaccgtaacacaatggtccggcaggtagcagggggccgaagcagatctagcaccgttgttggcttgttgctgcttgctttgttttatattgtaagtgtatcagttctcaatttgtattccatgataaccaagttcaactaataaagagtaaatatataccattgaccagtttgtctcgctcaatgtttatcatcgagtttgtgtccatccatgacatattccaattacatgctactagttattactccctccattcctaaatgtttgacgccgttgacttttttaaacatatttgaccgttcgtcttatttaaaaaaattaagtaattattaattctttttatatcatttgattcattgttaaatatatttttatgtatacatatagttttacatatttcacaaaagtttttaaataagacgaatggtcaaacatgtttaaaaaagtcaacggtgtcaaacatttagggaagtagggagtacaatataattacgttatactccttataaaatatagtagtggtggtgatgattttgtcaccacctacttttgcgggaagaaaaaaaaaagtggagctaagagcatcactaatagaatgtgtaaattcaatcttcaaaattctgaatttgggaatcctaaatgaaatttgataagttacagaagtgatccttccaatagattgtgtaaaattgactctctaaaatagaaaagtggaccgcatagtaaactatcaactaaaaaaaatcagttatatattcctcctccttccgcgacggcgaaggcaccatcacatcgattgttgtttacaaatacacgagtaatccaggtcgagcatgtttaactcaaaagaatcagttaattacgcacatcaatttacggagagatgggcatgatcatcagatcatggaggaagaaagaagtctagactctacgacgcaacgacgtgttcgtcgaggcccccgatctgtttctctcatacacgatcgggtgctacttcggcgcctcgatcaccttgattaattgtgcgctagctgccgcttcgcgtcctctgcttcttgatacacttcgcggagcttgcgctttgcagcgatcatggccttctcgtcggtactgcacgacgacgtggcactctcgcggcggctcatgttggccgtcctcttgggcggcgatggctgcaggattttggcgtgatggtcgtcggtctcatcgggttccagcacctgagagagcttctccatgacggctgcagacttgaggagctcgtccttcacggatgccctccacccacggacaaaaacatttcgcccctcgcccgggaacgggaggagagaggcgggagcgtgagattgggagtggtagaggcgagatcgtgcgccctcatatcaaccgagctaggatttgggagatggaactccagaactggatttttcaccttttagttcttttgaaaaaaaacttattctacaaataaatccttaaaataacttattttagaaatggtgcttttcgcggcgccaatgtagttggtgccgtggtccaacatgacagcaccaaggacgttggcgccgtcctctccaccctcgggtgaaagctaagtcactaatgtgaaggagaacggcaccaccaacattggtgtcgaggaaatttgcaaaaaagaaaagaaaagaaaaaggacctagttgtaataaaaagtgactcatttgtaaataaaaagaactcggaaacttcggcaggagagtagcggatccgttggagctgtgttttggactaaaatctctcaaattcaattttcgaaatgaaatactctctccgtcccataatataagggattttgactttttgcttgcattgtttaaccattcgtcttattcaaaaaattttagaattattatttattttatttgtgatttactttattatccaaagtactttaagcataactttttgttttttatatttacacaaattttttgaataagacgagtggtcaaacagtacaagcagaaagtcaaaatcctttattatataggataataagacggagggagtaggtggatagttggtgatgctctaacaagattcacatataagtaacaaatacgtacaacaattaagagataataataacatattaataaaaattttctttaattggaaacccgttgccatgcacaggcaatatgctagtatactagagtaatatttgaaagattttaacaaaaactgtcggaatgttatatagtttctcccttccacaggcaccatgcaggcaggccggcggttggtgatcatatactcatatcatgtcatgtccttttgctcctcaccgtgctcgtacgtacgtgctgcccgacgctgatcacaccggccgagccgaacgtgctgggatgcgcgcgcggaggacaccggcacatacgtgccatcgcctcaccgcgcgctcatgtaggagttatatgttgggtgccggccggcccgcatcgacgagagaggcggccatgcatgcgtgcgtgcgcgcgcgtgtgccgcgcgcgacccgcgaccttgctgcctctctccagtccaaatatagtccagtgactgattcgtcgcgctgcgcgtgctctcctgactgaaaataggcgtatattggcaaatcctaccctttattagccgaaaacctggcacggggtcatagttgaatcacgacgtacagcgcgcgtggttacacgcctccaagtttgaacgtatacgtacggtaaaaagtggaacggtttacacatagccatgcaccgatttttctcgatatcattccatacgcgaccgcaacagtcattttgagttagaaatgggtcaagtttcatttgactaattaagcgatatatagcatgcgtgttccttttttaaggcagggtgcaaacagctgctacagagaggtttccgtgatgtcgacgaatatataattagtccctgtcccacgtgccatttgacatccaccagacgggttcactgaattcagtctgacctgtcggcctcggccaatcggccatcgcatggcaattgccaagttgacaacttgtcaagagccatcacttccaaaagtataggtagtactgtactaaaagcttgtaaaaaagagaaaaaaaacaagaagatatgatacggagatggattctaatagctcgagtggacgtccacccgtttattgcatgtcaattagatggttacgaaaaattttcaaaaaaactaacaagacagatcaatatataatatattactccaacgaacatgcaaattcaaattcaacttctacaagttgtaacaaaaataacaaatttaattgtaaacatacctataataatttgagttttttttgttatttttattacaatttgtaaaagttaaattttaatttgcatgtttgtggattgatatattacatattgatctatcttattcatatttttttaatttttttatattcatctagataacatgcaataaatgggtggacgtccactggctattaaaacagtttaccgatatgatactgcagtagtggagtaggtaccattagcagaggattgcaaatttgcaattgcaatgcaaagcccgacgatcgaacaagcttgctctgacggcgccatgcggcggcgctcctctgtcctccatgccgttctcctcctcctcctcgtcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgccggcccggacgccgtctacggcctcctgctctgccgcggcgacatgaacccctccgactgcttcgactgcggcaccagggtcggcgacgacgtcgcccaggcctgcaaccgcaccaaggacgccatcctcgtctacaaccagtgctacgcccagttctcggacaccggcgacttcctcgccgccaccaacaactccggcgcgtacagcctcctcataagcggcaccaacatcagcagcgccgacgtcgccggctacgaccgcgcggtcaccgagctcctcaacgccaccgtgcggtacgcggtggagaactccacgaggctgttcgccacgggccagcgggtgggcgccgacccggggttccgtaacatctactccatggcgcagtgctcgccggacctgtcgccggcgcagtgccggagctgcctcgacggcctcgtgggccagtggtggacggggttcttgttcccgcggaacggcgagggcgcgagggtcgccggcccccggtgctacctgaggtccgagctcggctccgggttctacaccggagctccgatggttctgctgcgagccgacgggctctcaccggcgtcggcgccggcgccggatgttgttccggccactacgttaggtgagcagcataccaattactctacccatcaaagtgatcacgtcacgtctcttcagtcttcacgtcatctgcacctaatgtttactcatctccgatgcttgaactgattatttttcactgaaatatgcagttaagaagaattcagcaagcaaaattctgctaattgtcttgccgatagtagcagttgcaatcgtagctgcaatttctgtctgcatgtggactgttcggaagaagagcagagcgacaaaagcagagcatttgtccgaacgtgagtcctctgcacaaatacaatatggcatcggattgtttacaaaccccacttaaaattcttaatcatcagtatgaattgattgttctatcgaatccatgcaaatttttgcagttgatgcatctgaggaccttgaaagtgtcaagtcaaccttgctaactctgggatcactgcaagtagcaacggataacttcgacgaaagcaagaaactcggcgaaggaggatttggtgcagtgtataaggtatgccagtagtctttatgtgtaacttttgagtcattgctgacttctttttcaaaaataattgttgatttgatggtgcgagtcaagcatggtcaaaagctcaaaatatgaatatctaaaagtttttctccattgatgatgatgatgatttttattttctacaaaagatctttcgatctttctttattagaaacaccaataattgtaaactattttacagcactcaggtttttaaaccattacaaaatacagtatatcaatgaaaagtaaaaaatatgcaggggcatctttttggacaagaagtagcagtgaaaaggatggcaaaaggttcaaatcaggggctagaagagctgaaaaatgagctagttcttgtcaccaaacttcatcacaaaaatcttgttcgtcttgtgggtttttgcctggaagatggagagaggttgcttgtctatgagtatatgcccaataaaagtctcgacacatttcttttcggtaatattaacacctcctttcagtatatatggtcatgcacttctttctcatgtgatggtgtgcaacaattacaatgatgtcttcatttggggctaattagacgtggagcaacgaagacaactagattgggcaacacgatttaggatcatagaaggcgtcgctcgtggattgcagtatcttcatcaagactcccagaagaagattgttcaccgcgacatgaaggcaagcaacgtcttgctagatgcagacttgaaccccaagattggggactttggccttgctaggctcttcgggcaagaccaaactcgggacgtcacgaaccgtatcgttgggacattgtaattaagcagaacacttgaagcttatgtgccaatatttcacttaaaaactacgtactaacatgcaatttcattcttactgcatgcagtggatacatggctcctgagtatgtgattcgcgggcaatactctacgaaatcagacgtgtttagttttggcattctcatcttagagattgtgacagggcaaagaaacagtgggccctattttgcagagcaaaacgaagatttagtaagcctagtgagtatcccttctaattcctacaaatcaatacactaatattgcttatgtttccagaaaaccactcatatgtaccatctatattactgataactggagatctatatataactaatgctaggtatggaggcactggacagagggaaatattgtagagatggtagactattccttggacagaaactaccctgaagccgaggtgctgaaatgtgtcaacatcggcctcctgtgtgtccagcagaacccagtagatcgacctacaatggcggatgtcatgattttgctgttaatttatagtcatgattagttataaacaaggtgacaccaatgaggtaaatcaagaaactgttgccaaatttcaccgttaacagaaactcatgaggtcaaacccgtctattcaaaagctattattaggccttgttaaatgggcttcaatccagctcaccaacatttgtaggccggtaatttgaactaaagttcaatgcatgcaccagaatctgtcaagattatgacccatccaatagaggtttaacatgatggattgagaaattatcctctgaaacaagaccatcaatgggaacacaaaatgggcttatggcgttgtatgacacattttcacgcagctgcgcaaggcatgagtctatagtgtgacttaacgagaacgaaaaacctatcgagcgatcgatcgcgaggggcgatcggttcccctcccccccacgcagtttccatttttggcaccgctttactttcctcttttagtaagtttatacacctaaagtttacacatctaaaatttatccacctaaagtttgtagagcgaatatttatgcgtcaaaagtttatatacccgattcaaatttaaattcggattcaaatattttatatatagaatatttctatacgtaaagtttatgtgtgcattatttttctcttttagtaagtttatacacctaaagtttacacatctaaaatttatccatctaaagtttgtagagcgaatgtttataagttaaaagtttatatacccaatccaaattcaaattcggattcaaatattttatatatagaatatttctatatataaaatttatgcgtgcaaagtttacggtataaagtctatgcacatgaatgagagtattaattttttttctattttttttactaactttgtttttttaaaaaaatatatgatgaaaagagagaagggagaggagtataggggaggggcgggtcccattaggggcgcccgagaaggaagaccagacaagcaattatattgttaaacagtaacctcgagattagggtaggtaccagtcttccaagctaacatattgtttttctttgtaaatacttgtttagcttaaaaaagtgcatgcacgcctattacaacctgctaatcattaattgcgaatttcaaacttaagttagtgaagtagttaagtgaagatttgcatatgttacatatttatatttggattcgtagtactaggcatgtatattttgagatgggtggagtaatttataatttaattattattaaattagggatttgctacccatctacctgctattgtttttggttttgtaagccgaatttgtggccgctagatcactccaagatttgtgttgatttggctcaccaagataacctttgatgtaccttgttcatacgcctacattactcgcgaggggggggggggggggcacaggcaccgatccccccttcctatttaaaactctactctcctcttcccttcctcctcctcacctttttttttctctgtctaggtacattccatagcttcgtttcgtgagatcaatcgattgagctagatgttagctgcaggagaaaggtttctaggttgtagaggagtagcgtgagggtgaggaggttgtggatgaggtaggcattgtgacggggagggtggagctgaagcggatcgagaacaagatcaacagacaggtgaccttttccaagcacaagaatggtctggtcaagaaggcgtacgagctcgtcgtgctctacgatgccgaggtcatgctccaccttctacatccgaggcaagctcaacgattttgctggttggggtcctagtatgtgcggctatgcgtgcgaacatgttgacaataatcccattctaaaatgttttgtagccatgcatgtagatgcatattgagtcaatgttgttatgctagcttttttccaaactttaaatgtggctagatatattatgtcgtcaataaataacaccagaattttgtggactagttttgttaggacctgaacataataaacaagaatagtcactagacgggaaactatatattttaatccctcgaggggacatcgttatttgcatgttactcaaatggttacgaaaaaaattggaaaaaattaagaagatgtattaacatgtgatataacactccacaaacatataagttcaaattcaacttttatatctcgtaacgaaaaaaacaaattaaacaacatctagttaacgtatatttacagtcaaatttgttttttcgcctattttgttagctaaaccaaatatcttaatgtcagttttgtcagtgcttggtggtcagttttgttaaagttttagtttcgactgaatttgtataagccaaggagcaatttggtcaacagttagttttgtcagcaattagtacctgattttgttagttttgtctgaattcatatataactaaatgcagttttgttagcagctagtttaatcaataattaattagttcatggtgttgttagttttgttggctactaaatatgacttgatctaattttgtcagcagttagttttgtgaatttaaaacttggttcagcttggttcaacttgaccaacttgaccttggaaggggtccccttgggatccttttgtaaccttgcttgtacaagctcggtttccctctcttctccttttatgaaataggcagagctcctgcttttacccctcaaaaaaaaacttggttcagctagctctagtaatttcatggaagctagttaattgacttcttgatttgattatatttttgtgagcaatcggtatctagttttgttagtttgtcagctagctagttttgtctgaattctactaatagtaattaggtcaataagccatttcaatcaaatacaagttgtcaagctgatctgcccatttcactagttcaaattcctgcagttgatttgtattccctgctttagtatatagatttatcagttacatatatatgtcaacatttcatacacgtaggtagtatagatttattttattttattttagtgtagggttgtaatcttgtaattttttttcctgctatatcaatatgaactttgcactgtctagtgcgagctgtaaaaaataaaagaaatagcggctatgagttcgttcccaagatactgttaatctcgacgaccaacttgaataattccatttccctttttcttcgttcaaacgatgaaacacgtctgcatgcacataagtacacacgtacctaatggtgatcagagaattcagtctatatggactatgcatggcatgcccaacttgccaaagacgagatcaatatccttctttttttttgacgcgatcgaatatcctttttaaggggatgcaccccgtgttagttttatactgccatctatcccacgcccctagctagctgcatcctagctctatcggcgcaatgttgcgacgccgacgctcgtctgtcggccatgccgttctcttcttcgcggcggtcgcgctcctcgagtcgctggccgcccagccgtggccgaaatgcggcaacggcggcacgttcacagcagggagcacctacgaaaccaacctcaagaacctcgcgctcatcctccgcacgaacgcctcctcggggtcctcgcccaccctcttcgcctccggcgccctcggctccgccccggacaccgtctacggcctcttgctctgccgcggcgacctgagctcctccgactgcgccggctgtggcaccaacgtctcgagggacgcggtcgcggggccgacctgcaaccgcaccaaggacgccatcctcgtctacaacgaatgctacgcccagttctccgacaagggcgacttcctcgccgccaccgacaactccggcgagtacagcgccctccaaagcggcaccaacatcagcagcaccgacgtcgcgggctacgaccgcgcggtcaccgagctcctcaacgccaccgtgcagtacgcggtggagaactccacgaggctgttcgccacgggccagcgggtgggcaccgacccggggttccgtaacatctactccatggcgcagtgctcgccggacctgtcgccggggcagtgccggagctgcctcgacggcctcgtggaccagtggtggaaggggttcttgttcccgcggaacggcgaaggcgcgagggtctccggcccgcgctgctccctgaggtccgagctggggccgggccccttctataccggcagaccgatggtgctgttgccggtcaaggccgacgggctcacgccggcgccggatgttgtgcctgccattacgggaggtgattaattaaactacagtattatacttcctcgtctcgctcatgctgtcccatatttttcccgggtaattttgcacggggcttgattttaactgttaacttaaatttgatttatactcctcttagtttatgttacatatataaagggagaatagccaatatgatccctaaaattttgctcctagatcattttagtccttaatatttcatagtgtccaaacaagtcctttaaatttgtcacgtgggctaatattgttcttggtcctaccaaaatcactatatggacatgccatgtcaccctcctatgtaaaatctatatgatttgtctaatttactcttacgtatatcatagaaaaattagaaaaaaggaaaaaagttaaaaatatatatatggtatatgtaagagtaaaaatatacgtaaaagggtgaaaaaaatgggaaaagtatttgttcctatggttatgtctaattcacccttacattctttttctatgatatacgtaaaagtaaattgggtaattcatcatagattttgcatgaatgatgacatggcatatccatataatgattttttggacccaaggattattctaagccttatgaaaaagtttaagggttttttagaccattaaaaggttagggactaaactaatcctacattgaaactttatggactatagtagctattctcccttacataaatatgattatattacatatgcaactagcgtacagtctgtgtgttgcaacggttttcttttaaaaaaagagcaattttacggtacttgagaaggtaccatgaggtacccttttttctattgtaaatttggattctctcggtacctaggtactatgaggtaccatgaggtaccaaattttacactaaatttttggtacctcatggtacctcctcaaagaccgtagtgtattgtatatatttttaaagccttaaaaaactatttttaccgtgtaatatatcaaggagcgatgaaaattttatattgaaggaattcgattattttttaggttttctctcactttttgcgtgcacatattgttgttggtggtgggtatcttttactttatgtttttgtatatacaaattaatttatatacaactattgtcgatccatttataccatttatagtcaaaattcttttcttttcttttcttttctcatgagatagatagatagattgatggattattatcaagcgaaaaaataactaaaatttgttcactgagcagcagctagaagcatagaactgtattattgtgtaatccgtttcatatttagttcttcacgtacttgaactcattatttttcactgcaaaaatgcaggtaagaataattcagcaagcaaaattctggtaattaccttgccgacagtgacagttgccatcgtagctgcaatttccctttgtatctggaatgtgcgtaagaagagaagattggcaaaagcagactccagacgtgagtccctgcacataattttggcataaatattaacattcttatacactggcgtccgttaacatttcgtcaaattcatgcaaatttggcagctgatagaaccgaggattttgaaagtgtcaagtcagcactgttatctctgacatcactgcaagtggcaaccgataacttccacaaaagcaagaagattggtgaggggggattcggtgaagtttataaggtaataggccagtagtctttacgtctacttctgaatcattgttgatttcttttgagaaaaatgtgtcgatttgatggtgtgaattgactatggtcaaaatataaattctaaattaaagttgtgtttagttgagcacaaagtttggattttggttgaaattgaaaatgatgtgactgaaaagttgtgtatgtatgacaggttgatgtgatggaaaaggactgaagtttggatccaaactttggatctaaacacagcctaatactcccttcgtccctaaatatttgatgacattgattttttttaaacatgttggaccgttcgtcttattcaaaaacttctatgaatattattaaaaacttaagtagtagtagtatatgtaacaatgaatcaaatgataggaaaataattaataattacctaaattttttgagtaagacgaatccggtcaaataacggcgtcaaatatttatggacgaagggagtacctagaagtatgaatgcactactgctcaattgtgagtgagtcgcaaattttgtgttctcttgaaacaaatggcgaagctcctgcctcttgtttagaaaaactattagtgcaggttagttattgtattttattaatagtgaaaatatattacatcctcgactttagccatataatacataggtaacaagttaacttgaaaaagacataggtgatgggacaaatcctcaaatacctttggaagaaaaccaattgatagacttaaaaagacacataaattctagcaaaaagtaagcctatatgtattacgccacccatagaaagtaaaagacctttggtaactaactctaagaatatagcataatatactgctcctcccatcgtaataacatagaccaacatttggatcagttggacgataagaagataacctgcattgcagagttagacatcatttttctgttataaaaatcttttatcattttttttcaatgccaaattgatgaatttcaagtgtctaggcactccccgaagcgagttactatttttttttgggcacctcaggaggaggcatattgtaaggaaaagaacacattgtcgtgcaaaatgagcaacatggcaataaaaataggtcttgaattgtttcttgcacattgtagacactatattgcttgtctcctctccaattccttttatgaaggttatctttcattaagattgctttttctataaagaaatcacatagaaactttgattttttatagtaacctttaaaattagttatgttatattattatatttttaacccattacaaaattttgtatttctgttcatgtctccatgtataagttagtaagaaagtaagatactaagctaaattatttagggagttctttccgggcaagaagtggccgtgaagaggatggccaaggactctcaccaggggctacaagagctgaaaaatgagctaattcttgttgccaaacttcatcacaagaatcttgttcgtctcattggtttttgcctcgaaaaaggggagagactgctcgtctatgagtatatgccaaacaaaagcctcgacacccatctttttggtactattagcattatctttgatcatttgttactcctgtaatcatttcactccaccaataatagtgacattttttttacatttggtgaaaaaagacacagagcaaaggaaacagctagactgggccacacgatttaagatcatagaaggtaccgctcggggactccaatatcttcacgaggactctcagaagaagatcatccaccgtgatatgaaggcaagcaatattttgctggacgctgacatgaaccctaagattggggactttggcctcgctaagctcttcgcgcaggaccagactcgagaagtcacgagccgcattgctgggacattgtaattaagttgatggaatacttcatatttttgtgcttatattaactaacaaactaatgaaatacaatcctccttgctgatgcagcggttacatatctcctgaatacgtgatgtgcgggcagtactctacgaaatcagacgtgttcagcttcggcattctcgtaatagagatcgtgacaggccaaagaaggaacagtgggccatatttctctgagcaaaatggtgtagatatattgagcatagtgagtatccccggtagttcacataggaattcatgatattgctttgcattgcaatatttgcatatttgtggatagctgcacatgtctatcgtaattactgctgactgctgaagacatacatatttgtgactattgctaggtatggaggcactgggaagaggggacaacagcagagatgatcgaccattccttgggaagaaactacaatgaggctgaggtggtaaaatgcatcaacatcggactcctatgtgcccagcaaaaccctgtagatagacctacaatggtggatgtcatggttttgcttaacagcgacgctacttgccctctaccggttcctgcacctaggccaacatcttcgattgatggaagctctggttactcaacaggttactcaacataatggtctggttggtagctgggagctagatttgtcaccgatgttgttgctttctgttgtttcatattgaaactattcattctcgatttgcaatccgtagcatccaacttcaattaatgaagagtttcgggggactattactcctcaggggttatatatagtttaactagttgataccccgtgctttgttgcgggatatgtgaatgaatgcatgttatacattataaaaatggtaaatgtatatgtttaaataatgtgaaaatgatgagtagataataatttgccattgcttgtatattgagttctaataatacagcaaaattgtaaatgatacgtaatgtttgcatgatatttaaaatactctagataataattgctagtgtgggtgatgatgtcgcacacttgcatgatgagttttaggagttaatgggcatcaattttatagtaagaaaggattaatgaaaagtgtccacattgggagattcctatcccattcaatctctcaggcagctcgctccatgcttttcgtctcaactccttctctcctctttatgtgttaaagattgggttcagagatagccctttccattgtgaaatcaagttgttagattcaacctatatgatgaacaaatagtcaaaagtgagtgttttagaaattatggtgaatactgttttcgcgggtaaacagtgcagggtggcactaggttgccggtcagatcggcagattccgtggggagttggtttcggattgttttcgtggaatttctatgttacttcatgtttatgacttctagattgtttctatatgtatgtaatattgtttgtgtgttgatgtcagtcaatttagtgtgaacttgtactcaaatatggtatttctttgttagttcatgtgcaaatattgcttgaggccataggagtatagccagtgatagattaggactaggcttgggagaagctgagatccaaacaatcaaggatatcacgcgggatgtctaggctagagaacaatgcacgtggagatgaaagtttccatatatcatacacgaggtgttgtgcaagtatagaaagagtagtcaaatttggattggaatccaagtttggaaagattagagtgtggagttgtacggggatgttgtttctctggtttcttagatttcctatgtgattagaagtctagttctagttggattcctagttaggggcattcacgttatggtataaataaatagggcatatttgtcacttgtttgatccagtattgtgaatttcctattatgggttaattggatcatagcattacaaatttgtctgtttggaaatatgctattataattcatctaattgaaaagatgccattgcaatacttctaaaatctggttcatgccattttatacgcttgagatgggttttgaattgtttttatatattgtattttcgtatggaccaaactaccgttggtcttcagtcttcacagcttaaaatcatccccaaatgtagctccaaaccctagccgagcgagcgagcagtggcgatagcagagcaagcggcggtggcggcggaggctccggcaccggcaccgagggctttcgctgtggcgacgcaacaagctgcagcggtgaagcaagcaacggcgacgacggagccagcagggcctcggcatcacgcacaaagcaagtggcagcggcgctggcagcggagcaagcagcggcggggcaccgagggcttcggcagtggcgacgcaccacaagcagcggcagcggtgaaggaaacggcggcggcggagacggcggcagcggcaacgctggccgcggagaaagcagcaacggtcgcatcgacgacgaagcaaacagaaggtggcggaggcgagctagtcctagtcgcagcgcgacaagttcttggagacaacggcgagctccagtggcattttcctttcctttttcccttttttttctcctctctgtatttttttcaggatcaaatactgcatatcgattctgaatttttttttaacatcagcgatttcagtttatttatttgaaatattgtggttcaaatctgtttttttcattgcactggcacgagcgatttcaatcttgatttgaaatgctgtgggtcgtatggtgatttatttttacggtgcttgagtggtaggataaggggtagtttggtctgtacgaaaatacaatagacaaaaaccgattcaaaacccatctcaaacgtatagaatggcatgtatccgattttagaagtattgcaatggcatccttccaattagataaattataatggtatattttaaaacagataaatttataatggtataaatctaattaacccttataaaatatgtaactaacaaattagactaacaccgttagaaggctggttttcagaaagaataggataaggatacccctgcacacaaaaattcaagattgacatcatatttgccataaaaagcttacatattgatttgccctccaaaactgatatggtcaaatgagattcaactctaacaataattgtcaagaagccgaaccattcctacaacataagcaaaataaataaataaataacggtattgctaaaaatatgtcgccacaaattacgatagatttcagttggttgtttcaaccgtcggatgcagaaatcgcacgtgtacacatatccctccgattttgttctcttctgatctcttctgttgctttaatgttagtatttgctaagtaggattactaattaatcttaaaaactaaatattggtgtcatcacaaatttatagttttgggaattacatcaacttacacatgtaattttgagaattacatatgtaattttaggacttacatatgtaattttggaatttacattgtaaatacactaaaattacatatgtaatttagtgacttacaatgtaaatacatagcgactattttttaataaaaaatatggcgccataaatatagctactcccataaataaatgttctagctagtagatcaagaaggatcggttcagaacccacataaaaatgcataataaactagctagggggtcgcaagcattttcgatgtggagtatgtaatgttccatgttgctcctgctgttgccttgttgctcctgacgcgtgctgctgctgccgccgcccggctgttgctcttaacgccgccggcagctgctgctcccttgccgccgccacctcctgccgcctgctgctatactgccctgccgccgctgttgagggggtttggggacccattttttgggttgatttgctcttgatgtggagaaagtgacgaggggatttggggattagggttcctagagagaggagctgattcttcacggtggagtgaagagcactgatcagaacagatgggcagtgagggggatcatgttttttctttgttatgaattattttcgtccgtttatttgaactaaatcaaacggcagtggcaaatcgaaggagcacaaaccaagtgttttagatgcactttctaaacacatattgatgcatataaagtcaatatactttcaagagtttcgccgttttgtttttttcttgatcctgacggtctaactggagtacaacggacggttggactggcggcggtagcaacaacatcatcaagcagacaaggagatcgacaggcggtctgaccgacgacgtcatcacaacgatctgaccggtgcaacttcgtaaagtttgagggtaatcttttaattttgcaagaagaattgattttggtgtttctaccatacaaccgcctccggttggcttggttcttatattcgaaccaaccaatattttgctaacattttgtccggttgtcccagtaaagagcaaatatctattccttaccattgtattattttgatttgttcaaaaaattttcatccagttcgtctccaagttacaatgtactactgatttatcaattgcttctactccatgacatattgacaatggattggatagtttttaaaagggttaattggatccatgttactgcaactttgcgaaattaaaaaaatgccactactattcatcatatcggccacatgccactggaaatttctataattaaaactatgccactcccgtccctttttccgtctcctctctcacgccgtctccgttgccgtcctcatcccctccctccttcctcatttccgttcctgacttcatccccctctccggcgagcggtagagcttgaggagggagttggtaacgacagggtcccgttcctgcgcacgccttccctttccctctccgtcgccgacacggtctcctcctccccgccactacatattcctcttgctggtgaacttccattgcacgcgcacaagcacagtcatcacagacttcggcgatctccatggctccatcaggtggggtgcgcgagcgcatcgcacttgaatgcatgctcgtgggcgaggcgcgcaaagcctgtggatggggaaggggcgggaaagacgacgacgcgagggcggcgaggaggagggagaaggtgaacggggtgggcggcgaggcctcgcggatgcggtagtagagggcgagggaggcgaccgcgggcgcacagcgctgggacagcgcggcgtggagcgggcagcctcgggagggggccgacgagaaggcaccggcagaggaggaggaaggtgggctccggagccaaaggagcaggcagcggaggcggtgtgggagctcgggcatggcgggagggagccgccaccgtcgttgtcctctatccgtgacaggaggtctcgggagctgccgccgtcgccgtcctcgacaccatccacggcgggagtgctcgggagccactgccaccactgccgtcatcaccgctgtcctctttgcagtcgcagggatggaggaatagatggtgaagaaagaggagggagatggaaacgattaaacatgggggaacgagatagtgaaaaagtgatgggagtggcatgtttttaaaataaaaggaaaataaaaccgctccctttgccgtatgtgggagttcaaaaaaacttccactaattaaaaacatgccactcccagtatccttttattttgtttttggctctaattaattcaccctaaggtagcactatctttctttttctaatatacgacaccattgactttttgtttacatttgatcatttgttttattaaaagaatttataaatataaaaatatttaagtcatgtttaaagaatatttgatggtaaatcaagttataatgaaataaatgataattatatattttttaggagtagttttttttaaaaagacaaatgatcaaacgtatatcaataaatcgatggcgttatatattaaaaacggaggaagtataaaaagaatctatccatcagacgcacgatgcccaaataatcggacggtcaaatattccagttgaccaacgagcgaaacatcaagttataatgatgaaaaaaccatcaattggaacatttaaaagttatatgaaacttggtaaagatatacgttgaaacatgtcgctgtcacatatgaaacaactagtattaacggattgaagcatacgtttttctttcattaaaatataatcatgtgatatcttattgtaaagatttaattacaacgaatacaacggtgtaatcagatcgtagattggataattagtttaggagaaaaatcattttgaagctcaatagaatgtgcatgtatggataagatggagagagagtagtggtaggtagtttcgggaattttgtaaaatacactgaagacacatacgggtatatatcactatcacgtataaaacattaggttctgacaattttaaatatatatattttttattataatataataatgcgatatcttgttataaagatttaattacaacaatacaatgatataatcggataagcggttaatgagaaaaaaacattttaaatcttgagtagtacactggtcagtctgagcgttcgataaaattttgtgaaatcggtagaccgatcagtagattttcgggaagtatatgatcgacattcttcatgcaagttgccgcgcgactgcctttttcatggggcccgaccgcgcgaaggtgcaagcactcccgtgaccaataatccattgctcctaaattttactccctccgtatttcaatgacaatgttgactttttgacaaacgtttaacctttcgtcttattcaaaaactttatataattataatttattttattgtgacttgatttatcatcaaatgttctttaagcatgatataagtatttttatatttgcataaaatttttaaataagacgagttgtcaaacgttggttaaaaagtcaatggcgttatacattaaaatatggagggagtattaattatatattgagttctacaagtatcttgtttaatactccgtacattttaggagctaattaaacatgtcgaaacagcggctacggggaggtttcccttgagactagtcacgatcagctttgtttatttccattccccttttcctttcagcaactgttatctatcatatcaactgcgtccatgcatgcacgtgggttttgacaagtaagtaagcgaaagtaatttcattttatgcatatcatataaatagttaaaaaaaatttaaaaacatttgataacattgattaatacgaaatatatcactccacaaacatacgaacttaaattcaattaatttctataagttctaaaaaaatacagtaacaaatatagctgcgaatgtacgataattattttcagtttaattttttttacaacttgtagaagttgaatttggttttacatatttgtggagtgatatattttatattagtatatgttgtcaatttttttagaaaaatttaataactatttacttcagatgacatataaacaactagagtaagtaacggggttcagtgaattcagtctgacctgtggtggggccatcgcatgccaagttggccacttgcccagagctgtcacatccaaaatgatacgcattccagctcaaaaactcaaaacgaatgctgtgccattgctacatcgatcgagcttactagctttccatcatcccaccactgcctctgctaagctactctgaccggccggcgccatgcggcggcgctcgtcgctcgtccacgccgtcctcctcgcggtcgcggcggtcgcgctgccgctcgccgccggccagccgtggccgagctgcggcaccggcggcacgtacgcggcgaacagcacctacgaaaccaacctcctggacctcatcagcgccctccaggggaacgcctcctcctcccccaccctctacgcctccggcgccgtcggctccggcggccgcgacgccgtctacggcgtcatgctctgccgcggcgacctgagcacctccgactgcaacgactgcggcaccagggccggccaggacgtggggcgagtctgcaaccgcaccagggacgccgccctcgtctacaaccagtgctacgtccgcgtctccgacgccgacttcctcgccgctgccaccaacaactccggcgaggtcgccctcatgagctccaccaacatcacccgcgccgccgacgtcagggcgtacgacgccgcggtggtcagcctcctgaacgccaccgtgcggtacgcggtggagaactcgacgaggatgttcgcgacggggcagcgggtggggagcgacccggggttcagcgacatctactccatggcgcagtgctcgccggcgctgtcgcggccgctgtgccggagctgcctcgacggcctcgtggggcagtggtgggacacgttcccggtgaacgtggagggcgcgaggatcgccggcacgcggtgtaacctgaggtcggagctgaaccagggcacgttctacactggccaaccgatggtggtgctgcgggccgacggactcgcgccggcgcaagggccggcgccggcggctacgacgggaggtgagcatacaacatactccctccgtttcgaaatgtttgacgccattaactttttagtacatgtttgaccgttcgtcttattaaaaaattttaagtaactattaattctttttctattatttaattcattgttaaatatattttcatgtaggcatataattttacatatttcataaaagtttttgaataagacgaacggtcaaacatatgctaaaaagtcaacggtgtcaaacatttcaaaacggagagagtatttagttggagatgtattttcaatcctcgcggagaactggagatatccgctcatttcttacatatgccatccaaataatctatttaaattaatatgaaaaatatcagtccacaaaaatacatggttaaattcaacttctacaaaatccaataaaaaaaacaaattaaattgaaaatagttaacgtgcattcacaattatattttgtttgttgagaagcagctagcagcctagcactgtgttgttgtaatgaggtgctacatagaagaaaaggtacagtactttggatacttgaactgatcattttctatgcaaaagtgcaggtaagaataattcagcaagcaaagttctggtaatcgtcgtgccgatagtggccgttgcaatcgtagctgcaacttccttttgtatatggaatgtgcgtaggaaaagaagatcaagaaaagcagaacatttctctgaacgtgagtcctctacaaaatttagcgtagaattcttcaaaaattccatctaacattcgaatatcaattaactatatcaaattcatgtaaattttccagttgacgcatctgaggaccttgaaagtgtcaagtcgaccttgataactctagcgtcattgcaagtagcaacagataacttccacgaaagcaagaaactcggtgaagggggatttggtgcagtttataaggtaaactagcatgctggcccgcgcagattgcgcggctagcatcattatattttctctcatataatagcatatttgctttctcattatatttttcaaatatattaaaatgaaacataattttaaattttacaataactttatgaaactactaatgtgtaatattcatattgtatttttatatacgtgttagttattaattatttttaatatcaaattttagttatttgtaaattatatatattcctatatgtactatagacctgtcttttaatatttctttttttattccgaattttctgtaaattgtatttctatatagactctaagctcttcttccaatattatttatttttatttctgaatttttattatttctaattgtatttctatgtggactctaaactcatctttcaatattctttaatttttaatttcgaattttagttacttctaaatcgtattcctatattgactttaaactcttcttcccgtgtttttcttaatttcgaattttagttacttgtaaattgtatttttatacggactctaaactctacttttaattttattatgtgtattctgaattttagttagttttaaattcctatatggactctgtactctacttctaatattccttatttttttatttccgaatttctattctttttcttaattgtatttttatatggactctatactctacttctaatattccttatttttaattccgaatttcagttacttcctaattgtatttctatatggactctagtctcctcttctaatattccttatttttaattctgaatttcagttatttcttaattgtatttctttatggactctagtctcctcttctaatattccttattttttaattccgaatttcagttatttctaaattgtatttctatatggactgtactctcctattctaatattccttattttttaattctgaatttcagctttgctttttctttttcttcgattaatgtgagaatttctatgccatgagagcggactgtactctcctattctaatatttcttattttttaattccaaatttcagctttgctttttctttttttccgattaatgtgagaatttctaggccatgagagcgaacgtggaggctactttttctattcctttaataatataatagatggtactccctccatcccaaaatataaaaaatttaagtgaatataatacattccagtactacgaatctgaacaggctaaaatatatcacatccacccataattctttatattttgggacgggagagtagtagttcacaggtaacttttgaacaattgctgatttccttttagaaaagaattattgatttgaaggtatgaatcgagaacggtaaaaatatgaaattctaaatatgtcttgattcctgagcgcactagtactccattgctaatttgttatagtttatttttacaaaagatctttgatctggctttattggaaaaaccaaatattgtaaattagtagcatatgcatgttagagtcttaagtcattacaaaattcaccatttctgtccatatctccatgtataaagcaaattagctaataaactaagaattattcagggacttctttttggacaagaggtagccgtgaagaggctggcaaagggttcaaaccaagggctagaagagcttaagaacgagctagttctagtggccaaactgcatcacaagaatcttgttcgtcttgtggggttttgcctagaggagggagagaggttgcttgtctacaagtacataccgaataaaagccttgacatatttcttttcggtacaattataattaccttttaatctacatatatatacccctttcgtttgctgacatgcaataattacaataatctcttcatcacgtgtcaattagactcggagcaaagcagacaacttgattgggcaacacgattcaagatcatcgaaggcattgctagaggactacaatatcttcaccaggactcacagaagaagatcatccaccgtgacatgaaggcgagcaacgtcttgctagatgcagacatgaacccaaagatcggcgacttcggcctcgctaggctctttgggcaggatcagactagagatgtcaccaatcgcatcgttggaacattgtaacgaagtcaaacactttatctgtttgtgcttatatgtagctaacaaactaacatgtacatttttttcttgttgttgcatgcagtgggtacatgtctcctgaatacgtgatccgtgggcagtactctacaaagtcagacgtgtttagctttggcattctcgtcatagagatcgtgacgggacggagaaacagcggcccccatttcttagaacaaaacgaagatttaataagcatagtgagtatcctgctaactcatagacaaatacggagtatattgataccgcttacattttaatatttgcatttgaagataaccatgcaatatatgatctgcaatattaacatataactcacaatatgtaactgattctaggtacggaggcactgggaagagggaaatattgtagagatgactgaccactccttgggaagaaactaccctgaagctgagctgctgaaatgtgtaagcatcggtctcctgtgcgtgcagcaaaaccctgtagatcggcctacaatggcagatgtcatggttttgcttaacagcgatgctaccagcactctgccggcttttgcaactcatagcccaacaatttccatcgaggggaactctggttactctcaaaccgttacacaattgtctcctagatagcagggggctaaaacatagttggtactagaaaataccccgcgagttgctgcgggatataatgtatctaaacaaaatgaagtgaaattctaagagaacaattgatccatcacatttagacatagtgcataccaataaaagaaagcgaaattctatgaggacatttgatccatcacatttaacatactatatgggttggataggtccaagtactccttagcagagcttcatcctgtttcatcgattataggaaaatgaattttcttgactacaaattttggaaataatacaaactcatcttatgaggagattgtgaaacttgcgtaatatatgtgtaaggacaggaaaggtgtataacaatcaaagacctgtttattgcgctatgctacaaattaaatgaggattagttgtactattctttttagcaatatatgacagactgatagagatatataagagatggcgttatattatttgattggaataaataatattacaataataaataaaataatagagtgggctaagctgatgaaacaaaatggagaagcaaagacggagttattgaaatggatgatcctgggagctgcaacttctttctgtgaaccaaagaaatggagtcgactgaaggtgataatcttgaactttgttttgtccttttccccctactcaagaagagttacatctaagttcgcatgttttctttctcgtctgctacctactatttgtgttgggccaaagtattggctgaaaacgctcctttcttgtttgagctggtctccccagcctgtggatgtaaaaactctctttatataaaagctgggccatctggccttctatcaaaaaaaaaaagttccagaaatcattctcgttgaatcgtagtatagctcaaatatgaatagaggtagaaattaatgaccagaatttactttcccaattagctagtaagagcatctatgataaaatccatcagcatgatataacatgaatggaggggaaatgtgacattaaattttatgaaggataaaaaagtgatatcatgcagatctagccaatggctaggcagatgaagacaaacaggagcattgcctttttctatacaggaggaatgagtacaaccaataaactcatcccaaagccatctgtttcaaccttgtgagccaatgagctgatcagctgaacatgggaaaatgagggaagagaagcacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaatatgaagattggcgaatccagctgttgtgctgcaacaatttgtttcatagcaaaaggggaggctaaaatgcctgctaaaatgctgcatcgaaccgaagccaccagatgagttggacatgattacatgagcccttttacagatggaaaccgcgctaacaggggaaatggatttgatggatctttgtatctggaccaggaagaaacgttttcgtgggtatggatgaacaacttgttagtgccattgctaccaggtatacatgtatcctgtaggatagtagttggacgtgggtgtagctgcgtaggcgaacagattgattcgttgtgttgttgcttgtttgtgggagctcagcatgcaagaagatcctttaatagctacccttccagttcttttcctcttatattccttgagaagtggaagaggctgttggtttcgcagagggagagaccgtgggatggtggaaccatggaagatgaaccaaatgacagtttttgatcgagccatcaaggaggaggcgaatcgatgaggggaagaggactcgacaacgcacgatggagaggcctggtgatgcgccgcctacgacactagtcggaaggaggaagaggaaaggttcactggctggcccaggtgggaaaattgggctggcctcagcgagcaagagaaaaggcctcgaggaagcaatttgcaccgttaagaacgtgaatccaacggatggaaataagtggtgacgtggctcaacctcaaagcaggaaattgctaataactacactaagtggggatgatttgtataggtatataggatttgctcgttgatgcttgttttgttttccgttgaaattgtatcttttatcagtttgtaatcaagaattgtaaagttaaattataaacatggagatacgaggaaaaccagtagtatgtcactttctttttcccttttgacttcaattaattagtttctcataagatacttttagcgtaggagtaatggatatccatctgaccatccatgcaagttgttgcagctaccgcggctggttttttccacgggggcgccaggtgcacgcactccacacccaaccatttgattatttctagttaagaatgggtcaagtgttccaatcgattaagtgcgtgctaattactactagtactcgcatgttgaaacagctgctgcgtggtggtttccgctcacctttattttcgacaacgaatgatcgatgaaacgtcccccctgaatgaacgtactttacgacgtaagcatctgtctaaaaaaacacgaataatagaaaatgacctaatatcaaataattagaagagtgacttcgaattcaggtcgtctacctcaccaccttgtgaagctagctggaagactctgggtgtttctcatgaacatctgcctaacgttgtgtggtgacctcagtctctgtgggctatcgccatggcaacttgccaacaccatcgtacgtacgtgcacgagaaaaaaacatttcaatgccgcgcgaaaattctatcctcttttgctagcttccatcccactgtgcatcctgctgactgtgacagctgcgtccacgggcgccatgcggcggcgctccacgttcgccgttctcctcttcgcggccgccgcgctcccgctcgccgccggccagccgtggcagctctgcggccgccgcggaggcggcggcggcggcacgtacacggcgaacagcacctacgacaccaacctccagagcctcatcgccgccctccagcagaacgcctccacgtcgcccactctcttcgccgccggcgcgctcggcgccgccccggacgccgtctacggcctcatcctctgccgcggcgacgtgagctcctccgactgctacgactgcggcaccagggccggccaggacgtcgccccggcgtgcaaccgcaccagggacgccatcctcgtctacaaccagtgctacacccgcttctcggcggccggcgacttcctcgcctccgccaacaactccggccaggcgccgctcatgaacagcgacaacgtcaccaccgccgacgtcgccggctacgaccgcgccgtcacggaactcctcagcgccaccctgatgtacgcggtagtgaacaccacgaggctgttcgccacggggcagcgggtgggcgccgacccggggttcccgaacatctactcggcggcgcagtgcacgccggacctgtcgccggcgctgtgccggagctgcctcgaggacctcgtcgccaggtggtggaagacgttcccgcggaccacggtgggggcgaggatcgtcggcacgaggtgcagcttgaggtcggaggtatcccaggacaagttctacaccggagccccgatgctgaagctgtgggccgacggcctctcgccggcggcggcggcggcgtcgccggatgctgcgccgggcactacgggaggtgacaataccgcgtcatttcgataacatatactccctccatttttaaatataagatatcgttaatttttaaacatgatatttgaaaatttgctgggttcaaatttactgcaaatatgagaaaatataagtcattatacttttttatggttcatggatttctgcattgtttatgttataccggattacttttgaactgataagtctgacttttgttactcgtcacattcttggtgttatgtcagataatcaccgcgcagacagtcaagacccatagtttagcatggcaaatgctgtattacatcatgtcacgtatatatattagtagtatgtcaattaacgatgactatcttcatagctcattgttttcattgagtcttagaaaaatcataaattggcacacgaagagacagagacggatccagaaagaattaatatgagggtctgaacaaactatacaaaaattataaacccatcttctaattaatgtatgataaaaaattttagtggggtcttcgtgggggctcctatggttacgacacgggtaatggagggctcgagacccccatagacccatgaaggatccgccactgcgaagagaaagtcaattttgttcgttgagcagctggtagctcaataatcagctgctcagacaagaaaacaggtgctctgttttgaatacttgaactgattattttccctccaaaatgcagtcaagaataattcagcaaacaaaattctggaaatcgtcttgccgatagtggcagttgcaatcgtagctgcagtttccatcctcttgtggaatatacgcaagaagagaagacgagggaaagcagagcatttcaccggacgtgagtgatccttctcatcattggcataaaattcttatcaaattccactatacattgttaatcatccgtattcattaacagtttatcaaattcatgaaaatttgacagctgatgcagctgaggacttcgaaagtgtcaagtcaaccctgctatctctggcatcactgcaagtagcgacggataatttcaatgaaagcatgaaactcggcgaagggggattcggtgctgtttataaggtatggaagtaaccttttatgtgttcttttgaggaaataattttttatttcacggggcgaattaagcatggtaaaaatatgaaatgataactttttactatgagtgtactgatccttaattgttactttgataatttaattaattaatactatttggcaaatatcattcaagatcgcctaatattgtaaattagttacagcaccaagcttttaagccattcaaaattcagttttttctatccatatctccatgtaagaaggtattaaaccaaatttttcaggggcttcttttcagacaagacgtagcagtgaagaggctagcgaagggttcaaaccaagggttggaagaggtgaaaaacgagctagttttggtggccaaacttcatcacaagaatcttgtgcagcttgtggggttttgcctagaagagggagagaggatgctcgtctacgagtacatgcccaacaaaagtctcgacacctttctttttggtactactgatatcacccctgaatttagatatgttaccatcttttcatgtttctgcaatgaacatgattcatgctaattagatgaagagaaaaggagacagctagattggactacacgatttaggatcattgaaggcattgctcggggccttcaatatctccatcaggactcccagaaaaagatcgtacaccgagacatgaaggcgagcaacatcttgctagacgcagacatgaacccaaagattggggactttggacttgctaggctcttcggacaagaccagactcgagagattacaaaccgcatcgttgggacattgtaattagttcataaatatatatgtaataaaataattaactatgcaattctcattctaaccatgtgattattcttgttggatgttgatgcagtgggtacatgtctcctgagtacgtgacgcatgggcagtactccacgaaatcagatgtgttcagcttcggcattctcgtcatagagatcgtgacgggccggagaaggaacaacgggccctatttctttgagccaaacgaagatataataagcatagtaagtatatactacctccattttctaaatagatgacgtaacttagtgtaaatgtgctgaagtataagtcttacgtaaagcttttttaatgataaaacatgtcacaacagaacaaatgatatttatataatttttaaatatgacgaataatcaaacattatgtcaaaagttaacaatattatttattaataaaagagggagtatatattttgctaattcaccaagactaatgcaccattgattgccacttgcacttttagtactttctaacatataaccatgcatactgattactgaagatatttatgtatctaatactaggtatggaggcactgggcagagggaaacattaaggagatcatagatcactccttgggaagaaactaccctgaaggcgaggtgctaaaatgtgttaacattggtctcctgtgtgtccagcagaaccctatagatcgtccaacaatggccgatgtcatggttttacttaatagcgatgctactagcactctgccggcccctgtagttcatattccagtagcatctttctccgatggaagctctggttattctcaaaccgtgacacaattgtctcccaggtagcagggcctaaagcagagcttgccatcgctagtgtagttggcttgttgcttgtttttgtttcgagttggaacttgaaactgtatatattgtcattttgtgataagtggtcaagagcttggccacacgagcccaatgctacagaatcacctacagaagcgtaggacacatcactgtatattgggattccaaaaatctgcttatctgagaaattactgcagtacacacagctcgctagtgctgtagaatgcagattgctctggaccgttaacttaaaagaaagtttccattacagagtgtaatttgtgaccaagtcagtagcagattgagcgaaaatgagcgaaaatgggcaaatggccggc

SEQ ID NO: 75314 - DNA, 57928 bp, Oryza sativa
tcatcacggcaattggcctcctcgacctcgacgccatggatggagcaccgcctggatggtgtgaaaaaagaagagaaaaaagaaagaggaaagagagagttgacgtggtatgctgacatatggggcccacgtgtatcccacgctgactcagccgccatgtaaaccaaaccggggtcaaaaccaccaaagaacctcggttgaccgattttgtatagttaagggaccccgcatatctggttttgtggttcgagaacgttttttatcccaataacaagttgagggaccttcggtgtactttttcaaactaataaacagaactcttctaccccgttatccggtattatattgcctgcctgccagggagtctggggccgagcccgccgagctaccgcccacggtttgtggcgaacaccaccgttttcgcgggtgctgatctcgatcgtcgatcatatagacaggtgagcatatatgcatatgtcatgtcagcccccgtgacgggtgctgtggcgtgccttgctcgatccactcatcatgaccgatcgagagagctgaccgccaagtggccaaagttgatgccgcgttgatcgttcgtccgcccacccccggccgtcgtcggtcgcgacggagccttttagagcaagtataataatagcgagctataagtctactataagcttataagtttatgtggagaagagaggtagaaaaaaattaaaggggttggctctcatgtaaaagctagcttaacacaatctccaagataaatgcattaaatgtataagtgagagatagagagaggaaaataaaattatagctaacgttatagctaatctattatatatgttggttttaaaatgagctaatagtaagaagtgagctatactattatccttgctcttatgtggtcttggtctcttgttacggagattcgtgcgctggaacttggcgacatggactcacagatcccgctagttgtttttcttgccccatcaaagactatatattcttccccttctccaacccacatccctcatcgcacacacgtttttaatctgctaaacaatgtgttttttttaagttttctatagaaaaattaatttagaaaatcatattaatctatttttcaagtttttttactaatacttaattaatctcgctcatttgctttatttttcgtgctaggaaacagggttgggaaccttgcctcccgaactcgtactcagcctaattgtttggttcacatgccaaacatggctagatgcgtggctcataaattgattggtcacaccttaagtaaggtttggctaaaagataaatgtataatatataggcctttgaattgaaaaactatgacatatgccacaactttgttgtatcctgcagctgaagctcgcacgtggtgtatacatcaggtgcactgtgcttcatctactgtctatgcacaattaaatgagttccattgcaaaatgaaaagaatccaaatatagaagcataaatatatctttattgcgtactttatatttaatttgtcctatgaaatgaatcgatgtatatactgtcagacgtttgaggtcacgacaatagtatttgcatggtgtggagatcatcgatatcaagatatatacgggattgaggtaaaagaaatggagacaaggtttttatacaggttcgggccccttatctgacaggtaatagccctactcctattggccgtagctggtgttactctatattcatcagaatcacaaaagtacaatatttgggattgtctatctagccgtcgttgacatggcggtatgaacaccaatacgtggtcgacgacgtggtagtcttcctcctcgaatataaactcgccgagatcagagattgcactagatctctcttattggcctctgtaggcactagattgggtctgtctaggctaatctttgatgtcgacgtctggcttgtcttggcttgtgttggtctcctccttctcctcctagagggtcttgtatttatatccatagatgtccccttgtccaagtagaactagagagaccaatatggatacaatccgagtggtccatgtagtttccatatagaactctacttgtccttccttatctggaactccttctatatacgaggtatgattctgtataagacttggtatatgatgggtcctgccgaggttagtcgattaccattgggtatgtggtgtccataaccaggacaatagcccccaacttcaactaaaatgaattcacattgtcatgctgacttggtcgttctcgataacattcgagaagacatggagtactcaacatctctgaaaaagatcaacggtgcacaagtgtatttaaattgaagtctaaacaactgccagaaacgagcctgaaatcaacgcaaatgaacgagttgatcttatcgatcgaagaccttggaataacaatgtcgtgcttgcttaaccgttctcggacgactgagaaggtacggagtatactactaaattttctgtcttgccgtaatcgagaatttgggttgaagtcaagaattttcatctcggtggatacaccatcacttcattccataatccttgtcaaactccaccatctgttctcgagtaatcgagtagttgtccaactgttctcgagtaatcgttcaaccgttctcgagtagtcgagtagttgtagaatctgtgacaaagccctaaaatatgattttcctgaaatcaatacctagaacaaattgttatatacaaatagcccagaagcaaatgctcaagggtaacataatataatatgaatttaaaaattaaaaataaattgaatctgcacatggcaataaaagagtactctcgctaaagctgccctcagcaattagagtctggtactcttcctagccctagctatttttatggaaaaatggtttttcggcaaaggtagcttaaatcttataacaaaccaagctaaagctgacgaaatcctagctcctagccgtgaagttgggaaaccaattcccgattacacgacttagttaatacgcattcagaatagcgcaaatggacaataggattgacttcaagatagggcgatataagaaaataggatcaacggacaaatattgcatatacaaacacttccagaggttgtcggagaatccatctcgtcgaaacattgaagcaccaaaatctccctaccaggcgtgccactgtcgacgtttgaggtgacgactacggtatttgcatggtatatatggagatcgtcggtaccagggtatatgcgaaattgaggtaaaagagatggagacaagggtttttatacaggttcgggccccttatctgacaggtaatagccctattcttgttggtcatagccggttgtcacaccctaaaaatcctaaatatataaattgttgtttaattggaattattaaaattgattttaaaagcctagaagagaagatctaatttttaattaataaattccaatataaaatggggctagataaaatttcattaaatactttgcttaattctataattcctagatttttctgggatttatttgagctaaggaagtatttttaataaatgaaattgcatttcatgaataatttaaattgaaaaaggattttaaaagtctcttttggctttgggccgaaagtcggcccaaaaccttctctctctctcggcccaggtcggcccaagccgagcgcccgcccgcgcgcgcgcgttcccgtcgctgacaggtggggcccgcctgtcggggtcgtcgtcttcctcgcgtcggccgccgcccgaacctagccaagccgtgccgccgtctccttccaaattcggccgcgtctttccttctccggtgaaatcaatagaggggaaatgatcttcgggatctcctctaccttttctcttttggaatcgtcggctaatttcgtttggaaatccgtggattcgagtttgattcggatcgaaccctttcctccgaaccctaatctttccttcttgtcgccggtcgccgtgggccttcgccgccgcctccttgcccctataaaaggatccccaagcccgccgctacccgtcgccaccctcgccttcgtctctcgccgtcggaagagccctagcgccgtgtgacctagcgccgccgtcgtcgccgccgctccagccgtgcgccgccgtcgctccagtcgtcgccgtcactcgggaagaccgccatcgtggtcgccgtcgcgtcgccgtcctcgtccgccccttcgccgtcgctgttgaccgccggagcaccgccgtcgtcgtcaaaccgaaggactccgccgccttttcctcgacgccgccgtcgtccgttcatcttccaccgccgttttggtcatcggtgagttcgccgcgtcgcgttctacgtgctggtgccctccgttcgcgtcctcgcgccgtcgttcgccggcgagcatgcgcgcccgagccgccgagccgccgccggaggtgacgtcaccgctgacgtcatcgtggccgcccgtcgtgatccggtcgtggaccgcttgatctcggccgttcgttttggataagatcgatctcggccgttcgttcccgtgaaccgccgccgtgcgcccggtccaccgcaaaccctagccgttgacgcaataattcctttttccttttcaaaagtaattcattatggcgtcataattcaattaaaatccatataagtgttttaatccgatttaatctttaaaaattcataactaattcatcttagctcagatttagttggttcaagtctctaaatttttctaaaattgagatctacatgttaaaaatatccacatgtactgttcatgcttgtttatgtgctgttttggtgattttgctcttttctgtttagattccgacgtttccggagagtccgttttcgcaggagaagaatttgaagagttccaaggccagcaaggcaagtcacacagatcccaaacaaccctttgagcatgttgatcccgtttaaagctactatttctattcaactattgcatttattttcgaatgtcattggatggaattaacctattgtttgttatagcccttttgttcttgattactttattccttgataccttgggttattataacttgactagttgggctatatatatattggttcagctagatattagatatgattgcttagccatgcttagaaacattagcacactattgggataacttatgactcactattatttaatgatggcttaatgatagttcacgatggtcaatcgtgattaggttaatcaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccagaaaaggtgccctgtggtggattgtgttgtgcgaggggtattgtcacagctcctttccgaggtaccgtggtggtattgaggcacatggtgacatgttgtggggctgtgtcttgtgggtacagtggtacacctctagccagagtaaaactattcgaatagccgtgcccgcggttatgggcgggtctaacaatgtctttcgtgattagtctcacacctctcatcatgataaaagatgctataactggtaataatttgtttagctcctggtttggaattgtatattcctggtttggagatagatctgtacagccgggtatggttgttcagaatggttgggcctatacaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacagtgacgctgatggtgtggaggattaggtgtagccctggtcaagctgcctgtggagtggagccgtctgcgccgtttatcttatttttccgctgcttagatctttattgattgagaggaactatctacctctgtaatgacattttattcgcctattaattagagtaataattgtactctattatcaatttgttattgtgtgcctcggctgactcctggacgagggttcacacacatgtaagcgtttggaattttggatagaaattccgggcgtgacaccggtgttactgtggacccccgtttttataacaggaatcaatcgtgtaaatagtaccatttccctggatcaagtagtctggtacacacgagttcatagctgaaataccaagtgcacatacacgagggtctagtgcgcattattacatcataggcttgcaggcatagtcttagaacataggaccgaatggtccggaatacattccaaaagcagaagtagataaggcagcggagttaaggcagcggcacgccgttgccataggcaacgaccataactaagacctactgagcgccatcgtcttcatcaccctcttggtagtaagcgtagggatcctccgaagcttcatcttcgacctctgattaagtttgtatattgcaagggtgagtaccaaccgtactcagcaagccaccacagcaacaatgcacatgatagggggtattcaagggatggctatggttcttttgcgcaaagtaagttttgtaattcttttcacaagcctaagacctagcatgactgatcaaatttttagtaccagtgttcatatcaaagaacgacggttctgtccaccatccattgtgatcccaaggatagcttcccgccattgagtcgtcatggttttctgaggacgaccaccttccctcctctcaggaagtggctccatcagcataaaaatcatcatgcaatattccatcccacacaaattaagaatttagagtctagccaagtgtaatacatgtctcggtgctcaataaccgcgagcacggctattcgaatagatttggtttactcacactgcagtggatgtacactttatccgcactccgcgactgcccaacacatgagcctcgtcccaacacatgagacgcgtcacggcaaagctttttgataacctcgcattggcagtacccactccataaactttacatcctcatgcactctaggcggaatacgatttctagcagtgagaggagttctggcgcacccgggaaaggaagactcacacatgcattaaggtataattatgtttagattctcacatggcagtcctaccgatggcgacaccactgtaggcacccgcctcgcggtcctaccaaaggctgccccaccgtagagcccctgcctcacatatcaagaaaccactatgcatggatactgcctccgctcatctatctactccgctaggtctatacccatacgagaagtgtggttgtacgggggtcgtttcatgcttaacctcatggctcggtccttaactgaccagggacggcactagccttttccagacaccacccaaatcctacatccgccccagttgaaaatagttgtttcattttattttcctttcaccaaatcatgtcatcactatcatggcaatgtggcgctcatgtctccatatgccgcatctcaattaccttcccaaaggtaattgcccaggcatatagcatttgataaatatgagtatgcatgattctagaatagcatttctaagcaattgtcataattgactagggactcatacataaacatggttacaaatatttaagggtaaacaataatcaaggcatggcataatcacaagtgggatgttcatcattgcatgcaattttatttgtaaacaaaataatttcgcaattgggatcaacatgttcaaagaatagtgatgacttgccttgctcgtagtcttgcgggtcttgatccttgctcggatccacaactccctcgggctctaaaattacgtacgaagaaatgatttgaattcaattagaattcaaataaaatccaaataaactcaaataaaagtcgaacgcgaatcgattactcctaagaatctccaaaataatctacgattatataaaactttgcaattctacggctaacaataatctacaattaaattctaattattttaaattttctaaacctccttaatctctctctaattttttatttatttttccttttctttttctctcttcttttctttatttttttctctctttttccctcttcttctttctttctttttctctccctcccggcttctcccttccctctcggttctctgcctacccgagcggcaacagcgaccaaacaggggggggagcggcggcttactgacgacggcggcggcaacggcgacgcaaggcggggcgacgcatggcgcggcgcggcggcaccgagggcggcggcgcagtggagaggaagagaggagaaaagaggggaatggggtgggggtatttataggggagagggggaagaaggagagggggtggccggcttaatggcgacacgatggcggtgcacggggctcggggtgacggcgacgcgcggcgatgcgacggcgcggggctcggggcggcgacgcgatgggcgggcggcagcaacgatgcgacgcgcgcggtggcacggggctcggcgcgacgggacgtgtggcccggcagcggcgcgagtgcgacggcgacgagacggccgcgcggcggcgcgtaggcgcgagggcgaagggcggcgatgcgacggcgagcggtgcgcggggcgcgagggcgacgggcatgcggcaggggcgcggggcgcgaggcggcaggcgcgcgacgggacgtcgggccggcgcggcagcggcgatggcgacggcgcgcggcggctcggggcgcgaggcgcgcgcggcagaggagggggcatggctaggaaacctcgtcgagcacctactgcgcaatgaacagtgctagctcctatttaaccctaatttagcctattccctatataaattttattctataaatcctaatttttgcacaaattaagtttactcaatatttgtgttatttcaaccaatggattcaccctggattaatattacccatattttatttttatataatttatttgaattttaattagggctaattcttattccatcgcacttaaatttaattattaccaatatggtcgcggtaatattctatttatttctatctcgcctaatctttattttaaattatatttcaattatttattttgccaatttatttttagggtttattcctaattgattattctttactcacgatcaatgaactccgaaatcaaatccaaataaaataggcgaataaaaccggcatgatgcaatttatttaaaaagtttttaaagatccgtatttttagggtttcgattttgtcggtcgaattttcagggtgttacagttactctatatttatcagaatcacacaagtacaatatttgggattgtctatctagccgtcgtcgatatggtggcacgaacaccaacacgtagtcgacgacggggtagtcttcctccttgaatataaactcgtcacgatgagagattgcactagatccctcttgttggtcttcacaggcaccagattggatctgtctaggctaatctctgatgtcgatatctggctttgtcttggcttgtgttggtctcctcccccttctttagggggtcttgtatttatacccatagatgtcccattgtccaaacataactacaaataccaatatggatacaatttgagtagtccatatagttttcatatagaactctacttgtccttacttatctggaactccttctatatacgagtaataattccatataagactgtatataatgggccccgccgagtttagtcgattactattgggtatgtggtatccataaccatgatatatacactgtttaacaaaatgaatagaccactaaaaaagttatagaagtaatttgcgaggactgtaaataaaataaaaaaatttgctccatgacactttgaggcatttgctctataaaacctactttttacagctttaccctaagatactctggttatacggttatctgtcaaaagacactccgataattaatttatatagagagataaaatcttttaaaaaaggttttacctttggacaacttgcaagctttaaatttcaaaattttggctgactttaaacattttatgcaaattaaaaattttcccaaataccggaaataaaaaacagttatttaaatccagaaaatattggtataaattttattttatctttttttttttgcaattgtcatttagacaatttgggacaacttttgaatttgcaaaaaaatttaaatattagctattatttgtttgaattcaattcatacgaatagtcaatctttttttcaaagttatatatgtctctattggaagatggtattggaatagggtctctttttttttaaacaatagcgtgcttgacaatacaccacaaccgaataatgttatagcaaataccatgaatctagagtatcctgaagtcaagagacctcaatcgtggttcctctcgtgcgtaaactctgctaatcccataggatcaatagccttgataaggacagattgagcatatataaggctatgtttagctcttagggttgggcattaatcccttgtacatgtaaaataaagcgacttgaacaacttttttatagaaaaaaaattgtaaaatacacaccgtttaacagtttataaaacgtgcttgcgggagagtggaggttacgaaaaataagaaacacacacagcctaatacatcatttaataataggcaacaactaggagctacaaatatcatgctcccttcagcttttaatatttgacgtagttgacttttgaatgtacctttaactattcatgtaatcgtgttatttaataattttgtgcaaatatgtaaaaatacgagtcatacttaaaagtacatttagtgaaaaaacaaatcacaacgaaaataatattacacatatattttaaaatttaatgacgttaaatattaaacataagagggagtactatatactccctccttatttcttattttaatgtatgacgacgttgactttttaaccaacgtttaaccattcgtcttattcaattttttttgtgcaaatataaaaatacttatgtcatacttaaaaaatatttgatgataaatgaagtcacaataaaataaatgataattacataaattttttgaataagacgaaaggtcaaacgtttatcaaaaagtcaacagcgtcatacattaaaatacggacggagtattatgtagtgtgtgcaaggcacatttctttacgtagaaacaaatcttgtttttcttatttcactcatcatcaatgtcaggcaaaattcacccccattatttacctttgtacatggcctaatacgattgttttgaatcgaaagaggttcaaataattacacttgactaaatgctagtagtagctatcatgttgatccagggatcgtggcttggggtggtttccatgagaatactctcgaccaacttgcattattcctcctttttcctctttcagacgattcagacaatgaaacggacgctacctacgggctatggcagcattgcatgcatgttgccaacttgccaaggaggcttgtactacttccgcagtatcttatcctaaaatgagttacttttttacctaccatattttctcaactaatcattaatattcttcaattaatttattcaacaatttttttctcaatcaaccataatctttccttcaattatttatacctatttccttaaaatttatgttcatattaaaaatacttacaattttgaaggaggaagcatccttttttagcccgattcccgaagctagctaccgtgttaattcgagctactccactatttagagcaggcacaataatagactataaatcagttataaacatattttaaagagataaaaaaaagagaaaagagcagcagactatagatatgtaaccagctgcagcacggattccaagacgtaatgtgtatatgccagttgggattatgtattaatagtgtagtaaacaattattatatgaattggctattatattggctatagatgatttagagctagtagttagctatactattaaacttatactattaaacttgctcttagcttcattccatcccactgcccccaaactgctgcatctacggcaaaaaatgctgcgacgctctttggtcgcccatgccgttctcctcttcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgcctccgcctcccccaccctcttcgcctccggcgtccgcggcgtcggcccggacgccgtctacggcctcctgctctgccgcggcgacatgaacccctccgactgcttcgactgcggcaccaacgtctggagggacgcggggccaacctgcaaccgcaccaaggacgccatcctcgtctacaaccaatgctacgcccagttctccgacaggggcgacttcctcgccgccaccaacaactccggcgaggtgagcctcctcataagcggcaccaacatcaccagcaccgacgtcgccggctacgaccgcgcggtcaccgagctcctcaacgccaccgtgcggtacgcggtggagaactccacgaagctgttcgccacgggccagcgggtggggaacgacacggggttcagcaacatctactccatggcgcagtgctcgccggacctgtcgccggcgcagtgccggagctgcctcgacggcctcgtgggccagtggtggaagacgttcccgctcaacgggaagggggcgagggtcgccggcccgcgctgctacctgaggtccgagctgggccccttctacaccggtaatccgatggtgcggttgccggtcaaggccgacgagctcacgcaggtaagaataattcaggaagcaaaattctagtaattatcttgccgatagtgtcagttgcaatcatcatagctgtaatttccctctgtatctggaatgcacgtaagaagagaagattggcaaaagcagagcgtcaccccggaagtgagtcctctgcacacaattaggcataaattcttgttaaacattcttataccacgagcatccattaacagtttagtcaaaattatgcaaacttgccagctgatacaaatgaggactttgaaagtgtcaagtcaaccctgttatctctggcatcactgcaagtggcaacggataacttccacgaaagcaataagattggtgaggggggattcggtgccgtttataaggtatggcatgagtactcttaactttttaacttttgtatcattgttgatttctttgagaaaaagttgtgtgatttgatggtgtgaacccagaatatggtcaaaaatataaattctagatggctagaagtacgattgcactactgctcaattgttaattaatcacaaattgtggtgtacttctcttcttgaagtatatcgcagaggtttggtgcactactgctccagcccttggttttagataaaaaaaaaatgtgacgtcccagaataattagaggaaataataataaagcaggacgagaccttagtccttgggcctccagcagtagtagagcaattggcccggttgaccttgggccttcttgacccccaggacgagcagcggcagttgggctaggcaagctagctagctagctggcagatcacacgcagcagcaagccagcaacagcacatcagaaatgttccatatgctgccaaataggattaaatgatcagccaccctaaatctaaatcaaaagacaacatccacgcaaactccaagtaaaacgtgagagtattatagatattactatttgaacattatatgtgatatagtggatatgttgccaataaaagacataaataaaattagaagtagtagtcacatctattataacacttgctcttagtttcaacttaggagtttaagctgatccatgactataatattggtttaaacttattgcgtgaagcgagaacgtaaaacatgatagtgttacagtgtagggtgtattccatttagatgagtcgggtctaaaatcgtttttatctagtcgggcctagaattattttgggctataagcgttatatagtaaaatatatgcatgtgtgtagtctaactaaataagttgagcctagctataaccttttttttttcataatggacgttacaaaaagcaagaaaatatgaatgtctggttgttaaacttattaaaaagtcatctgagtccataaaattacaaaatacacatctctatccataactcttggtttaacgtatcacatgggttccaaagcgcacctataaatatttaagaccaaatttggtcaaaatttcaaattttgtatcatcaataattccttaaatgattaattagtttaaaggattggtatatattgatttgccttaaaattactactctcgtgatattataaatttactagtactaatataaaataaatggtccaaaatacaaaagttgatcgaaacttatcctaaatatcaaatatttatatccaggaggagtaagatactaagccaagtagttaaattattcagggaattcttcatggacaagaagtggctgtgaagaggatggccaagggctccaaccaggggctggaagagctgaaaaacgagctagttcttgtcgccaaacttcatcacagaaatcttgttcgtcttgttggtttttgccttgacgagggggagagattactcatctatgagtacatgtccaataaaagcctagacacctttctttttggtactattagcattaccctttttaacctacatattttgtcttttcactccatcaataacaatttttttcttttggtaattagatgcagagcaaaagagaaaactagactgggcggtaagatttaagataatagaaggcattgcccgggggctacaatatcttcatcaggactcccaaaagaagatcgtccaccgtgatatgaaggcgagcaacattttactagacgcagacatgaaccccaagattggggactttggccttgctaggctctttgggcaggatcagactcgagaagtcacaagccgtatcgccgggacattgtaattaagtcgaaggaacactcattatttttcgctcatatatagataacaaactaaaatgcaattcttctttgatgcagcggttacatgcctcctgagtacgtgctgcgcggacagtactctacgaaatcagacgtgttcagctttggcattcttgtcatagagatcgtgacaggccggagaaggaatagcgggccatatttgtctgagcagaacgatgaagatatattgagcatagtgagcatccctactaattcattgaggaatacatgcctattgtaattactgctgactaaacacatatgtgtgactaatgttgctaggtacggaggcactgggaagagggagcaattgcagagatgattgatcattccttaggaagaaactacagtgagaccgaggtgctgaaatgtgtcaatattggactcttgtgcgtccagcaaaaccctgtagatcgacctacaatggcggatgtcatgattttactcaatagtgacactacttgcactatgccagctcttgcacctaggccagcatatttgatcgatgggacctctggttactcccagaccgtaacacaatggtccggcaggtagcagggggccgaagcagatctagcaccgttgttggcttgttgctgcttgctttgttttatattgtaagtgtatcagttctcaatttgtattccatgataaccaagttcaactaataaagagtaaatatataccattgaccagtttgtctcgctcaatgtttatcatcgagtttgtgtccatccatgacatattccaattacatgctactagttattactccctccattcctaaatgtttgacgccgttgacttttttaaacatatttgaccgttcgtcttatttaaaaaaattaagtaattattaattctttttatatcatttgattcattgttaaatatatttttatgtatacatatagttttacatatttcacaaaagtttttaaataagacgaatggtcaaacatgtttaaaaaagtcaacggtgtcaaacatttagggaagtagggagtacaatataattacgttatactccttataaaatatagtagtggtggtgatgattttgtcaccacctacttttgcgggaagaaaaaaaaaagtggagctaagagcatcactaatagaatgtgtaaattcaatcttcaaaattctgaatttgggaatcctaaatgaaatttgataagttacagaagtgatccttccaatagattgtgtaaaattgactctctaaaatagaaaagtggaccgcatagtaaactatcaactaaaaaaaatcagttatatattcctcctccttccgcgacggcgaaggcaccatcacatcgattgttgtttacaaatacacgagtaatccaggtcgagcatgtttaactcaaaagaatcagttaattacgcacatcaatttacggagagatgggcatgatcatcagatcatggaggaagaaagaagtctagactctacgacgcaacgacgtgttcgtcgaggcccccgatctgtttctctcatacacgatcgggtgctacttcggcgcctcgatcaccttgattaattgtgcgctagctgccgcttcgcgtcctctgcttcttgatacacttcgcggagcttgcgctttgcagcgatcatggccttctcgtcggtactgcacgacgacgtggcactctcgcggcggctcatgttggccgtcctcttgggcggcgatggctgcaggattttggcgtgatggtcgtcggtctcatcgggttccagcacctgagagagcttctccatgacggctgcagacttgaggagctcgtccttcacggatgccctccacccacggacaaaaacatttcgcccctcgcccgggaacgggaggagagaggcgggagcgtgagattgggagtggtagaggcgagatcgtgcgccctcatatcaaccgagctaggatttgggagatggaactccagaactggatttttcaccttttagttcttttgaaaaaaaacttattctacaaataaatccttaaaataacttattttagaaatggtgcttttcgcggcgccaatgtagttggtgccgtggtccaacatgacagcaccaaggacgttggcgccgtcctctccaccctcgggtgaaagctaagtcactaatgtgaaggagaacggcaccaccaacattggtgtcgaggaaatttgcaaaaaagaaaagaaaagaaaaaggacctagttgtaataaaaagtgactcatttgtaaataaaaagaactcggaaacttcggcaggagagtagcggatccgttggagctgtgttttggactaaaatctctcaaattcaattttcgaaatgaaatactctctccgtcccataatataagggattttgactttttgcttgcattgtttaaccattcgtcttattcaaaaaattttagaattattatttattttatttgtgatttactttattatccaaagtactttaagcataactttttgttttttatatttacacaaattttttgaataagacgagtggtcaaacagtacaagcagaaagtcaaaatcctttattatataggataataagacggagggagtaggtggatagttggtgatgctctaacaagattcacatataagtaacaaatacgtacaacaattaagagataataataacatattaataaaaattttctttaattggaaacccgttgccatgcacaggcaatatgctagtatactagagtaatatttgaaagattttaacaaaaactgtcggaatgttatatagtttctcccttccacaggcaccatgcaggcaggccggcggttggtgatcatatactcatatcatgtcatgtccttttgctcctcaccgtgctcgtacgtacgtgctgcccgacgctgatcacaccggccgagccgaacgtgctgggatgcgcgcgcggaggacaccggcacatacgtgccatcgcctcaccgcgcgctcatgtaggagttatatgttgggtgccggccggcccgcatcgacgagagaggcggccatgcatgcgtgcgtgcgcgcgcgtgtgccgcgcgcgacccgcgaccttgctgcctctctccagtccaaatatagtccagtgactgattcgtcgcgctgcgcgtgctctcctgactgaaaataggcgtatattggcaaatcctaccctttattagccgaaaacctggcacggggtcatagttgaatcacgacgtacagcgcgcgtggttacacgcctccaagtttgaacgtatacgtacggtaaaaagtggaacggtttacacatagccatgcaccgatttttctcgatatcattccatacgcgaccgcaacagtcattttgagttagaaatgggtcaagtttcatttgactaattaagcgatatatagcatgcgtgttccttttttaaggcagggtgcaaacagctgctacagagaggtttccgtgatgtcgacgaatatataattagtccctgtcccacgtgccatttgacatccaccagacgggttcactgaattcagtctgacctgtcggcctcggccaatcggccatcgcatggcaattgccaagttgacaacttgtcaagagccatcacttccaaaagtataggtagtactgtactaaaagcttgtaaaaaagagaaaaaaaacaagaagatatgatacggagatggattctaatagctcgagtggacgtccacccgtttattgcatgtcaattagatggttacgaaaaattttcaaaaaaactaacaagacagatcaatatataatatattactccaacgaacatgcaaattcaaattcaacttctacaagttgtaacaaaaataacaaatttaattgtaaacatacctataataatttgagttttttttgttatttttattacaatttgtaaaagttaaattttaatttgcatgtttgtggattgatatattacatattgatctatcttattcatatttttttaatttttttatattcatctagataacatgcaataaatgggtggacgtccactggctattaaaacagtttaccgatatgatactgcagtagtggagtaggtaccattagcagaggattgcaaatttgcaattgcaatgcaaagcccgacgatcgaacaagcttgctctgacggcgccatgcggcggcgctcctctgtcctccatgccgttctcctcctcctcctcgtcgcggcggtcgcgctcccgctcgccgccgcccagccatggcctgtctgcggcaccagcggcggcaactacacggcggggagcacctacgagtccaacctcctgcgcctcgcgagcaccctccgcgcgaacgccttcggcttccccaccctcttcgcctccggcgttcgcggcgccggcccggacgccgtctacggcctcctgctctgccgcggcgacatgaacccctccgactgcttcgactgcggcaccagggtcggcgacgacgtcgcccaggcctgcaaccgcaccaaggacgccatcctcgtctacaaccagtgctacgcccagttctcggacaccggcgactttctcgccggcaccaacaacttccggcgcgtacagcctcctcataagcggcaccaacatcagcagcgccgacgtcgccggctacgaccgcgcggtcaccgagctcctcaacgccaccgtgcggtacgcggtggagaactccacgaggctgttcgccacgggccagcgggtgggcgccgacccggggttccgtaacatctactccatggcgcagtgctcgccggacctgtcgccggcgcagtgccggagctgcctcgacggcctcgtgggccagtggtggacggggttcttgttcccgcggaacggcgagggcgcgagggtcgccggcccccggtgctacctgaggtccgagctcggctccgggttctacaccggagctccgatggttctgctgcgagccgacgggctctcaccggcgtcggcgccggcgccggatgttgttccggccactacgttaggtgagcagcataccaattactctacccatcaaagtgatcacgtcacgtctcttcagtcttcacgtcatctgcacctaatgtttactcatctccgatgcttgaactgattatttttcactgaaatatgcagttaagaagaattcagcaagcaaaattctgctaattgtcttgccgatagtagcagttgcaatcgtagctgcaatttctgtctgcatgtggactgttcggaagaagagcagagcgacaaaagcagagcatttgtccgaacgtgagtcctctgcacaaatacaatatggcatcggattgtttacaaaccccacttaaaattcttaatcatcagtatgaattgattgttctatcgaatccatgcaaatttttgcagttgatgcatctgaggaccttgaaagtgtcaagtcaaccttgctaactctgggatcactgcaagtagcaacggataacttcgacgaaagcaagaaactcggcgaaggaggatttggtgcagtgtataaggtatgccagtagtctttatgtgtaacttttgagtcattgctgacttctttttcaaaaataattgttgatttgatggtgcgagtcaagcatggtcaaaagctcaaaatatgaatatctaaaagtttttctccattgatgatgatgatgatttttattttctacaaaagatctttcgatctttctttattagaaacaccaataattgtaaactattttacagcactcaggtttttaaaccattacaaaatacagtatatcaatgaaaagtaaaaaatatgcaggggcatctttttggacaagaagtagcagtgaaaaggatggcaaaaggttcaaatcaggggctagaagagctgaaaaatgagctagttcttgtcaccaaacttcatcacaaaaatcttgttcgtcttgtgggtttttgcctggaagatggagagaggttgcttgtctatgagtatatgcccaataaaagtctcgacacatttcttttcggtaatattaacacctcctttcagtatatatggtcatgcacttctttctcatgtgatggtgtgcaacaattacaatgatgtcttcatttggggctaattagacgtggagcaacgaagacaactagattgggcaacacgatttaggatcatagaaggcgtcgctcgtggattgcagtatcttcatcaagactcccagaagaagattgttcaccgcgacatgaaggcaagcaacgtcttgctagatgcagacttgaaccccaagattggggactttggccttgctaggctcttcgggcaagaccaaactcgggacgtcacgaaccgtatcgttgggacattgtaattaagcagaacacttgaagcttatgtgccaatatttcacttaaaaactacgtactaacatgcaatttcattcttactgcatgcagtggatacatggctcctgagtatgtgattcgcgggcaatactctacgaaatcagacgtgtttagttttggcattctcatcttagagattgtgacagggcaaagaaacagtgggccctattttgcagagcaaaacgaagatttagtaagcctagtgagtatcccttctaattcctacaaatcaatacactaatattgcttatgtttccagaaaaccactcatatgtaccatctatattactgataactggagatctatatataactaatgctaggtatggaggcactggacagagggaaatattgtagagatggtagactattccttggacagaaactaccctgaagccgaggtgctgaaatgtgtcaacatcggcctcctgtgtgtccagcagaacccagtagatcgacctacaatggcggatgtcatgattttgctgttaatttatagtcatgattagttataaacaaggtgacaccaatgaggtaaatcaagaaactgttgccaaatttcaccgttaacagaaactcatgaggtcaaacccgtctattcaaaagctattattaggccttgttaaatgggcttcaatccagctcaccaacatttgtaggccggtaatttgaactaaagttcaatgcatgcaccagaatctgtcaagattatgacccatccaatagaggtttaacatgatggattgagaaattatcctctgaaacaagaccatcaatgggaacacaaaatgggcttatggcgttgtatgacacattttcacgcagctgcgcaaggcatgagtctatagtgtgacttaacgagaacgaaaaacctatcgagcgatcgatcgcgaggggcgatcggttcccctcccccccacgcagtttccatttttggcaccgctttactttcctcttttagtaagtttatacacctaaagtttacacatctaaaatttatccacctaaagtttgtagagcgaatatttatgcgtcaaaagtttatatacccgattcaaatttaaattcggattcaaatattttatatatagaatatttctatacgtaaagtttatgtgtgcattatttttctcttttagtaagtttatacacctaaagtttacacatctaaaatttatccatctaaagtttgtagagcgaatgtttataagttaaaagtttatatacccaatccaaattcaaattcggattcaaatattttatatatagaatatttctatatataaaatttatgcgtgcaaagtttacggtataaagtctatgcacatgaatgagagtattaattttttttctattttttttactaactttgtttttttaaaaaaatatatgatgaaaagagagaagggagaggagtataggggaggggcgggtcccattaggggcgcccgagaaggaagaccagacaagcaattatattgttaaacagtaacctcgagattagggtaggtaccagtcttccaagctaacatattgtttttctttgtaaatacttgtttagcttaaaaaagtgcatgcacgcctattacaacctgctaatcattaattgcgaatttcaaacttaagttagtgaagtagttaagtgaagatttgcatatgttacatatttatatttggattcgtagtactaggcatgtatattttgagatgggtggagtaatttataatttaattattattaaattagggatttgctacccatctacctgctattgtttttggttttgtaagccgaatttgtggccgctagatcactccaagatttgtgttgatttggctcaccaagataacctttgatgtaccttgttcatacgcctacattactcgcgagggggggggggggggggacacgcaccaatccccccttcctatttaaaactctactctcctcttcccttcctcctcctcacctttttttttctctgtctaggtacattccatagcttcgtttcgtgagatcaatcgattgagctagatgttagctgcaggagaaaggtttctaggttgtagaggagtagcgtgagggtgaggaggttgtggatgaggtaggcattgtgacggggagggtggagctgaagcggatcgagaacaagatcaacagacaggtgaccttttccaagcacaagaatggtctggtcaagaaggcgtacgagctcgtcgtgctctacgatgccgaggtcatgctccaccttctacatccgaggcaagctcaacgattttgctggttggggtcctagtatgtgcggctatgcgtgcgaacatgttgacaataatcccattctaaaatgttttgtagccatgcatgtagatgcatattgagtcaatgttgttatgctagcttttttccaaactttaaatgtggctagatatattatgtcgtcaataaataacaccagaattttgtggactagttttgttaggacctgaacataataaacaagaatagtcactagacgggaaactatatattttaatccctcgaggggacatcgttatttgcatgttactcaaatggttacgaaaaaaattggaaaaaattaagaagatgtattaacatgtgatataacactccacaaacatataagttcaaattcaacttttatatctcgtaacgaaaaaaacaaattaaacaacatctagttaacgtatatttacagtcaaatttgttttttcgcctattttgttagctaaaccaaatatcttaatgtcagttttgtcagtgcttggtggtcagttttgttaaagttttagtttcgactgaatttgtataagccaaggagcaatttggtcaacagttagttttgtcagcaattagtacctgattttgttagttttgtctgaattcatatataactaaatgcagttttgttagcagctagtttaatcaataattaattagttcatggtgttgttagttttgttggctactaaatatgacttgatctaattttgtcagcagttagttttgtgaatttaaaacttggttcagcttggttcaacttgaccaacttgaccttggaaggggtccccttgggatccttttgtaaccttgcttgtacaagctcggtttccctctcttctccttttatgaaataggcagagctcctgcttttacccctcaaaaaaaaacttggttcagctagctctagtaatttcatggaagctagttaattgacttcttgatttgattatatttttgtgagcaatcggtatctagttttgttagtttgtcagctagctagttttgtctgaattctactaatagtaattaggtcaataagccatttcaatcaaatacaagttgtcaagctgatctgcccatttcactagttcaaattcctgcagttgatttgtattccctgctttagtatatagatttatcagttacatatatatgtcaacatttcatacacgtaggtagtatagatttattttattttattttagtgtagggttgtaatcttgtaattttttttcctgctatatcaatatgaactttgcactgtctagtgcgagctgtaaaaaataaaagaaatagcggctatgagttcgttcccaagatactgttaatctcgacgaccaacttgaataattccatttccctttttcttcgttcaaacgatgaaacacgtctgcatgcacataagtacacacgtacctaatggtgatcagagaattcagtctatatggactatgcatggcatgcccaacttgccaaagacgagatcaatatccttctttttttttgacgcgatcgaatatcctttttaaggggatgcaccccgtgttagttttatactgccatctatcccacgcccctagctagctgcatcctagctctatcggcgcaatgttgcgacgccgacgctcgtctgtcgtccatgccgttctcttcttcgcggcggtcgcgctcctcgagtcgctggccgcccagccgtggccgaaatgcggcaacggcggcacgttcacagcagggagcacctacgaaaccaacctcaagaacctcgcgctcatcctccgcacgaacgcctcctcggggtcctcgcccaccctcttcgcctccggcgccctcggctccgccccggacaccgtctacggcctcttgctctgccgcggcgacctgagctcctccgactgcgccggctgtggcaccaacgtctcgagggacgcggtcgcggggccgacctgcaaccgcaccaaggacgccatcctcgtctacaacgaatgctacgcccagttctccgacaagggcgacttcctcgccgccaccgacaactccggcgagtacagcgccctccaaagcggcaccaacatcagcagcaccgacgtcgcgggctacgaccgcgcggtcaccgagctcctcaacgccaccgtgcagtacgcggtggagaactccacgaggctgttcgccacgggccagcgggtgggcaccgacccggggttccgtaacatctactccatggcgcagtgctcgccggacctgtcgccggggcagtgccggagctgcctcgacggcctcgtggaccagtggtggaaggggttcttgttcccgcggaacggcgaaggcgcgagggtctccggcccgcgctgctccctgaggtccgagctggggccgggccccttctataccggcagaccgatggtgctgttgccggtcaaggccgacgggctcacgccggcgccggatgttgtgcctgccattacgggaggtgattaattaaactacagtattatacttcctcgtctcgctcatgctgtcccatatttttcccgggtaattttgcacggggcttgattttaactgttaacttaaatttgatttatactcctcttagtttatgttacatatataaagggagaatagccaatatgatccctaaaattttgctcctagatcattttagtccttaatatttcatagtgtccaaacaagtcctttaaatttgtcacgtgggctaatattgttcttggtcctaccaaaatcactatatggacatgccatgtcaccctcctatgtaaaatctatatgatttgtctaatttactcttacgtatatcatagaaaaattagaaaaaaggaaaaaagttaaaaatatatatatggtatatgtaagagtaaaaatatacgtaaaagggtgaaaaaaatgggaaaagtatttgttcctatggttatgtctaattcacccttacattctttttctatgatatacgtaaaagtaaattgggtaattcatcatagattttgcatgaatgatgacatggcatatccatataatgattttttggacccaaggattattctaagccttatgaaaaagtttaagggttttttagaccattaaaaggttagggactaaactaatcctacattgaaactttatggactatagtagctattctcccttacataaatatgattatattacatatgcaactagcgtacagtctgtgtgttgcaacggttttcttttaaaaaaagagcaattttacggtacttgagaaggtaccatgaggtacccttttttctattgtaaatttggattctctcggtacctaggtactatgaggtaccatgaggtaccaaattttacactaaatttttggtacctcatggtacctcctcaaagaccgtagtgtattgtatatatttttaaagccttaaaaaactatttctaccgtgtaatatatcaaggagcgatgaaaattttatattgaaggaattcgattattttttaggttttctctcactttttgcgtgcacatattgttgttggtggtgggtatcttttactttatgtttttgtatatacaaattaatttatatacaactattgtcgatccatttataccatttatagtcaaaattcttttcttttcttttcttttctcatgagatagatagatagattgatggattattatcaagcgaaaaaataactaaaatttgttcactgagcagcagctagaagcatagaactgtattattgtgtaatccgtttcatatttagttcttcacgtacttgaactcattatttttcactgcaaaaatgcaggtaagaataattcagcaagcaaaattctggtaattaccttgccgacagtgacagttgccatcgtagctgcaatttccctttgtatctggaatgtgcgtaagaagagaagattggcaaaagcagactccagacgtgagtccctgcacataattttggcataaatattaacattcttatacactggcgtccgttaacatttcgtcaaattcatgcaaatttggcagctgatagaaccgaggattttgaaagtgtcaagtcagcactgttatctctgacatcactgcaagtggcaaccgataacttccacaaaagcaagaagattggtgaggggggattcggtgaagtttataaggtaataggccagtagtctttacgtctacttctgaatcattgttgatttcttttgagaaaaatgtgtcgatttgatggtgtgaattgactatggtcaaaatataaattctaaattaaagttgtgtttagttgagcacaaagtttggattttggttgaaattgaaaatgatgtgactgaaaagttgtgtatgtatgacaggttgatgtgatggaaaaggactgaagtttggatccaaactttggatctaaacacagcctaatactcccttcgtccctaaatatttgatgacattgattttttttaaacatgttggaccgttcgtcttattcaaaaacttctatgaatattattaaaaacttaagtagtagtagtatatgtaacaatgaatcaaatgataggaaaataattaataattacctaaattttttgagtaagacgaatccggtcaaataacggcgtcaaatatttatggacgaagggagtacctagaagtatgaatgcactactgctcaattgtgagtgagtcgcaaattttgtgttctcttgaaacaaatggcgaagctcctgcctcttgtttagaaaaactattagtgcaggttagttattgtattttattaatagtgaaaatatattacatcctcgactttagccatataatacataggtaacaagttaacttgaaaaagacataggtgatgggacaaatcctcaaatacctttggaagaaaaccaattgatagacttaaaaagacacataaattctagcaaaaagtaagcctatatgtattacgccacccatagaaagtaaaagacctttggtaactaactctaagaatatagcataatatactgctcctcccatcgtaataacatagaccaacatttggatcagttggacgataagaagataacctgcattgcagagttagacatcatttttctgttataaaaatcttttatcattttttttcaatgccaaattgatgaatttcaagtgtctaggcactccccgaagcgagttactatttttttttgggcacctcaggaggaggcatattgtaaggaaaagaacacattgtcgtgcaaaatgagcaacatggcaataaaaataggtcttgaattgtttcttgcacattgtagacactatattgcttgtctcctctccaattccttttatgaaggttatctttcattaagattgctttttctataaagaaatcacatagaaactttgattttttatagtaacctttaaaattagttatgttatattattatatttttaacccattacaaaattttgtatttctgttcatgtctccatgtataagttagtaagaaagtaagatactaagctaaattatttagggagttctttccgggcaagaagtggccgtgaagaggatggccaaggactctcaccaggggctacaagagctgaaaaatgagctaattcttgttgccaaacttcatcacaagaatcttgttcgtctcattggtttttgcctcgaaaaaggggagagactgctcgtctatgagtatatgccaaacaaaagcctcgacacccatctttttggtactattagcattatctttgatcatttgttactcctgtaatcatttcactccaccaataatagtgacattttttttacatttggtgaaaaaagacacagagcaaaggaaacagctagactgggccacacgatttaagatcatagaaggtaccgctcggggactccaatatcttcacgaggactctcagaagaagatcatccaccgtgatatgaaggcaagcaatattttgctggacgctgacatgaaccctaagattggggactttggcctcgctaagctcttcgcgcaggaccagactcgagaagtcacgagccgcattgctgggacattgtaattaagttgatggaatacttcatatttttgtgcttatattaactaacaaactaatgaaatacaatcctccttgctgatgcagcggttacatatctcctgaatacgtgatgtgcgggcagtactctacgaaatcagacgtgttcagcttcggcattctcgtaatagagatcgtgacaggccaaagaaggaacagtgggccatatttctctgagcaaaatggtgtagatatattgagcatagtgagtatccccggtagttcacataggaattcatgatattgctttgcattgcaatatttgcatatttgtggatagctgcacatgtctatcgtaattactgctgactgctgaagacatacatatttgtgactattgctaggtatggaggcactgggaagaggggacaacagcagagatgatcgaccattccttgggaagaaactacaatgaggctgaggtggtaaaatgcatcaacatcggactcctatgtgcccagcaaaaccctgtagatagacctacaatggtggatgtcatggttttgcttaacagcgacgctacttgccctctaccggttcctgcacctaggccaacatcttcgattgatggaagctctggttactcaacaggttactcaacataatggtctggttggtagctgggagctagatttgtcaccgatgttgttgctttctgttgtttcatattgaaactattcattctcgatttgcaatccgtagcatccaacttcaattaatgaagagtttcgggggactattactcctcaggggttatatatagtttaactagttgataccccgtgctttgttgcgggatatgtgaatgaatgcatgttatacattataaaaatggtaaatgtatatgtttaaataatgtgaaaatgatgagtagataataatttgccattgcttgtatattgagttctaataatacagcaaaattgtaaatgatacgtaatgtttgcatgatatttaaaatactctagataataattgctagtgtgggtgatgatgtcgcacacttgcatgatgagttttaggagttaatgggcatcaattttatagtaagaaaggattaatgaaaagtgtccacattgggagattcctatcccattcaatctctcaggcagctcgctccatgcttttcgtctcaactccttctctcctctttatgtgttaaagattgggttcagagatagccctttccattgtgaaatcaagttgttagattcaacctatatgatgaacaaatagtcaaaagtgagtgttttagaaattatggtgaatactgttttcgcgggtaaacagtgcagggtggcactaggttgccggtcagatcggcagattccgtggggagttggtttcggattgttttcgtggaatttctatgttacttcatgtttatgacttctagattgtttctatatgtatgtaatattgtttgtgtgttgatgtcagtcaatttagtgtgaacttgtactcaaatatggtatttctttgttagttcatgtgcaaatattgcttgaggccataggagtatagccagtgatagattaggactaggcttgggagaagctgagatccaaacaatcaaggatatcacgcgggatgtctaggctagagaacaatgcacgtggagatgaaagtttccatatatcatacacgaggtgttgtgcaagtatagaaagagtagtcaaatttggattggaatccaagtttggaaagattagagtgtggagttgtacggggatgttgtttctctggtttcttagatttcctatgtgattagaagtctagttctagttggattcctagttaggggcattcacgttatggtataaataaatagggcatatttgtcacttgtttgatccagtattgtgaatttcctattatgggttaattggatcatagcattacaaatttgtctgtttggaaatatgctattataattcatctaattgaaaagatgccattgcaatacttctaaaatctggttcatgccattttatacgcttgagatgggttttgaattgtttttatatattgtattttcgtatggaccaaactaccgttggtcttcagtcttcacagcttaaaatcatccccaaatgtagctccaaaccctagccgagcgagcgagcagtggcgatagcagagcaagcggcggtggcggcggaggctccggcaccggcaccgagggctttcgctgtggcgacgcaacaagctgcagcggtgaagcaagcaacggcgacgacggagccagcagggcctcggcatcacgcacaaagcaagtggcagcggcgctggcagcggagcaagcagcggcggggcaccgagggcttcggcagtggcgacgcaccacaagcagcggcagcggtgaaggaaacggcggcggcggagacggcggcagcggcaacgctggccgcggagaaagcagcaacggtcgcatcgacgacgaagcaaacagaaggtggcggaggcgagctagtcctagtcgcagcgcgacaagttcttggagacaacggcgagctccagtggcattttcctttcctttttcccttttttttctcctctctgtatttttttcaggatcaaatactgcatatcgattctgaatttttttttaacatcagcgatttcagtttatttatttgaaatattgtggttcaaatctgtttttttcattgcactggcacgagcgatttcaatcttgatttgaaatgctgtgggtcgtatggtgatttatttttacggtgcttgagtggtaggataaggggtagtttggtctgtacgaaaatacaatagacaaaaaccgattcaaaacccatctcaaacgtatagaatggcatgtatccgattttagaagtattgcaatggcatccttccaattagataaattataatggtatattttaaaacagataaatttataatggtataaatctaattaacccttataaaatatgtaactaacaaattagactaacaccgttagaaggctggttttcagaaagaataggataaggatacccctgcacacaaaaattcaagattgacatcatatttgccataaaaagcttacatattgatttgccctccaaaactgatatggtcaaatgagattcaactctaacaataattgtcaagaagccgaaccattcctacaacataagcaaaataaataaataaataacggtattgctaaaaatatgtcgccacaaattacgatagatttcagttggttgtttcaaccgtcggatgcagaaatcgcacgtgtacacatatccctccgattttgttctcttctgatctcttctgttgctttaatgttagtatttgctaagtaggattactaattaatcttaaaaactaaatattggtgtcatcacaaatttatagttttgggaattacatcaacttacacatgtaattttgagaattacatatgtaattttaggacttacatatgtaattttggaatttacattgtaaatacactaaaattacatatgtaatttagtgacttacaatgtaaatacatagcgactattttttaataaaaaatatggcgccataaatatagctactcccataaataaatgttctagctagtagatcaagaaggatcggttcagaacccacataaaaatgcataataaactagctagggggtcgcaagcattttcgatgtggagtatgtaatgttccatgttgctcctgctgttgccttgttgctcctgacgcgtgctgctgctgccgccgcccggctgttgctcttaacgccgccggcagctgctgctcccttgccgccgccacctcctgccgcctgctgctatactgccctgccgccgctgttgagggggtttggggacccattttttgggttgatttgctcttgatgtggagaaagtgacgaggggatttggggattagggttcctagagagaggagctgattcttcacggtggagtgaagagcactgatcagaacagatgggcagtgagggggatcatgttttttctttgttatgaattattttcgtccgtttatttgaactaaatcaaacggcagtggcaaatcgaaggagcacaaaccaagtgttttagatgcactttctaaacacatattgatgcatataaagtcaatatactttcaagagtttcgccgttttgtttttttcttgatcctgacggtctaactggagtacaacggacggttggactggcggcggtagcaacaacatcatcaagcagacaaggagatcgacaggcggtctgaccgacgacgtcatcacaacgatctgaccggtgcaacttcgtaaagtttgagggtaatcttttaattttgcaagaagaattgattttggtgtttctaccatacaaccgcctccggttggcttggttcttatattcgaaccaaccaatattttgctaacattttgtccggttgtcccagtaaagagcaaatatctattccttaccattgtattattttgatttgttcaaaaaattttcatccagttcgtctccaagttacaatgtactactgatttatcaattgcttctactccatgacatattgacaatggattggatagtttttaaaagggttaattggatccatgttactgcaactttgcgaaattaaaaaaatgccactactattcatcatatcggccacatgccactggaaatttctataattaaaactatgccactcccgtccctttttccgtctcctctctcacgccgtctccgttgccgtcctcatcccctccctccttcctcatttccgttcctgacttcatccccctctccggcgagcggtagagcttgaggagggagttggtaacgacagggtcccgttcctgcgcacgccttccctttccctctccgtcgccgacacggtctcctcctccccgccactacatattcctcttgctggtgaacttccattgcacgcgcacaagcacagtcatcacagacttcggcgatctccatggctccatcaggtggggtgcgcgagcgcatcgcacttgaatgcatgctcgtgggcgaggcgcgcaaagcctgtggatggggaaggggcgggaaagacgacgacgcgagggcggcgaggaggagggagaaggtgaacggggtgggcggcgaggcctcgcggatgcggtagtagagggcgagggaggcgaccgcgggcgcacagcgctgggacagcgcggcgtggagcgggcagcctcgggagggggccgacgagaaggcaccggcagaggaggaggaaggtgggctccggagccaaaggagcaggcagcggaggcggtgtgggagctcgggcatggcgggagggagccgccaccgtcgttgtcctctatccgtgacaggaggtctcgggagctgccgccgtcgccgtcctcgacaccatccacggcgggagtgctcgggagccactgccaccactgccgtcatcaccgctgtcctctttgcagtcgcagggatggaggaatagatggtgaagaaagaggagggagatggaaacgattaaacatgggggaacgagatagtgaaaaagtgatgggagtggcatgtttttaaaataaaaggaaaataaaaccgctccctttgccgtatgtgggagttcaaaaaaacttccactaattaaaaacatgccactcccagtatccttttattttgtttttggctctaattaattcaccctaaggtagcactatctttctttttctaatatacgacaccattgactttttgtttacatttgatcatttgttttattaaaagaatttataaatataaaaatatttaagtcatgtttaaagaatatttgatggtaaatcaagttataatgaaataaatgataattatatattttttaggagtagttttttttaaaaagacaaatgatcaaacgtatatcaataaatcgatggcgttatatattaaaaacggaggaagtataaaaagaatctatccatcagacgcacgatgcccaaataatcggacggtcaaatattccagttgaccaacgagcgaaacatcaagttataatgatgaaaaaaccatcaattggaacatttaaaagttatatgaaacttggtaaagatatacgttgaaacatgtcgctgtcacatatgaaacaactagtattaacggattgaagcatacgtttttctttcattaaaatataatcatgtgatatcttattgtaaagatttaattacaacgaatacaacggtgtaatcagatcgtagattggataattagtttaggagaaaaatcattttgaagctcaatagaatgtgcatgtatggataagatggagagagagtagtggtaggtagtttcgggaattttgtaaaatacactgaagacacatacgggtatatatcactatcacgtataaaacattaggttctgacaattttaaatatatatattttttattataatataataatgcgatatcttgttataaagatttaattacaacaatacaatgatataatcggataagcggttaatgagaaaaaaacattttaaatcttgagtagtacactggtcagtctgagcgttcgataaaattttgtgaaatcggtagaccgatcagtagattttcgggaagtatatgatcgacattcttcatgcaagttgccgcgcgactgcctttttcatggggcccgaccgcgcgaaggtgcaagcactcccgtgaccaataatccattgctcctaaattttactccctccgtatttcaatgacaatgttgactttttgacaaacgtttaacctttcgtcttattcaaaaactttatataattataatttattttattgtgacttgatttatcatcaaatgttctttaagcatgatataagtatttttatatttgcataaaatttttaaataagacgagttgtcaaacgttggttaaaaagtcaatggcgttatacattaaaatatggagggagtattaattatatattgagttctacaagtatcttgtttaatactccgtacattttaggagctaattaaacatgtcgaaacagcggctacggggaggtttcccttgagactagtcacgatcagctttgtttatttccattccccttttcctttcagcaactgttatctatcatatcaactgcgtccatgcatgcacgtgggttttgacaagtaagtaagcgaaagtaatttcattttatgcatatcatataaatagttaaaaaaaatttaaaaacatttgataacattgattaatacgaaatatatcactccacaaacatacgaacttaaattcaattaatttctataagttctaaaaaaatacagtaacaaatatagctgcgaatgtacgataattattttcagtttaattttttttacaacttgtagaagttgaatttggttttacatatttgtggagtgatatattttatattagtatatgttgtcaatttttttagaaaaatttaataactatttacttcagatgacatataaacaactagagtaagtaacggggttcagtgaattcagtctgacctgtggtggggccatcgcatgccaagttggccacttgcccagagctgtcacatccaaaatgatacgcattccagctcaaaaactcaaaacgaatgctgtgccattgctacatcgatcgagcttactagctttccatcatcccaccactgcctctgctaagctactctgaccggccggcgccatgcggcggcgctcgtcgctcgtccacgccgtcctcctcgcggtcgcggcggtcgcgctgccgctcgccgccggccagccgtggccgagctgcggcaccggcggcacgtacgcggcgaacagcacctacgaaaccaacctcctggacctcatcagcgccctccaggggaacgcctcctcctcccccaccctctacgcctccggcgccgtcggctccggcggccgcgacgccgtctacggcgtcatgctctgccgcggcgacctgagcacctccgactgcaacgactgcggcaccagggccggccaggacgtggggcgagtctgcaaccgcaccagggacgccgccctcgtctacaaccagtgctacgtccgcgtctccgacgccgacttcctcgccgctgccaccaacaactccggcgaggtcgccctcatgagctccaccaacatcacccgcgccgccgacgtcagggcgtacgacgccgcggtggtcagcctcctgaacgccaccgtgcggtacgcggtggagaactcgacgaggatgttcgcgacggggcagcgggtggggagcgacccggggttcagcgacatctactccatggcgcagtgctcgccggcgctgtcgcggccgctgtgccggagctgcctcgacggcctcgtggggcagtggtgggacacgttcccggtgaacgtggagggcgcgaggatcgccggcacgcggtgtaacctgaggtcggagctgaaccagggcacgttctacactggccaaccgatggtggtgctgcgggccgacggactcgcgccggcgcaagggccggcgccggcggctacgacgggaggtgagcatacaacatactccctccgtttcgaaatgtttgacgccattaactttttagtacatgtttgaccgttcgtcttattaaaaaattttaagtaactattaattctttttctattatttaattcattgttaaatatattttcatgtaggcatataattttacatatttcataaaagtttttgaataagacgaacggtcaaacatatgctaaaaagtcaacggtgtcaaacatttcaaaacggagagagtatttagttggagatgtattttcaatcctcgcggagaactggagatatccgctcatttcttacatatgccatccaaataatctatttaaattaatatgaaaaatatcagtccacaaaaatacatggttaaattcaacttctacaaaatccaataaaaaaaacaaattaaattgaaaatagttaacgtgcattcacaattatattttgtttgttgagaagcagctagcagcctagcactgtgttgttgtaatgaggtgctacatagaagaaaaggtacagtactttggatacttgaactgatcattttctatgcaaaagtgcaggtaagaataattcagcaagcaaagttctggtaatcgtcgtgccgatagtggccgttgcaatcgtagctgcaacttccttttgtatatggaatgtgcgtaggaaaagaagatcaagaaaagcagaacatttctctgaacgtgagtcctctacaaaatttagcgtagaattcttcaaaaattccatctaacattcgaatatcaattaactatatcaaattcatgtaaattttccagttgacgcatctgaggaccttgaaagtgtcaagtcgaccttgataactctagcgtcattgcaagtagcaacagataacttccacgaaagcaagaaactcggtgaagggggatttggtgcagtttataaggtaaactagcatgctggcccgcgcagattgcgcggctagcatcattatattttctctcatataatagcatatttgctttctcattatatttttcaaatatattaaaatgaaacataattttaaattttacaataactttatgaaactactaatgtgtaatattcatattgtatttttatatacgtgttagttattaattatttttaatatcaaattttagttatttgtaaattatatatattcctatatgtactatagacctgtcttttaatatttctttttttattccgaattttctgtaaattgtatttctatatagactctaagctcttcttccaatattatttatttttatttctgaatttttattatttctaattgtatttctatgtggactctaaactcatctttcaatattctttaatttttaatttcgaattttagttacttctaaatcgtattcctatattgactttaaactcttcttcccgtgtttttcttaatttcgaattttagttacttgtaaattgtatttttatacggactctaaactctacttttaattttattatgtgtattctgaattttagttagttttaaattcctatatggactctgtactctacttctaatattccttatttttttatttccgaatttctattctttttcttaattgtatttttatatggactctatactctacttctaatattccttatttttaattccgaatttcagttattttctaattatatttctatatggactctatgctctacttctaatattccttatttttaattccgaatttcagttacttcctaattgtatttctatatggactctagtctcctcttctaatattccttatttttaattctgaatttcagttatttcttaattgtatttctttatggactctagtctcctcttctaatattccttattttttaattccgaatttcagttatttctaaattgtatttctatatggactgtactctcctattctaatattccttattttttaattctgaatttcagctttgctttttctttttcttcgattaatgtgagaatttctatgccatgagagcggactgtactctcctattctaatatttcttattttttaattccaaatttcagctttgctttttctttttttccgattaatgtgagaatttctaggccatgagagcgaacgtggaggctactttttctattcctttaataatataatagatggtactccctccatcccaaaatataaaaaatttaagtgaatataatacattccagtactacgaatctgaacaggctaaaatatatcacatccacccataattctttatattttgggacgggagagtagtagttcacaggtaacttttgaacaattgctgatttccttttagaaaagaattattgatttgaaggtatgaatcgagaacggtaaaaatatgaaattctaaatatgtcttgattcctgagcgcactagtactccattgctaatttgttatagtttatttttacaaaagatctttgatctggctttattggaaaaaccaaatattgtaaattagtagcatatgcatgttagagtcttaagtcattacaaaattcaccatttctgtccatatctccatgtataaagcaaattagctaataaactaagaattattcagggacttctttttggacaagaggtagccgtgaagaggctggcaaagggttcaaaccaagggctagaagagcttaagaacgagctagttctagtggccaaactgcatcacaagaatcttgttcgtcttgtggggttttgcctagaggagggagagaggttgcttgtctacaagtacataccgaataaaagccttgacatatttcttttcggtacaattataattaccttttaatctacatatatatacccctttcgtttgctgacatgcaataattacaataatctcttcatcacgtgtcaattagactcggagcaaagcagacaacttgattgggcaacacgattcaagatcatcgaaggcattgctagaggactacaatatcttcaccaggactcacagaagaagatcatccaccgtgacatgaaggcgagcaacgtcttgctagatgcagacatgaacccaaagatcggcgacttcggcctcgctaggctctttgggcaggatcagactagagatgtcaccaatcgcatcgttggaacattgtaacgaagtcaaacactttatctgtttgtgcttatatgtagctaacaaactaacatgtacatttttttcttgttgttgcatgcagtgggtacatgtctcctgaatacgtgatccgtgggcagtactctacaaagtcagacgtgtttagctttggcattctcgtcatagagatcgtgacgggacggagaaacagcggcccccatttcttagaacaaaacgaagatttaataagcatagtgagtatcctgctaactcatagacaaatacggagtatattgataccgcttacattttaatatttgcatttgaagataaccatgcaatatatgatctgcaatattaacatataactcacaatatgtaactgattctaggtacggaggcactgggaagagggaaatattgtagagatgactgaccactccttgggaagaaactaccctgaagctgagctgctgaaatgtgtaagcatcggtctcctgtgcgtgcagcaaaaccctgtagatcggcctacaatggcagatgtcatggttttgcttaacagcgatgctaccagcactctgccggcttttgcaactcatagcccaacaatttccatcgaggggaactctggttactctcaaaccgttacacaattgtctcctagatagcagggggctaaaacatagttggtactagaaaataccccgcgagttgctgcgggatataatgtatctaaacaaaatgaagtgaaattctaagagaacaattgatccatcacatttagacatagtgcataccaataaaagaaagcgaaattctatgaggacatttgatccatcacatttaacatactatatgggttggataggtccaagtactccttagcagagcttcatcctgtttcatcgattataggaaaatgaattttcttgactacaaattttggaaataatacaaactcatcttatgaggagattgtgaaacttgcgtaatatatgtgtaaggacaggaaaggtgtataacaatcaaagacctgtttattgcgctatgctacaaattaaatgaggattagttgtactattctttttagcaatatatgacagactgatagagatatataagagatggcgttatattatttgattggaataaataatattacaataataaataaaataatagagtgggctaagctgatgaaacaaaatggagaagcaaagacggagttattgaaatggatgatcctgggagctgcaacttctttctgtgaaccaaagaaatggagtcgactgaaggtgataatcttgaactttgttttgtccttttccccctactcaagaagagttacatctaagttcgcatgttttctttctcgtctgctacctactatttgtgttgggccaaagtattggctgaaaacgctcctttcttgtttgagctggtctccccagcctgtggatgtaaaaactctctttatataaaagctgggccatctggccttctatcaaaaaaaaaaagttccagaaatcattctcgttgaatcgtagtatagctcaaatatgaatagaggtagaaattaatgaccagaatttactttcccaattagctagtaagagcatctatgataaaatccatcagcatgatataacatgaatggaggggaaatgtgacattaaattttatgaaggataaaaaagtgatatcatgcagatctagccaatggctaggcagatgaagacaaacaggagcattgcctttttctatacaggaggaatgagtacaaccaataaactcatcccaaagccatctgtttcaaccttgtgagccaatgagctgatcagctgaacatgggaaaatgagggaagagaagcacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaatatgaagattggcgaatccagctgttgtgctgcaacaatttgtttcatagcaaaaggggaggctaaaatgcctgctaaaatgctgcatcgaaccgaagccaccagatgagttggacatgattacatgagcccttttacagatggaaaccgcgctaacaggggaaatggatttgatggatctttgtatctggaccaggaagaaacgttttcgtgggtatggatgaacaacttgttagtgccattgctaccaggtatacatgtatcctgtaggatagtagttggacgtgggtgtagctgcgtaggcgaacagattgattcgttgtgttgttgcttgtttgtgggagctcagcatgcaagaagatcctttaatagctacccttccagttcttttcctcttatattccttgagaagtggaagaggctgttggtttcgcagagggagagaccgtgggatggtggaaccatggaagatgaaccaaatgacagtttttgatcgagccatcaaggaggaggcgaatcgatgaggggaagaggactcgacaacgcacgatggagaggcctggtgatgcgccgcctacgacactagtcggaaggaggaagaggaaaggttcactggctggcccaggtgggaaaattgggctggcctcagcgagcaagagaaaaggcctcgaggaagcaatttgcaccgttaagaacgtgaatccaacggatggaaataagtggtgacgtggctcaacctcaaagcaggaaattgctaataactacactaagtggggatgatttgtataggtatataggatttgctcgttgatgcttgttttgttttccgttgaaattgtatcttttatcagtttgtaatcaagaattgtaaagttaaattataaacatggagatacgaggaaaaccagtagtatgtcactttctttttcccttttgacttcaattaattagtttctcataagatacttttagcgtaggagtaatggatatccatctgaccatccatgcaagttgttgcagctaccgcggctggttttttccacgggggcgccaggtgcacgcactccacacccaaccatttgattatttctagttaagaatgggtcaagtgttccaatcgattaagtgcgtgctaattactactagtactcgcatgttgaaacagctgctgcgtggtggtttccgctcacctttattttcgacaacgaatgatcgatgaaacgtcccccctgaatgaacgtactttacgacgtaagcatctgtctaaaaaaacacgaataatagaaaatgacctaatatcaaataattagaagagtgacttcgaattcaggtcgtctacctcaccaccttgtgaagctagctggaagactctgggtgtttctcatgaacatctgcctaacgttgtgtggtgacctcagtctctgtgggctatcgccatggcaacttgccaacaccatcgtacgtacgtgcacgagaaaaaaacatttcaatgccgcgcgaaaattctatcctcttttgctagcttccatcccactgtgcatcctgctgactgtgacagctgcgtccacgggcgccatgcggcggcgctccacgttcgccgttctcctcttcgcggccgccgcgctcccgctcgccgccggccagccgtggcagctctgcggccgccgcggaggcggcggcggcggcacgtacacggcgaacagcacctacgacaccaacctccagagcctcatcgccgccctccagcagaacgcctccacgtcgcccactctcttcgccgccggcgcgctcggcgccgccccggacgccgtctacggcctcatcctctgccgcggcgacgtgagctcctccgactgctacgactgcggcaccagggccggccaggacgtcgccccggcgtgcaaccgcaccagggacgccatcctcgtctacaaccagtgctacacccgcttctcggcggccggcgacttcctcgcctccgccaacaactccggccaggcgccgctcatgaacagcgacaacgtcaccaccgccgacgtcgccggctacgaccgcgccgtcacggaactcctcagcgccaccctgatgtacgcggtagtgaacaccacgaggctgttcgccacggggcagcgggtgggcgccgacccggggttcccgaacatctactcggcggcgcagtgcacgccggacctgtcgccggcgctgtgccggagctgcctcgaggacctcgtcgccaggtggtggaagacgttcccgcggaccacggtgggggcgaggatcgtcggcacgaggtgcagcttgaggtcggaggtatcccaggacaagttctacaccggagccccgatgctgaagctgtgggccgacggcctctcgccggcggcggcggcggcgtcgccggatgctgcgccgggcactacgggaggtgacaataccgcgtcatttcgataacatatactccctccatttttaaatataagatatcgttaatttttaaacatgatatttgaaaatttgctgggttcaaatttactgcaaatatgagaaaatataagtcattatacttttttatggttcatggatttctgcattgtttatgttataccggattacttttgaactgataagtctgacttttgttactcgtcacattcttggtgttatgtcagataatcaccgcgcagacagtcaagacccatagtttagcatggcaaatgctgtattacatcatgtcacgtatatatattagtagtatgtcaattaacgatgactatcttcatagctcattgttttcattgagtcttagaaaaatcataaattggcacacgaagagacagagacggatccagaaagaattaatatgagggtctgaacaaactatacaaaaattataaacccatcttctaattaatgtatgataaaaaattttagtggggtcttcgtgggggctcctatggttacgacacgggtaatggagggctcgagacccccatagacccatgaaggatccgccactgcgaagagaaagtcaattttgttcgttgagcagctggtagctcaataatcagctgctcagacaagaaaacaggtgctctgttttgaatacttgaactgattattttccctccaaaatgcagtcaagaataattcagcaaacaaaattctggaaatcgtcttgccgatagtggcagttgcaatcgtagctgcagtttccatcctcttgtggaatatacgcaagaagagaagacgagggaaagcagagcatttcaccggacgtgagtgatccttctcatcattggcataaaattcttatcaaattccactatacattgttaatcatccgtattcattaacagtttatcaaattcatgaaaatttgacagctgatgcagctgaggacttcgaaagtgtcaagtcaaccctgctatctctggcatcactgcaagtagcgacggataatttcaatgaaagcatgaaactcggcgaagggggattcggtgctgtttataaggtatggaagtaaccttttatgtgttcttttgaggaaataattttttatttcacggggcgaattaagcatggtaaaaatatgaaatgataactttttactatgagtgtactgatccttaattgttactttgataatttaattaattaatactatttggcaaatatcattcaagatcgcctaatattgtaaattagttacagcaccaagcttttaagccattcaaaattcagttttttctatccatatctccatgtaagaaggtattaaaccaaatttttcaggggcttcttttcagacaagacgtagcagtgaagaggctagcgaagggttcaaaccaagggttggaagaggtgaaaaacgagctagttttggtggccaaacttcatcacaagaatcttgtgcagcttgtggggttttgcctagaagagggagagaggatgctcgtctacgagtacatgcccaacaaaagtctcgacacctttctttttggtactactgatatcacccctgaatttagatatgttaccatcttttcatgtttctgcaatgaacatgattcatgctaattagatgaagagaaaaggagacagctagattggactacacgatttaggatcattgaaggcattgctcggggccttcaatatctccatcaggactcccagaaaaagatcgtacaccgagacatgaaggcgagcaacatcttgctagacgcagacatgaacccaaagattggggactttggacttgctaggctcttcggacaagaccagactcgagagattacaaaccgcatcgttgggacattgtaattagttcataaatatatatgtaataaaataattaactatgcaattctcattctaaccatgtgattattcttgttggatgttgatgcagtgggtacatgtctcctgagtacgtgacgcatgggcagtactccacgaaatcagatgtgttcagcttcggcattctcgtcatagagatcgtgacgggccggagaaggaacaacgggccctatttctttgagccaaacgaagatataataagcatagtaagtatatactacctccattttctaaatagatgacgtaacttagtgtaaatgtgctgaagtataagtcttacgtaaagcttttttaatgataaaacatgtcacaacagaacaaatgatatttatataatttttaaatatgacgaataatcaaacattatgtcaaaagttaacaatattatttattaataaaagagggagtatatattttgctaattcaccaagactaatgcaccattgattgccacttgcacttttagtactttctaacatataaccatgcatactgattactgaagatatttatgtatctaatactaggtatggaggcactgggcagagggaaacattaaggagatcatagatcactccttgggaagaaactaccctgaaggcgaggtgctaaaatgtgttaacattggtctcctgtgtgtccagcagaaccctatagatcgtccaacaatggccgatgtcatggttttacttaatagcgatgctactagcactctgccggcccctgtagttcatattccagtagcatctttctccgatggaagctctggttattctcaaaccgtgacacaattgtctcccaggtagcagggcctaaagcagagcttgccatcgctagtgtagttggcttgttgcttgtttttgtttcgagttggaacttgaaactgtatatattgtcattttgtgataagtggtcaagagcttggccacacgagcccaatgctacagaatcacctacagaagcgtaggacacatcactgtatattgggattccaaaaatctgcttatctgagaaattactgcagtacacacagctcgctagtgctgtagaatgcagattgctctggaccgttaacttaaaagaaagtttccattacagagtgtaatttgtgaccaagtcagtagcagattgagcgaaaatgagcgaaaatgggcaaatggccggcacaaaagcttgggtaaaacggaggaaaaagttcactcgaggtccctcgtcgcatcgccgagttacaaaatcgttcctgaacccaaaaaccatatacaacgtatgccccaacttccaacttccaaaaccagtttaaaacgagatcccttgacagtattgtcccccgattttggctgacatggcacccacgcaggggtagatctacccattaagcagggtgagtcgaccgacccagctacaacctgtaaagccccacacccaccaagaccccctaccccttatagtaatcatgggctaacaaggtgtgaacgcccaacagattagtccgtttcttcacaatgcacgcccgctacaaacaatgattcagacagttatgcgattgaactataaatacgatatgtgttgttttcgattgtttttatcgagtgaatatctctgttctccgccccatctataatttaaagtcgtgtctaccaaacatggctcctttgacaaggtcttcgtcctaggtggcatcttcctctctttgttgcgtcaggcagggaggaaaggtagaggaggaggcacggctccggccgttgtgggtgatctcaacggcggcaggaggtggtcccagctgcgacggcattgggaattggaggcagccaacagtctagttgcagcgggaagagttttaggggagagagaaagagtggaggaagctcggcaaagaaagcgggtggcacgtcgactccatgccggtctccagtgtcgccactggctgcgcccaggacaacgaagggctcttcgtcggtgtcattgggctgctctcctttccctcccagatcttcgccccctctactccggctctactaagctctcatcgacaccgcccctgcccgacctcctccgtgagcggtgctcgcgggtcactgccagggcgccccctctgctggcgccagattccatagaccccatcgccgccagggggatgggttgggcaccttgcccctgggctacttctactgaccattgtcagcctcatctttcaccaccactcccggtgctccgcctgcctcgtcgccaactagggggttgggcccctcctcaagctacccatggcgcggccaccaccctcgctgactccgtccgatgggacgccggccttgacatcctcctccgggtcctgctcctgctttctcaaccgctagcctcagtgttcttcaccgcgaagaccccttatcccgtcggcctccatgcgtggaccgacgcacctccaccagcttgagtgagaacggggggagagcaacagagggagaagaatgagagtttgtgtcattgatatgtgggtcccacgttgactcagtcatcatgttggacaaaatgggggtcaatagcgtgtaagaacctagagtggtctggttttgtaaagttgagagctgacatatatctggtttttcagttcagggacgattttataactcggtgacaaggtgagggatctcatgtgaactttttcctaaaacgtgagagggccaggagtccagcacgacagaaatgaggccaggcgacccagcgatttcacttcaggttgggggctcggcctgctggctctggtgaaacagaagcaggcccatttctttcaggatatgggcttatgctaaacgatcgtcctcgtgtagcaggccaatttttcaggacgtacaaaaccaacatccggcctgcaaggggagtatccagcttgatgtaagttggatttataggaacacaaatcttgatgtaagatcccatagataaaaagttgaaagacaggagcatccaaaaatctatcgcaagtaaaataatgaattcgaagaaaaaatgattgcctgcaaaattaaggggaaggaacatgcgaaaatcgtttctccagtggtgaccaatctcgcacagattttgacttggttgctatccagctggcaagtgcatcaggggtccagtcacacagtgaaattaatcatgtttagacacaatgcaagttttcttgtactgtcctatctgcatgctaattaagttgccaagtgtgaagccaagaacagttgtctccagtaacgatcgattggcaacaaaatcaaagtccaagtcaatcaacgagtcttccaattttaatcggtactagtatctatccctatctcttaagaatttctttaattaggaagatctggtcgttgatttagatggtatcattatgaccgtatagagaactcatattgaacgaaacatgctattgtatagctgaactgtgcgtgagtgatgcgagagaaaactgatggatgatctacaaacaatagggacaaaaaaatagtatgcatactataaagttagcaaactgcttggaaaaaattatctaaaccatgctaatggagaaagttttggacaaattgtacctttcgaagcgtgacacaaataataggtcgaaattgtaccttattagtctttttaaatgttattctaaaattaggaaacaataattatcaagcgttaccattttttactcttaatttactgttttgttattataattgtaaaatccaaatgtgatattagttagttgtaaatgcggtggaatcaacttctagtttaagcctgtattgctaagaaaataacagtggtcaatatatgattaaattcaaatagatgtgatatcaacaacaatagaaatctccgttcaagtaaggtttggttactagtaatttcaatccaaatttcaaattaaaaattaattgttcttcaaataatcctcatggtgagatcaatccacacattggagaagcacaagaggtgttatgcaatccaccgttagggtttaaatcctggttcacaaaaaaattatatatgtgtgggtgtattttattaaagaatacattacaattatataaaaataacttggcaacaacttaataggtcagtgccatctaatataagaacttgataattgaacatccaagtacaatactgtgacatgtgggtccattataatataaagaacttgacaatttagtattttggcgtaaaaacttagctaggtatgtgctgttttgatttatgagtgcttgataagttaattatttcacgatatcagtatgccataacatagccatactgcagatattatcttatgttgttcatcccaatttagcacgactggtatagattttttcttcaccttattgatctcaactgaaatacaaaacattctactagtaaaatttaactgacttttaattactaaaatgaaaaaaataagtatgcttatacaatatagacaagtatatatgttgacaaaataagaacttaaaaattgaatgtgtataaaaaaatgctcgaaataattcagttgttatattaactcttaagttattataccaaaacatacccatcatgcaagttgatgtaattgtatacttattaagttcctgtactagattgtatacttactaagtaagttcttgtactaaatttcactcacccattaagttattgtattaaaatgctcatttctcaggttattgcactaaattacacccgtctgctaagttaatataccatgattgtttattaaaagtttagtgagatcatgtcttgatggcgcattcgtatgtgatgcgtatatatgtttcgcatgtagtgaaacatgaaaaatgttaaaccgcatgttgggttaataactaaaaggagatcaacaaggagaatattttggcgtccagatctctaaaaaacgtttcaatcatttaatcatgcgcgtgtacgtgaattacgtccaattttgttatatattgtgaacaattttttaaaaaaatttaacagatgtaattacattgtaacttgcatataactataatataacttttacataattttgaaccgttagatttgtttcaagatttgtgcaatcaatgatgggaaaaaaatcacaacacacacaagtgaaaggatttagtccatgacctccgtttcacgcaaatagcatgccacgaaaagatttttaaatgttacatacaattaagtcacattatagctaatataattacaccacgattacactataattgtatttgtcaaatttttaaaagaaaaagttattgaaaatgtataggtgatcccattacgtcggctggtggaaggcggactcagcacgtactgcagcaggcgctcccgattcttcatgcggttggatacgctggatgccatgtcagatggggagaacagtggattttcttcaacttgaaagattaatcgacgttaaataaacatttaatcttaatgcattgggtgaaagatcttgagctggttgctatatatccaggcgacatgcatgcatcacggtccagtcgctatacctactataccatagactgaaaaataaatatgaacagatacaaagtaacaaacataaagtaagttttcctttctgaatctgttgattctagttttcctttttgggtctgtttattctaccctgttagtttctgacagagaaacgactggttatttcactgagaaacgactggttatttaacttataagaatatggagaagttgaaaaacccagtttactaatttatataagaaaatacaaactagttgtaaatcagtgatgtttggaaaagttacagctttttctacacaaaaacagaatatatatcttgttgctagaagttttccaaataaacatagcccacatgcctttagctgagtcgtgacttataagacaatgaatagttgaatagttcctcaattgataggtcaagtgatcaagcccacttatgaggccatgaatagttgcctcaattgattggtcacaggctcaaccacaagtcaatcgaccagagtttctactagtttctttcttcattattatataacactgttaacttccgtaccattcgttctatctaggggttttataaatataaaaaaaatataaatcaggtttaaaagtcatttaatgagaaaacaaatccaacaaaataaataataagtacataatttatttagtaaaacaaactgtacaacatcgtatattaaaagaaataaaagtagttatcttggcaggataggtgaagaaacgccaacggaggaaagagggcaaacatggggatgtggattttcatcgaatttgtagttacatgtttgtgtaataacttatattatcacaacacatcgtaccaaatgttttcacatttttatttaactatttatatcatatgcatgttatagaaaatactttcccgctaaataggttactggttacaaatacacaacaacataccgttgttgagagagagtatgctaaactctcaagggggtgtcacatcgtctcttgcatgactgtgaatatacacatatactaattagagtttaatttatcttttttttacaacttgtagaagtcatatttaagcataattatttgtgaagtcacatattaatccatcttactattttttttagtttttccgataactgtttagatgacatgtgatagacgatgaaatattccttgaagaatttagaatcctagatgatgcaacagtctgaatgccacaataattaagagggccgacagagcatgggaaaaactgaaaaagaaaaagacctactaaggcccggtctagttccaaaaaattttctcagaaatatcacgtcgaatctttggacacatacatgatgcattaaatatagattaaaaactaattgcacagttaggggggaaatcgcgagacgaatcttttgagcctaattagtccataattagccataagtgctacagtaacctacatgtgtgctcaaaagatttgtctcgcggtttccaggcaagttatgaaattagttttttcattcgtgtccgaaaacccttccgacatcaagttaaatatccgatgtgacacacgaaaaattttcttttcacgaacgccgtatgtacaaacacaacaatatggcgctagctctccctactagacctgccaacttcgtccaagctcgcccacccttcgtcaagctagctacatgcaccacctacatggcgtacttctacctcgccgccgcagcatgcctcgtcggcgtgttcctcaacgcgcctcacgccaccgacgcgcagcccatgccatggcatcgctgcaacacgagcagcggcaactacacggcgaacagcacgtaccaatccaacatacagtacctggccacctccctcccggcgtacgcctcttcctccccctccctcttcgcctccggctcctcgggcgcaccccccgacgccatctacgccctcgcgctctgccgcggcgacaccaccaacgcctcctcttgcgccacctgcgtcgccgcggccatccaggccgcccagaagcactgcgcgctcgtcaagaccgtcgccatctacgacgacccctgcatcgtccgcttctccaacctggtgttcccggtcagccctccctataacaaaggaatgttcgtcgcgtgggacgacaacaatgtcagcgcggcggcggcggccgcgttcgacgccgccttcgcccggctggcgaacgccaccgccgagcacgcggcggcggactcggtcaggcgattcgccacgggggaggaggcggcgctcgccgtcgccggcgaggtctatcccaagatctactcgctggcgcagtgcacgccggacatgtcggcggatgcctgccggagctgcctcgaggatatactcgtgaggatggtgcccacgtatttagccgggaggaagggcgggcgcgtgttgggcgtgcggtgcaacttccggttcgagacgtatcctttcttcttcggccagccgctgttgcaactcccgggctcgccggcgtcgtcttctgctccggtgaacggaggtatgttggatgaacacgagtgaagcttgcagtgttaatttcttttccactctttctatttattattagttgtatgatatttgctcttggggttatgggtaaaatcgtttttacccaactatttattctttcccatcacctaaatttgcataacacactatcactacctctgttattttttacttcacgttttggacatcgccatatatagtctctagggcacgtgtttcattcatattttttttctaactatattttatataaattattaaaaaatattgttatatgaaagtatttttcataacaaatctactaatattgcatattagatcataatattttttatcaatgaattatttaaaaaggtttgagtatacatccagcaaaaaagaaagatttgactatgtgtatttctaggaaataatctatttgcagtaagaggtaaacactactattcgcatgtgttttggaatcattcccacgatatatttatttccaagcagcgcctggccctccctttcactgactaccaagtctaccactaccaatgagttggggacacaacccctgtgtacaaggtcctgtttggtttcatgggctaattattagcccccaccttttagccctgaattagctctcaaggatccaaacatgtgggctaatttgaggttaaagtgcattagcccccctcaaaacattagcccctttaagtggtgctaatggagctaattttgggtggggacaatcaaaaagcagctctctctctctctcctctctttctactctctctccaccatttagccttcaattagcccatggatccaaacataccaccttaggctaatgtttagcctaccaattcatgactaaatattagctctcaagattagtcttgggctaatcttccaaacagggcccaagttaaccttttctcaaagctccatgatattattttgagtaaaatatgttattgttaatccgtccgtttcaattacttttcgttttacctttgtcgtaaatcaaacattcttaactttaatcattgattttggaaaattgtatagttgaatatcataagatttatgtttttagagcaattttcacaaaaccgcaagttttgggccatccgtaacgcataaccctaggttttggggcaaagtgtttcataaaaccccagctacaagcttatatcttctatttgactaatatattgtaaaaattgtatgtgatatttttagtacatatacacattagctgcttttcaataatcgttgttcatcgcggtctgatcatttatgtgtatatttaaccaattattatgacattatcacttaggattatgtccatttttttatatagtgacaaattgagaaaaaaatataaactagacaagaggaatgtgtactttgagtcaacaaatgtaaatttatgcaaaaaaaaaacataatcatatgtaatatgagtattttacataaatatactacatgaaagattttcatggacgccggatccttttgtttccaggcggaccgtatgtggaacagcacaggaaaatggagggaccggcgctaagccatcgtccgtataagaaaatcattttttgtgtgcg

SEQ ID NO: 75315 - DNA, 1311 bp, Oryza sativa
tgggttccaaatacttagttatatatgcagtctcataaccaacgtatattccaatcttttccaatggacccctttgcttgttcgttgaggtggtaggataggtatatagactaggcatccaaatttgaacaaatgggacaatttccgtgtgaccccttgcaccaatttcatttttgaatggattgtgtagggccatgaatctgaaattaataagaattaccacgtgtagggctgcatgttcccaacacgtgcttggcaatttacaaccttgcaagagtggcttggtgatgaatttaattcttttaatcaacgcttctgcaagtccattttgcgtatggacgtgacatatcgagtgctctgctttgattcccattgccatgaaatattcatgaaatgcttttgaaataaattcgcagcattgtccatttgaatggactgcacatgatgatcaagaaaattattcttaatttggatgatctgctagatcaattttgcaaagtcatggtttcgttttgatagcaagcacacgtgcgaccattttgaggaagcatcaatgagcaccatgaagtatctaaacggcctttataggtgctgtatagggccacatatgcccactgtattcgtgctaagaatgcagggatttcatccttcattttccatacggatggtcttgtgatcaatttcccggtggcacatgcatgcctcgcaaaatcttctcttttttttttctgaaaggaacatagaaagggaagcccctgttaaaaaaaaatctaaattgataattgaaaaaaaagattacaacaacctaatccagtttaagactacatctttatcaccctcattcaatctaaataacaaaagaaggagatcacccttgagggattgtctccaagaaaccaaggaatgaagaatattctcaaagaaatcaaattaacgtgcaatctccaatattacttgatctgaattgatgggccgcacaggtcctacatttgcacatcgtgctccatgtggctgaccgcagaggatagggtggagtccgccggtgatggatgttgtttgctatttttcttttgccggtgatggatgttgtttgctatttttcttttgcttgtcatctctatgacatgaacgaaaatgttcttacatttttttcgtgcttgctagatgatggatggctgctactgcgcaacgtcgagcccatctctataccacaccgctacacccttccatgattccatcgtcaaactaccgctcgccacccggttaccctctccactacccgtcacaagacacagactagcctctccatta

SEQ ID NO: 75316 - DNA, 2670 bp, Oryza sativa
ccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtacattgaagaaacaactgaagcctcttccttctgcgagacaacagtaaaatgctgtcgatatatgtggtgaagcaactcttgtctcggacagtaaaaagtcataattttggcccggcggcttgccggggtaggcaaaaggtgagcttatgcgctggcttgcccctgaatcccttgatgcatatggactgtgcaccggtgactattcaatgctaaagatcacatattcctggctgtaaattgtgatggtggatgtctcattttgcttggatactctggaccatccggtggtacaaggggaacttttgcttctggttgaactgattactccaataactttcgtgttaataacttttgccatcatgatagtgcctattatttataaatgtggacacaagtcattttctggagcttgtggtaaagcagggctgagaatctcgtgcaagcttcatcttgtaaattgcagtaatcagcataagattgtgacagataacttccatgtttcagttcctatgcattactactatctaattttcctcgggcaatgagcatgaactatgcatgagactctacagaagatatcggatacgaccatacgaatggactaggatgaggatgctactactggccgccaattttgcttggcattatggtggattactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaattcatgttacaaatgatagctcctcgaaaatttgaacaccatttttttaaacatgagatagaagctccaccgatcaattaaaagggaaaaaagcttaacaaggtctataaaacaaagctataccgatcctactggtaacaaagttaatggacgcttaaaaaaagtatggacacaataactagaaagaaatttgagaatatacttttccttttaaaaaaatggacatgattgtaggaaaattgagaaaatatacacgtcatgtggcgcaaaactatggagtaacgggaccaaccaacaagttcttgctaatgggaaaaagagagggttgaatgtgggtgctgttcttattttgcccgagggatccgaattagcgccgcccgactgtatttctcctgagttgaaagaaaagataggaaatctctcttttcagagttatcgtcccaataaaaaaaatattcttgtgataggccctgttcccggtaagaaatctaccccgcgcattggctgagcgtcactgggttggtcccacagcccggccacgtgagactgagggcagcaacaagtaccgcgccgtgggtcggtcccatagcaccgggtctacaggccccatcgtttggccaagtatggataatagcactgtaataataatttataagtaataatagcactgtaattaaacttttatatatgtgctcttaacgatttaaataacaatgctgaaaaataaactttaataaaaaaatcaaaatcaacttcaaaattgagttgtaaaattcaaaatttggcagcggctgatattgtatggaggaaacgatgggaatcttaatacactgatgcatattgattttctcagttcatctatctctaccgagtttctaatccctactccctccgtaaaaaaaaagtttggacatagctaactacaagtggttttttatgtgaagagcacatgttatcatgatgcatcataacttcactaccccggactaaacaagattataatatgctgcaatctgcatggtttctgaaactttgaatccattttgaacaaaaaaaaaaggttttgagatgacatgtagacctagtggtgcggagctatatctgatatggaatcgattgggtattacgccgtcccgactgttgctaccttcggtcccgcgttgctgggccacaggactaacccactgccccgcagccgaggcgcagggtggagttggtatcacgctgttgagcaacggtaccaccgtcctcgttgtcggtcctgcagcttcacgccgcgccgattgacccacccatgtcttcgctccgtgggatgtgtatattttctcaattctctacgattatgtatgtataaaagcaaattcttaaaaatgaaatctatatcctcaatatttttttctaataactattacaattggatgggatcaatgg

SEQ ID NO: 75317 - DNA, 743 bp, Oryza sativa
ttttaaacaacattttaactttttagaaatcaattcattcgtttataccctcaaatagctatcatataaatcagataattcataagtatattttttttcatgcgagtccagtgtgcaggtggcattcgatggctttcgttgcagacgctatgtttggatgggactccgaggtgaaagccttgctcggcttgccaatcctagcagcatgatgcccttggcgccgttcaccttctcgagggcattgctattggagcccttgttcaactccatatcaagggatttctctgggtgaaaaccatagattcgttaggatcgggtgatgtcgccgttctgtcgacgtgttcttctcgaagtcttcgttttaggtgcttttcccttgctggacggttgtacttaaattttaggttcactccgtcaatgccggggttttcgccggtttttcataaattaaccgggccgtagtaaggattttgggtccagttttctttataagtgggataactctcttcttcttcttctattgggaaattgcaggagctccctacccgttccccgcgaaaaaaataatgtaattatttttggagttatttttcccttactgtatagttctaatcgtcaaggtttccttctattctctacttcctatacgatgaaaataactatttttttaaaaaaataatatagtgattaccctcaaaaatatagaaaataattttatttacttctgaatattctacactttt

SEQ ID NO: 75318 - DNA, 1100 bp, Oryza sativa
tctgaccgtcgccttgtaaggtgtttagaacttttagtatgagtttggttcgtgactttaggctgcctacctcgggtataaatagagggggagcatgaggcttcccggtatcgctttggagagcaattgagttgagttttaagttagggtttcgagtttagtcgaaatttttgtaaggagtgttgttggtgcactttgtaaacacagagagaatcaataaagtcgtcatctactactctaagagttcttcgatttatgttttaccgggctttagcggtctaaccaacgactcaccgatggtaagaccggcggcaagctaggaaaccctctagtacaagaaacaaactttacataaccaatcatactaaatttggactccttccaaattcgacttcgcatcccatacgcacacaatacctccatcgtatgccatatggaatctccatcaaccacgtgcatcaactctagcctaagtatcccgcatgatctagaacgtgtattttaagtgtgcattgacacatctagaacaagtggttcaagtggtaagacacattcctactcctagctaagtgtgggttcaaatcccatatgctgcagataaaaacccatgctcaccgtatttttttagtttgccatattctgcatcatatacatgtaacatattaacaaaattattttattcaaattgaacaaatcgtcttttgggtttgattcttcttgcaatcacattttttatttttctttgcactaaatatgtttattttttattgtttttaacatattaacaaaattattttgttcaaatttaacaaattgtcttatgggtttgattcttgttgcaatcacatttttcatttttctttgcactaaatatgttttatttttttattgttttgggcaaactagcgtatgatgaatttaaaatcatacattgtgacagtcgtgataaaaatgtcacgagttagcgggctgtgaatatccactgggctcatctgtgacgaaaaacaaaatatcgtcacggtgtatgtttgtcagtgatgatatgtaaatccgtcaccgagaatccgtcacggattaacaagtttcttgtagttaggaaa

SEQ ID NO: 75319 - DNA, 7341 bp, Oryza sativa
tgcatgtgcatattgatgaaaattctgcattgaaatttcgtaagatttgcatggtttttgacttggttttgatccggatcatgtcacatcatgtgcggtggcgacgcgccggcgcctgcatcaagtgtatctagctgaatgttaccagatctgtgcagctagctagctttggagactggtttacctttcagagtgcataatatatctccaagataagagtcagagaacatcaaagcaaaataaaagggataatatgtaatgtggtacaactgaattgtcgccctgtacttatcctggttgagtacccatttaacaaggataaacatctgactgttttatcatgtctgtcgcctggtgattgattagatcatctttaactccaaatacgtctgagtttttaacaggtccttcggcacagaatcaataattggttttctaccgtctaagtcaggtttgatttgttcatatgtcattatattaattgatcccttcgatcataaaaacatatcattttggacattgatatggtcttcggaatataactttatccacaaatttatacggcggaacattaaaaaacccaataaaattatagcattacggaagtcaaatgtcacatgtagttttcattcatccaatccaaatatttaatcaaaattttaaagtttgacttaaaacatatccaaaacaacatgccttcaagaccgaagggagtatgaaacttagaattacctagctaaactagcaccttgaaccgctgtccatggatgcagatgcaggttatacactttgagtcagaaaccatcggagcagaggaaaggcctgagataagcatttgacgtggaggtttattttaggtttgacaaattgacgtactacaaacaatcatgaatatcatatttgttgtttcattcaaaccatcagatgtgtaacacttaattatagtgtaatttttatcgcctcttttgaggaccttttggttatgtacgagagaaaaggtcgcctaaaagaaaaaggaaaactatacacagagtgaacagctgatagattcggctgtatgattttctttttctcccctccaaatatgaagaaaaggtcttctataaaagaaacaaaactacgcaaagtgaacggctgatagattcggctgtgtaatttttttcgctccaaattaaatatgaagaaaaggtcatggccggttgagccaaatgtgactaactacacactcttaactttattttagtttgttctctctgattcagtaactccaatttccgattaacaatattttttacttggctgcttcaagtgatctagaagcaatcaatcaagaatggtggagagaaaaattcagatgcagaaaaggtatctgctaatttcttccggtggcattacggtcatgaagcaaaagtaaccagcacaccaaattattctaaaatccaatatagtactatcagtctaattaattgatagaaggtgatgccactgttcaattaatataatgcacaattcaatgaaattattccatgcatattgaataagaaaataaatgaaggacaagggatcagtgtctttgtacatgttatgagtcactaacttaattatgggagatgcctatcaaatcccaagttaagagcaaaatgttggatttttcatatttgagctatatatacaaaagaaaggctgggcaagattatgcataaacaggtagtctaaaacaaaatggcatgtaacaaagcacaacttaacagctttatatcatgttagtttttttccaaacaaaatcataattacgtcatattagtcagtgaatagttagacaggaccaaataaaagtaaaaatacatttcaagtctctaacttagctagatgaattaaggatccaaaactaacgcaagaatgcagcatccttccctatgcacagtgactctgtagtcctatctgaaactccacatcatgacacatgaatatcattttggtacgaatccacatgatcaacccaataatgtatcaagctctctatctaataggctttcgcatgaatgctatgggcctcaaaatagtgtctttaattagatgctttctcctcttatacagctttctacatgcattattcttgcttggtgtaagaaggttatactgtatcttaagcaacatgcaaactctcatattcaattttcccctccaaataacctagaatcatataattagatggagtaactataagattgttgataatgcccatatgaagcacatccctaaatttgaagtttaatgaataattatctttttgcgaccatctatatactggtattgttctgtctagcatagctgtacacaatccttttgtattcacagagggaagctgtgaccgacataacatcaaattaattaaacacttcatttgagcaggaacagcgtgacctattacaaataaatcaacaattattttttccctttggtgagcacattaatttgatacatgtaatctaggcaatgaaagatttatagtgtatttttgtacagaattaatgaaagatttacagtgtattttgtacattcagatcataaacaaattaaagaactaaaagtaatcacaaaatctaattaactactaagaggagtgcaaattaaagcatgtgctcctcttagcaattaataataattaatagatcggtggatggatgtgatggtgatgaaatgatcaggaggggtaagaagccttaaggtgagcttgcaagcatggcgagtccttccaaaccctagcgttcgccctgagcatctccctcgccctcgccctggcgcgctcgccgccgtccgcctgcagcaccagcagcagcttcgccaccacgccgacggcgagcatctcctgcagcacggccggcgtcgccgcgttcctcgcgacggcgtggagcgcgcgcacggcgctctcggtggccgccggcgacacccgcatcgccctcttggacaccacggcgagccccgccgggtgcgccaccagctccgacctcccctccgcgcacccgcacaggtggtcgatcgccaccaccgccagctccgccgcgcgccgccgcccgccgccgccctcctcgtcgaggaggagctccaccagcgccgccaccgcgccggcctccaccgccttcacgcggttccgcccccacgggcacagccggcacagcacgtgcagcgccgccttcaccgccttcgacgacacgccgtcggacaccacccggaccacctcctccaccagctcggggctcaccgccatcagccgctccggcggcatcgccgacgtcaccgccttcaggaggaggatggcatacgcgcgcgaacggtagctcgggcggcggagcacggaggcgagggtgtcgaggaagccgacgccattgtccttgccgaggacgcggcgcagggtgggctcggacggcttgagggagtagagcacgcccagggcctcctcctccggcgagctcgtcgacatgggggaatcgatcaccgagtcgaacaggtcgtcgtcgtccgagctggctgaggtggaggcggcggcatggctctggacgacgacggagacgaggaactcgacggcgccgggcgtggcctcgacgcagcgcttgttgcggtcgctctcggcggcgatggccttgatctcccggagcgcggcgagctgccgctgcctgccgccgccgccgagcatcgtcgtcgtcccctcgtcgacgagcgcggcgacgcggcaggagtcgacgggcgggcgcggggtggggaacctctcgacggcgtgcgcggcgcaccacgcctggatgagccgccgcagcgtgtggttgggcgtcgcctcccgctccgccggcgccagctgccgccgcgtcaccgggcacgtccccttccccccgtcgccgccgccgccgccgaacatccaccgctcgatgctgctccggtcgtaggtgatccccgtcgccagcgtcaccgggtccctcatgatctccagcgagatcgggcacaggaagtaggacggcacctccgccgccgcctcctccatgctcgctactaccacgagacgagttcgagctcgagttgatcgcgaaggagagagatcgatgggaggaagaagaagaagaggagtttgagttgaagggaatgaattggcgggagaggggagaagcgcgttggttttatagggcgaagagacggaggcgcgaaaaagtccacgcgcgcgggtaaaaaaggagggagacgaccagggttggtattaatcaatttaatttaatttaattacggcgatgaacagtgagcgttaatttaaattaattaatgtcgtgccggtttttttttccccgtcgcttcaccatgccgtgttggtgtgaaatgtgccgacacgtacgaacgcgtatgtgccgtgggaaattggataggtggcgcgagtaattaattgtacctgtttaaactaaattagtaattactatagctgtttaaattaaattagtttcggtaaattgggtggtaaaaacgggtggttgtgtcgggtcggcgtcggacggctcgtccgcgctgaccgagtgaccggacagcggctcaacggtttggcttttaatggatcccttcctctcttcttcttcttcttcttgttttttttttaactactattctgcttcttcttctttgtctttttgcttggtcttttcttttcttctaatcgcttacccttgaaagattccgttcctagccgatcgaattggctctaatttgaaaattctgccctgtttaatggtattcatttctttcacacattttttaattccccctgtggctatttcggttacttttgtgtggtggagagaacaaccactactgccactacgaatataatttcatgcttatggttgatcacaactgactaagcttgagaaacgcgtattaccacttttagcccgaggaggtgttgtacgtagaaaatatttttacactatatattatggtataataagtagtaaaatgtttttataaaacaaattgacaaccatatcatgacactgctggagaaacggtttttactcccggttatagcaaccgggatgagccaatcgtagtcctagttgagagaaccggtacttaaagttacatagcaaatgaaaaatacatgtgggatgtgggtttaaattcaagatctctcacctcagtcctcacgcacgtaaccatctcatcagtcctcacgtacgtaaccatctcacctactacacacatctaacttgaatagagatgttgtccttttgaactaactctagagacatctttagtctgagttggtgttaatttttagttcgggttggtgttaccaaccgggactaaagatcattcatctttatctttagtctaggttagtgttaccatcctagactacaaatcaatttttagtcccggtaacatcaacctagactaaaatgttttgagggacttgaaacacttttagtactggttcttaatctaaccaggacaattgtgattttgggtaacatgggaaaatatcagttcgccactagtgtgatgatatctataacaataaattattttttttgagagggtgcaactcaggacgccacgaacacaaacgcacacatacgcgtgcgcgttcttaacacacgctagaattgagattggaggcacaaggctaccgggataaccgaaattgatcccggggaaacggggaaaaaatcccctagtgagacacgcgagttacgattccagggatcgaactcgcgtggctgcttgctcacctagcgacgctagccatccgagcgacgctcggttccctaataataaattattttaaatagaaagagttacatattgggatatgatatgatgttttacatattctgatgatatctagtgatatgtgcgttgtgtggtataaaatttaattattcttttttatttaagtgcagatcaaatttagacttgtatatttatgtgtaaacttatagcatcactgaatctatccactatctctcttttttaaaagaaaatgtctataactatttaaaccgcatgtaagtaatagtaggtgtaattacattcctctactattttaaaagtggagtaaactttcttttatctcctactattgtcactgcgaagcacatccataagctccgtgtgagtaaccactagatccaatgtttgttttgcacagtaagcatgacaaatctaagtccgtattattgttagtaacaaaaactaattgaaaccgctcgtgtacgtgggacagtgtaaaaacatacgcacacttacgtgaacaaattagcgggatgaatagaacagtattacggtccgtatatatcttcttgccatgaccaagagccgtaataccaaacagccgtactccatgtgtaacacgtgcggttatatatggaacagtacacccaataacttgcacgtgtcactgtcacaaaacaacgcatagcggcttttagcctgcttgtcctgacctgcaccaaattaaggcgcacacgttggatttggatagtagtaattgcgatgaatgtgcaagcatatcagcatatatacataggccctgcttagttcaaaataataaaagttttattattttagaacacatttttttctaaaatggatctaaatgctagtaacaaaagttagcaatttagcatttgtcatttgggagtctacaatagcaaattttgttaaaaagtgcgttgggagtcgtgctctccctctactaacaccaactagaaaaacttcaatgccaaatcttttgtcaaaaaaatttaccacatcaaatctatctattatatactaaaagtacatgaaacatcgtacaaacgcttctaataaacatgtggcattcctacaaacattactaggccgccacattttcctttaaaaattagcaccaattaaatttatatatcttttataaaaaaaggcccccatcgtaacatgcaatacgtacgtacgtcccgtgcaattcttgcacgctcgtaggtacggaaggtccgattcccctgcccggcctttctttttttttatttcatggatttattcttttaattgttaatatttatgtatttatgtctactatatactttttaaaaaaggtccattaaattttcttaaaatactcttaaatcataaatggcgctctaataaattagagataaatcctaaaaattcaacatctaagcatcgttttttacttaaaccgataaacccttaattttagaaattagattatattgatcataaaataaattagaaaaagtgctcttaagtctcaactctcctgatctctatatacatacgtgcatgcatatttgatcgatcccaaca

SEQ ID NO: 75320 - DNA, 4256 bp, Oryza sativa
ataagtaacatgctcatatgttgacgctttacatggcattcgagaattatgacaaatcatgaaattttatttaatgatatggattataaatttgattatcacgtaggatccagtctattcggcccatgtcagttcataattatacatgactgaattagatttacatgctcgcatcttggcactctacatggcatgggagaattataagaaatcatgaaattgttttttaaggttttaatgatatggattatatcatcatataaatatgcctaaaatatagtttccagtctattcgacgtatacgggaataacctaaaatatcaatcttatttaccaccatgtataagttatatgttttggcgattatattatgccctaaataataactaaaagaacagagagagtacacattatttttttcttctttgatttctaatgaatatgcatgatgtgtgggaactttatactaactttagttaattaggaaacacaaataatacaaaacttatatatgagaattcatgcaataaaaagaaactttataataagaattgccctaatacaagcatacgttagtctttgacacttaaacatttaaaaatactctacacatactaattaaaaatacactagcatataattgcgctcttatttcaagtagaattcatttcaatgaaaataagaaagcgtgtgaaaaaggacaagtaaacagaattttatctttaattagattaaacaattctatttgccattttttatagaaatatcctcaattaatatatctaaaatccataaatacatttataagagaaaaaaattgttacttaaagtatatgaacccaaaaacaagatatgctaaatattccaaaagtaatcacacatattacaaataagtttcattggaacaaactccatgttgcgacaatatcttctcatatacaacggtccaagtaattttagttgagaaatgtggcaaggataactatgagaatatataagaaacattcaaagcaatctcaaatacattattgacaaaaacaagtttagagttgaatcaaagccacacataaattaaagcgataacaaataaggtgcccgcgcatatgcgcgggctaccttcctacactggtggagaagtgctttttagtcccggttcataaccccccctttagtcccggttgtccaatccggactacgaatccgggactaaatatcgctatctttagtcccgggtgaaataaccggcactaaagatcaatctttagtcccggttgataacaccaaccgggactaaatatagggatcttaccaaccgggactaaagagggaataacagcagtacagatggtcctctttctttttttttcttttttattttctcctgaatcaagtggcatgcatattcccaaatcccaaatcaaagtaacatcccaaatccacatcacaaatctttaagttacttatacacataaatcaaatacatcgcaaatcctaaaaaaaattacacaaatcaaattacatcacaagttctacaaaattcatcgcaaatacgtcacaagttcacatcgtatacaaatcaaatacatcacaggatcatatgcaataaatcacgaattcttaaagaaaaaggaaccacagaggtgccgctcggccggccgctgccgcctcctctccgcgccagccggccaccgccgcgcggcgcgccgcccgccaccgcgcaggccgccgccacgtcggccgcgccgcccgccacccgaccggtccgctcgatctcgctcgatccaaaaagaagagaggaaggaagaaagagataaggcagaagttagagaggaagaaagaaagagatagagtttgttgtgtggacgagagaagaggataaataatagggattatatagtacgtgttgatttttattcccggttagtaacaccaaccaggactaaagttagatctttagtcccggttggtgttacaaaccaggactaaagatcctaggcgcctaatatagtctgacatggtaccaaccgggactaaaaatcatatttagtctcggttggtatgatttttagcacaaaccgggaataaagatcatctaggactaaaaaatcatttttagtcctgatttttaatggaaccgggactattatagatttgggttgaccgatcaaatatggtttctacaccagtgcaaattgatctaaacaggcccatagccacattcatatactctctctctccgtgtcttaatgcatgataatattgttaacatttgaacaaatgtttaatcatttgacttatttaaaaaatatatatattttttaaaaatatgataaagtaactaacaataaagtaaataataattatatttttagtgagatgtgttttacaaattaattaacagcgtcatctactttaaaagaacagaagagagggagaagaatatactagttcgttaatttctcgccatcacgagatgagcttaattaagctatagtacccgtaccagcatttgcatgcatcgtccaatgaatcagccgcttccaaaccaaatccaaagcgaaggtgccaagcaaagcgcacgcacgcacgtttcgttaaacaaggccagtggattaggacgcgagtgacggcagaagtgcgggcggtggggcccgcatgtcggcgtcatttgaccggaccgaaaggggccggagttttttcaacgcacgcgcgcccgcatgcatgttggtgcgaagtgcgtctcctactattaattcgtcacgtgccgtcgctgaccgtttaccaattaattaatgctgatcgatcagttaattactccttccgttccatgatataagagattttgagtttttccttgcactgtttgatcactcgtcttattcaaaaaattttgaaattattatttattttttatgacttactttattattcaaagtactttaagcacaacttttattttttatatttgcataaattttttaaataacacgagtggtcaaacaatacaaacaaaaactacggagagagtagtttggaggtacataggatcataggagtatgtcatcgcttcctcccgctgatgtatccggatcctctgcatactttgttcatactcctcttaacgggtcacttatcaatgctgcataataaaagagcatctccaacatactccctctgtttcatattacaagattttctagcattgccaatatttatatatatattaatgaatctagacacatatttattagcatatgtatgaatataaataatgctagaaagtgttataacgtttcagatataacagatataggctcccatcggttgccattttacccaaaatggcttatttggcttattagaaaattaaaattaatttataagtaaaacttttgtagatttgttcgtagcgacttaaaagctaacattaacaaaaattacgttaaaagcattttaaaatcaacttcaaaatcaagtttaaaaattcaaattttggcttattctttggctgtttaggccaaacgatggggactgatagtagttatcttcgccgtccctgcgccgcccctttgttgtggcctcgtccgctacagcagttgcttgttgtcccttcgttgtggcccctgtccactgcggcgatcaccgccgtacctccgctgcggctcctatccgctatttgccgtgcattcgactgcgacggtcgcccatgtattaaattctatttgcaaaacaatgttcttttaactgtttgatttaactaaatgaaagtgacagggaattatgactaacgctaaacaagtactccggtacgttgtcaacattgaactattatgacctagctttgccgaccaggccagctctcgaatcttgatcggcttttgttatatattaactgttaaatgctaaatcattcgaggatgtaacgaaccattctaaactagactgctgaagacggaatctagttcttgtacacggtacacctgaacttttatacgtacgcaacctcgttacgccatacactaccacataatagggattcggtgccggttttcctaaccggcactacaaagacggcacaaatcacaacagattaaaggtggtggtttcaaaatcgacaccttcaaggcgcacacaagccaagaaaaatcggcttgatgcattgagccgatgcatcaagccatcaaactgatcccaaataatactcaatcccaaaattttgcatcaaatccatgaacacatctagatcacattcaaca

SEQ ID NO: 75321 - DNA, 3658 bp, Oryza sativa
acaaacacaaggagggaaggacaagaagggaggggaagaaatcgatccgtgggcctccagccacctgccgccgccgcatcccccttccttccgccacctccctccctcccccccagttggcccgcccctccatgggatctggcagagggaggagaggggaggtcgtggccgccgcctccgccgaccagacgcccgccgtggcggaggggagggcgtggccgccgctgctgcctccgccggccagccaccgggcgagagagaagggagggagagagagggaagggatggatagaagacgctcacgtgagtggatggatcgaagtcatcgaaccttatctcctcgttctggtggggcccgtcgactcatcgatttgccggctcggctcaattcgtaggtgtcggttttttataaaaattcagcatattataggtgtcagcttttaattaatcgacacttctaatatattaaaggtgccggtcttttttaagaaaaccgacacctgtagaatagatgtcgatacttatttagaactggcacctataattgcttaaaggtgcctttttttggatttcaacccgcggaagttggaaaatggttataggtgatggttttagcacttccggcacctatagtgccgagatctatttgatgttttgtagtagtgatagctaatttagccaaaaaaatttccaaaagtaagacacgcatgctggtgtagaggaaagtattattggtaattaaacccagaaaaaaatgcaaataatctaattactagataatattataagtaacatatatagacaactagaaatgcatatcgtcttgactcctgtgatgctgtgcagtttgggcaggtgtattaggtgcccccaattacagggccataaacatctctgttgatcctcaaattctatcatttgattgtattttgtctaatctctttctatatacttataatatggtagagacttaagaatacccatggccgacagagaacgatgttggttacaagaactaaaggtgaaaatggtgtcggtaattcctgacctaacggtttttatattttacccatttttttaggaacggaacaaaaacagaaacggaaatgataagaaaaaaatgaaaatagaaaccaaaatgatctcgctattctacaaactgttacattgttttatgatattttcttggaatttatcattttattactccaacacgtggtcctcgtctttagtcggcccatatatcatagtagagactcatcaattgtattactccctccatcccataatataaggcatggtcaaacttgacacagtcttcaaaactaatctttgacttataatttctcatatattataaggtttattgcaacaaaattataacatgataaagtaaatttaaatgtcaatctaatgatattaattttagcaaataaaatttaatttatattataataattattggtcaaatatttttaaagctgaatcttgaaatatgtgtacgccttatattatgggatagagggagtactaaactttgagcacgtaggaaaacataggcatatctcggatgaccactcaaaattaatgtagccaaagctcatgtatataaataaaaagaaaaaaaatgtaggggggagaacaattatttttcttttgcacgagtgacatttagcaattcgcttattaaacttttgatcaattatatatttctgttgtatgttatattatgtttacagtattttaaaaaatatgtaagtggaccacccatatctaaatttctagacatgttaccgtagttaaagggaagccaatttagataatgcaagtatgaattaatgtggtcatattatatagtcatgtaaagctatatctgtgattttatacttcagaatttatgacatgagtatatgcttttatctatgcctgtctgaaaagttatgttttacgaaaattgcaaaaaccacatttagttcaaatttggcatttcattccatgtcattatgttacaaatgctcatcctcctacttaattttgttgcaaaggaacaccccattacgcacgtgtttagttgaatccaccgtagactaagctagttgagctaatcttgtccaagtgcttgattagacttacttttcatctttcattatttttttatgcatataacggaactcaatgagataacgttttagctctcattagtaattttatttatggaatatccaagaaaagtgtcaaggctatactccgtatttaattttggaagagaccacattaacggctcacaattaaaaaaaacatgttgattcggttaagccgtgcgcacgggggtacgtggtttctactttctacacaaaattgagtagggttgagtatttacaacaaaataacttatatgctaaaatgtcaaacttcaaatgacttataggatggtttttcaaattttcgaaatgttttttccttagtttctagatattgttttctgtttccggctctactctttccaatttcagaggggaaaaaatatgctaatggaattggtggaccgtttgttcaaataccgattttatattcctgatccgaactgttgttcgaagtgggtgtgcgaggggaaacataatgtgcaattaagcacgtggaaagtgtgtgcgatggttggacaagtactgacacatatggatgcattcgcctttttgggggaattgggatttctggtgtagtgttgtaggcgtagattgtacactctacgtgggaagtaacgtcgtatacgtaccagccggggtacgcacatcggggcctctcacctcacatgtgcatgggccggcccagccggactcccgcgagcatgggcctaatgctgatggactctaccagtttgccactagcccactactccatctactactattcacgtatggaaaaagtccactctgactcccttaaaagtcggccgaatctaattcgtgccctttaaccacaaaaccgaatagaacgactctctgaaatattgaaaccggtgtaatttgactctcttaatggttttcgagggtggtttcgcgcagacgtggcgcttacgtgacggtgttgacttgtcttcgtcccacgtggcgttaacattgcgcttatgtaatattagaattaaaaatagatatgtgggactcatttgtcatttacacacaataaatacaatggacccactgactgtggggcccacatggtcatcttatctccaacccttcttctttctccctctctccccccttatttctctctctctctctctctcttcccgtcggccgtctgcaaggaatgggattggagcggcggtggcgggcggtggagcagcggacgggagccggagtggtggcgtcgggagggagggtgggtagcgtttggggtggtgctggcgcggatggaggcgaaaggggaggcggcagcggcagggaagacggctgtgatggtagcggcggcgggcaggagggtggacgagagaggatggggcggcgaccatccatgcaacggagacggctcgatgacgaccccgcgacgaccggggacgcccccgcgatagaaacaactcggcaatgaccttgcgacgctaacgggcggagggagagcggtggcggcgtggcactctagatccggcctccacgtgccg

SEQ ID NO: 75322 - DNA, 7602 bp, Oryza sativa
tcaaattacaccggtttcaatattttggcgagttgttctatccggttttgtggttaaggggcacgaattagattcggccgacttttaagggagtcgaagtggaccttttccttcatgtatcttttcaaattcaccgtactaaggtgcatcgtacctgtaataggttggaaggagtatggtagtagcactagcagccccatcgttttgcttattcgtggaataagccaaacgacatatttgcaaacaggatgtaatttgtgagtaaaatgtttatatatattcttagcaatctaaaagcaaatgctgaaaaataaatttcgatgaaaaaccccaaaatcaattccaaattttaggtggataattcaaattttggctgatgcggcataagcataagcgaaaagacgagccctcctaataacgatccggctcagaccccaacagttcttaggcacacccactcggggaaaggtctaatctccctaaaaaactagtccaataggagaagggtggctctcccttttaaggtggcttcctcctcccaagctaagcaagtgggattattcagaggctcactcggtcgccgcctgacttttgcgtctttgtcagcgggtaatagtggagaatgttctcatcacctgctccatctgttttagcactaacatttctatcactccgggatgtgtatagcccgccatccgagtagagtactaagagcttattcagttccttatcattctcaaccatttcaaatactatctccttctccgtaatatgtttgacgttgactagttcaattttgtgctaaccaacatcaaagaaaaaaaaataaaggcagtaatttggtaagttagcaaattaaatatatcattaacaacacgaccttatctattttagctaattccatagctttctgctcacaaaactactgccaacatttgacaacactaccatcttcattttaccttatcaaaatttactaatgccaaaatttaggattatcaaagattaataaagttttgttcatcaataaagtgaaaaagccctatgaaagctaagagtatatcaggtttgagacgatttgtttggccaatcgatccagataatgttttccatatcttagtgcggatctcagtagttttcctctttttttttccttttgaaaaggcaagaaatttgccttgtcgatctatattgagcagatctcaataatgtcactgtggaatttgtgatcgtaacaagaggagaaaataattgcgactacaaattaatgtaattaactgtgagaaaaattaacgcaaggagaaggcgtcttgttgactttagcttaaacagtgtttagtccccattgaaccgccagtagtatattcgacgcgccaccatcgtggtgattttagcagataaaaaaaagaacacgataaaattaatttccatgctcctgcggctggtctattgcagggagcatcattcctcggatacagttgctgttgccttgttgggtacagttgttgtaccacctgagttttttttcagtttgtctcgtacagtactgtgatcatattcttgtgctagacagctagagcatgactctgctgccattcattgaattctaaatagaatttgaggtcgcctgagtcactttaattggttgactctttttcataattgctaaaattataagtacaagaatctatataaatttattaaaagccaaaagttaaaattcaatactattttggattaaaatctgaaacaaattcaagccatgcaaattcatatatctttgcttccgtgcaaaaaaaaagtataaacatcatttgagaatgtaaaaatttccaaaagttttactcacttttctccattttctggctgtgttttccccccttctttccaactctccttcatcttttttcgcgctcatacttttcaaactgctaaatggttacactatttacaaaattttttttatagaaaagttgttttaaaaaatcatattaatcaatttttaagtttttaggctaatacttaattaatcatgtgttaatggaaaacaccgttttccgtgtggggagttggagactcagcctttgatggcaatccaatgattcttgtcccttgtcccttttttttcttattatataaaaggtcgaacaacatatttaaatattcaaaaattacaaaattacataaaataaataaaatttacaaaaccacatgaaaaatattcaaacttagataaaaataaagtaaagacatatataacaacaaagctatagctaaaaagaagtaaaattgtgcattgcatactactgcgattttagcctcaggaatatgcaatttcaagtgactaggaatttacaaatttcgagacacttaaaatctagcaatacctttaaaatctatctatatctatcgatcaatctatgtacacgtcttagattttggaaaagaacatgagaggtagtagtggcctttaattattcataattgctatatatatattctctccttttagtaacagggcgcgggacctgattaaccaacattagcaatttcagatgaatagtactccatccgtttcacacggtaagttattttaacattttccacattcatattgatgctaatgaagataagtcattttaccatttttcacatttatattgatgctaataaagatttattagcatcaatataaatatgaaaaatgttagaatgacttacgttgtgaaacggatgaagtagcaatgaaaccgtgatagcagcacgcgtgcttgctgtcacggagcagcgacggcgcacggggtggttgggaaggtggttagaatttttatacatgaatcggatcggatggtcctggcctgctggattttgcatggagcagccacggatgcacagaccgattcgctgtaggttagtactactatagtactacgtgcttaaaggagaaacagaaaagatacataggatcacttttaaaagcgactgtttttgtcctatttgcccgttaatcctgctcgacagagctgttgcttattttgttaattttattggatttattgttaggattagttggaactagattcttttttatgttttggtagagaaaaagcctacaaagattgaattacggttgacacggtagcatgttctacgctaaaacatgccgagcacaccgtgtgcgctccactttggtgcataaggacgtgattctacaaatatattggaaacttgtcatcaacaaaccagaacttttggtatagataggtttcgtcgaacgctcatcttggaggaacatcatcaaggcaagtgtgtgctggtgtaccctaagggcagtagcagtgcagcgcacgtatagcgtgtctctgcccacctgaagcagcgaaaacagattcagagtcacgagcttcacaacgcaagcgcgaggaaatcacgtctccgctgtgatgcgagggaaccgcgactccggagcaacgaactccacagcacacgcgcccctcaagtttctgcgttgcgtgccctcgatgcgacgaaagaactcgcggtttagataagatgcgagtggctacgcaaaggcgcgagtgaaggtgacacgtccgcatgagtctgacctggtgcggtaaggcaactcgccaggtcaacgcattgtgaagggccttaggggttgtttggttggttgccacactttagttatgccacaattttttaggtatatgtttattttactaccgtaattgtgtcgtgccatactttcttagtcatgggacccacatgccatattcttaaatttggagctaagcatgccacacttgtggacaactatttccaagccacacttgtgccaacatacctcaactaggctaaacttagttatgtcaatgttaggcatcaaccaaacatcccatcacccaataaaacttagggcatatttgggagggggtggttctcgttgttgcattttttttccaaaatactcaaaacgatctagggtgaaaaaggttataataaactagaagccaggagttatgtatcaaccaactatttattaaaatcttaactttcctaaacaagaccttaaattgttatctttcatcgtagaactgaaaacaatttaggattagaaaaaaaaaagatgagagagaaataaataggtagaagtgatatattattatgatgattgggtatgaacggtttcaatcaggtttgacccccccccaaatatttgtatgaaggatgatcttgtttctatatatttttggtgggtctaaggataaagcagactactggttgcatgagccttggcgcccgtgcatcaccatcaattatttacgtagtactcgacaacttccttctctctcctccaccttagacttttctaccgtctataggttaatagatggctttggtaactttattgcacttgtcctaactgaaaccaaatttagttttttctatataagggtattattttactcggcatgtaaatccaattgaatatatgcatttttttaaatcaacttgaaatcaacttcagttgaagagctgaagatattagatacccaaacaggatgcttgtggaatggcatatagtagttagatgagccgtgagcggtaacaaaaattggaaaaatttggaaaccagccgacgcagcggcagcttacacgttgtctttcgctgacgatgatgtgttagtagtagcactgtagcagccaagcaggagcaggcaggagtagtagtgatcacggtgactcggaaacgcgccgcacaagccatcccaaaatctcctccaatttgcttggctttggaaaaaaacccaattaaattataccattattccataatcagcagcggtgacggcttggcttagcttaactttggctttagtactcatctcctactaagctcgtggacttttccttctctcgtcaacagcagcgcacctcacctccgccgctcgcctcgcctcgcctcgcctcgccttcctcctcccatcctcaccccgttgaatttctcccacctccgatttcttcttcctcgttgaaccattccccacccttcttctcctcctcatcctcctctccgcgccccgcctctgcggcgaggtaggtgttcgatcggtcggatggacgcgtcggatggccgcccgtcgccgcggagccggcagctgcagggcccgcgcccgccgcggctggccgtcagcaaggactcccacaaggtcaggaagccgcccgtcgtgccgcagccgcgcgggggcggcggggtggtggctgggccgtcgcggccgcagcagtcagcagcagccgcgggcgccggtcatcatctacgacgcctctcctaaggttattcacaccaggcccagcgagttcatggcgctcgtccagcgcctcactggccctggctccgccgccgtggcggcggtggctgctcccgtggccgctggcttccacaccgaggcgtcgtcgtcgtcgtccgcctccgcctccgcgctgccgccgcagttccagctgccgcaggagttcatgctctccccgaccgccgcgctctcccccgccgcgaggtacgccgccatcgagaggtccgaacggccgcttccccccaccaccgcgcactactacaccgccgacgccgacgaccccatcctgctcgacgtcgacggcgacgccgccgcctttgcggcggccctcggccccgcccgcccgagcatcctctccccggtgccctccgcgctgccgcccgcggcgtcgtcggggctcttctccccgctcgaccaggcctccctctcctggctcagcgacctcagccccttcctccactccgccggcgccgccgccgcacccccgccgccgttcgcgccgagcccccgcagcctgctgctgtccacgcccaccatgccgtcgccggcgaccttctccgtcatggaattcttcagcagcaacttcccggacctgtaaactaatcccagctcacctcatttgattactccctctcgcgtccgtgtcacccccggggttaattactttaatccttaattaatcttttaccgcgtgcgccggcgaggttaaaaagtaaaaaatcacattgccgcgccggtgaggtaacttccagcgaggcgggcgggttggcgagatggcacggtcgttcgattttttaatggaggaaaaagaaaacaatattctcagatattttctcctgtgggtgaggggaagttggcttggctaagctagcattaattgttggagtaggtgaatttctcttctcatacttgcttcctctcctactgttaatgtattgataatttgatattataatcagctttaggtaggctaacctctcgttggctttatttttcttcctctttttcttcttttcgttctgctgattgtgtaacttgtaaacgaaggagatgattgattggttgatttaatgctagtttcatttgttcattctttattaccctgagcccttcagacttggtcatgtatggttgagatgatttaattgccgatgattttacgtctcggtttaccgccggtgtctacctggctttttgtctggagaattctttggtacataaacatgtgtctgatcgatgcttaaatgttgaaagccttgttttgatggtaacaggaaaaaaataagcatcatgttttagaactagattagtataagagaaaataagctagacagatttcgattactacttgcgattctctagttttgaggcaactaaaatatttgaagatatatcaatcccttcaaaggtgatgtaccacaaaactattgatttaaaaataaatttatcataaaactatgtatttaaggtggagtatcgaaaaactatagatttattaacaaaattatcacaaaactatgaattttggagtttaaatccttagcgctagtgttatatttgagttataaatatctaagttttggtattaaattgatactaaacctatacttttgtgataactttgttactaaatttataattttacgatactctactttaaatctataggtctccgagaaatttattgttaaatttataattttgtgatacatcacatcaccttaaatatatagttttgtgataatttagtcaaagtatctgtagttttctgaaatttagtcttatttgttttatagaggggaaagttcattttatattcatgaactttcataaaagtctaaaaatcattccttaccttttaaatcagacaatatttatccccgaaatttcagtacattcacttttcattctatcaccagattcaaagtgattttggatgacatgtaatacatattatcttttgcgagctatataaaaaataattggctggtggaaaaataattctatagtactccctccgtttcataatgtaagccattctagcatttcccatattcatattgatgttaatgaatctagatagatatatatgtctagattcattaatatcaatatgaatgtggaaaatgttagaatgacttacattgtgacaacggatgaaagtactgttgttagccccttttttctaaaggaaaaaaaaccatactacctctattttttaatagatgacaccattgacttttggtacacg

SEQ ID NO: 75323 - DNA, 38247 bp, Oryza sativa
cttctactatcctgaatctccttgttaaatactctctagctctcgcctgacatgagctgacatggcatgccattttttcactatttccaggaggaagtcctacagattgtcaaaccacagcatttcttgcctgttcatggagaactcctgtttcttaaagaacatgaattacttggaagatctactggcataaggcacaccactgtaagtactctcttagcgatggtttagatatcatgggcaatggatttctgtaataagggggagactacttatcagtttaagtctttgaaggttatggtattttgaacaaacaaaatttatgtagtgtttgcttttcctccatgccccttgtaatcttaaattacttgcgtaaacaaaaggatttaattattattcactttaaactgtaaactggttggagctccgtttctctactctttgagcttcttacaatatttgttcatgcatctatctgcaaatgaattagcacttaactactgaagtatctatctgcaaatgaatttgttttttccttagttatttgtaaacatttgtgctcgggtcaggattccaagtatcagcattccatcatatgtattttttagccaaatgtaaaaactatttggtacttgttattgttcttagattgcttgcttcaatctcaggtaattaaaaatggagagatgcttggcgtgtcacatttaagaaacagaagagttttgtctaatgggtttgttgcattagggaaggaagatttgcgggtgaggatctattttgtccattccctttttcttttcttttttttggcttcacctactctaaatctaacatgatgcactgtatattgtagctaatgtatagtgatggcgataaagcttttggaacatccactgatctctgcattgatgagagattaaggattgcatctgatggcgttatttttgtcaggtaatattaaacaattttggtgcatttgctatggtgtttatcttcagtaaaaatctcctctgggatcaaatgagagaacaaattatattaacatgctgctcttgtgaaaacggcaaaatcatatatggtgattgttaacacttatcttgtttcttgcagcatggaaatcttccgacctcagaaggaacttgcttcatcacagtcaggattgaaagggaagttcaaaataacaacaagatgcctatggcttgataatggaagactattagatgcactttacaaagctgcatatgctgcattatcaagttgtccagtgaattgtccacttagtcacatggagaggatggtatctgaaatcttgaggaaaatggtaaggaagtatagtgggaagaggcctgatgtcattgcggttgctacagagaacacaacagtgagttttgtagaagactcagaaactaaatcatctggaaagtttggatctttctcagctcctaggcattcgagcaggagttcaggtaggagtcttgaagaaagtgataaatcatgcccagagaatacagagggagaggctaaaggtactattcgcaaagtatcttaatcttacctttgaaaatgtggcggtctaaccctatattattatctgtattaagtgtcccatcatactgattttcttgttcactgttcagattcatgaaattctgtgcatttgattccatgccttttgtgctgtctaagatgtatcgacactgtcgttactttgttacacagaaaatcttcctgatgtcctgagaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagccaggggataagtcgtacaccagcacagtgcaagtctctatggacatcattggttcagaaatatgaggtagatcattgacgtccttacagttttggcataaattcagtttatcttttttattgcgaggaaataattaagtttgacttgttttcccatcttgtggtatagcttcccaaatgcagatataataccacatatataagctatatgatgcataaggaaaaatagtcaaattatgtaatttctatagcttatctggttatatgtgcatcatatagcttatatatgtggtattatatctgcatcatgtactgcacaaacgtagcagctgacattgcatttgttagtcagaagcagcataataggataagcttaacccttcagtttttatttgtttggcaggagagcaagaaagatgaggaaagcgtaaagacgtggccgtatttcttggacatggacagggttttatcaagccaaggggaaatggcaacccaatgatcccaaggccgtagtttagtggttgtaattttggagagtgatggcataatcaatcaagtggcaggatgagatggctgcagcgtgttcttctccagagaatatacatgccataattcattccacgaaaagggaggcaggcacttggaatgactaagctgctacgtattcaccatgagtgtgctacagggctagggatagctgatattatttgatcaactatactagattaagtaattgaatagctaagttttgttgtgctattatttttggtgtaagaagacaccaaatgctaatccgaaggctttcaattgagctacccacatgcctatgcgtgtaaattaacatgtttgattgtgggacgtgatagggtggttagagcgaacgcatttatcaggtgttgtagtttgagggtaagtgggatgagattattctttaaaaaggaatattcatttaagatctaggttagctctataccttaaaaattaaggcccttttgattcaaagaaaaatcatagcaatttttaagaatttcattcctatagtatttttttttctatatagccctttgaataaaaaaatgaatcatatgaaatttctatggaatatcttattctatgcaagttttggaggaaatttaatacgaggtagaacatcatgggaagtttcctttgagtttttatctccttaatttttgtgtttttctcgtggtccaatcaaacagtcgtttctatgtttttcttatgttttgcaattctatattttagacttgcattcatattagaatcctatattttttttctatttcttcgtatttctattcctatgatttaaagggagcccaatggactaatccaatcgctccgatattgatatgtgggctatgtcatcctctaaaaaagcatatcatctctcacgtcaaatctatctttctaaagttggttcgtctcaagctatcttattgggtcatatggtaatgttaaatttttagataaatctaaggaaattatgcataaggaaaaatagtcaaattatgtaatttctatagacttctcaattatctgtcttcagacaaatctagagaatatccataaaaaaaataccgagaagcaaacaaaatgcacatcatccagattctggaggcttcccaatatccctttgcaatctatctatctatctcatgttgttggttggttttatgctagatgattagttgccctcaccatcctttagttgaccttgtcttcagataaatctagagaatatccataaaaaaagaaataccgagaagcaaacaaaatacacatcatccagattctagaggcttcccaatatccctttgcaatctatctatctatctcatgttggttggctcccaatatccctttgcaatctatctatctatctcatgttggttgggtttatgctagatgattagttgccctcgccatcctttagttgaccgacacatggtaagatataagcggcagaaagagcgttgggtaagaaaccatcactataaaactggcaagcacacaagttatgatggtgaattaaaaaaaagaagagtcactccatgtgcgtagctaggccacgcaacaccacaatccaacagtgcgtgatcgaactaagtgcaaacacgtaaaagaggggaaaaaggaaaaaaagatgaagcaaaacttttttgtaaaattatttgtaaattattcggggcaagtatcatgaccacatatcctatatttcgagaaattaaaaagataaatagaaaaataaatgacagaaactttttaatcccgataacctaaccattttctaaatatatatattttctgcttatactataaaataaataatatgcaaatcttttaacttttagaaaaagttataattccaataaaacaaacaatatcggtgttgatccatatctagagtcttaaaagtcatacacataggttaattagcggaagcgccaggcgttgcgttgattttcagttattcaaaaccacgcacattttactgcatctcacttcaaaatttttcgaaaaaaatccactcggcctgttataagcgtctgcattagccatatgtgtctctaaatcaaaaagaaaaataatttataccaatatattaagaagctcctccaataaataagaaatgactaaatcgatttctgataatcccaatattctttcctcttcatgggcatcctgcgaagaaaaatgtttagttttagacataattagttttatgggactagatgtcaaagttttgtagttagaattggaagaagcattgttaaggtaaactgaaccgacttatgctaaataacatttagctagctaattaactaagcaaaaatacttaaataatttaacaagcaaatttgagatgtacacttactcgtgaacccgtggactcatgctgctttatatgccttgaaaaaaaattagcaatcacggtttggttcaaaaggaagtccctcaccagtgttgatagctccaccctcattactcattataagaatccacatcattgttcacccaaacaacttatttaagaccgggaggtcggacataacattcacccaaacaacttatttaagaacaagaggtcggacaaagcatgcatcgcatgttcatcacaatttgcatgcttaacctctgcagtaatggaataagtgttgcactgttggtcttcttatgctgcagatggaataagtgttgcactgttggtcttcttgtgctgattggtctttgtatttttttccttttcagcttctaggacaggactattttgggatgattatgggacatcatctcctttcagtttgggatacttacatgacaacatctcctttcagtttgggataggacatcatctccttttattgtaggatgcgctaggacatccttgggaagaagggatgggttgcaaggggtagtgctggagatgctgtgaagttagaggatggggaaacagatgttaaggtctatggttgggttgcccgagaaggggactataatgccgggaatgtggtgggcaggtacttgaggaagcataccaacctgacaaccatatatgaggtctccaagagtcaatcagagaagtcggggaagatggtagcgaaacatctcctttttcactttttggactagcaacacacctataaatatgtatcctatcccgggtttgggatatttgtaggacatcatctccttttagttctaagatgtgctaggacagcatctccatttttactttttggactagcaacacagctataaatatgtatcctatccctcgggatggtatgatattcgtgagaaaataaatagaaaatgccgcaacactcccaatgtcatcctctcgataagagtaaggattctgctactaacaagtggtatttgagccgttctatactgtagcctgatatctcctgctcatatccttcccaagctcccctctattctcagccggcagtaggaacaccagctgttcctgctcatccctctttccctgcgttgacgagttgtgctcgtcagaggcagtctcttccccacgcagtagccccccagtggcgtgccatgtccgcaggacagtctcagcgctcggttgtctcgagcgcgcggctccggcaggatgccgagctcaccgcggcagaggaacgcgagcgagtggcggcaaagaccgctgcgatgacagcgagggcatcaaggctggcggcggcggaattggcagtggcaagggcggaagtggaagcagcagcggcaacggatgcagcgcgtgcagcggcggcggagctcaaggctctacgcggcagtagcaccagcagctctgtctccgcctacggcagcaccgatgatgagctgatgagggaggcagctcgtgagcaggcagagcagtgggctgccgcgcaaccccacgcgcgtggcggcagcagcccagataggcgcggacacgccggcggcgctcctggcggggggcacgcggcagcggcagcctcttcccagtcttagcgctcggtcacctcgagcgcgcggtttcggcaggaggccgagcttgccatggcagaggaacgcgagcgagcggcggcagagaccgctgcgacggcagcgagggcgccaaggctggtggcggcggaattggcagtggcaagggcggaagtggaagcaacaacggcgatggatgcaacacgtgtagcggcggcagagctcaaggctctacgtgacagtagcaccagcagctctatcaccgtctaaagcaacaccgatgatgagctgacaagggaggcagctcgtgagcgggcggagcgtgcaaccccatgcgcgcggtggcgacagcatagacaggcatggacgcgccaacggaccccctggcgggggcgcgcataatggcgacgctcctggtggcaacggctgggtcgatggagatcgtggctgttgcaggcggcgcgactctctctcacgggatccaggccgtcaacagggacgtcagtcccggcagtgggtggcctactctcaccaagaccaactacgtcaagtgggctgcggtgatgaggataaggatccaggtgcggcacacgtgggaggcagttcggtacaacgacatcgactacgacgaggattggcgagcgctggatgccctcatcgctgcagtcccgctcgagatgtagttctcgctttccaggaagcggactgccaaggaggcctgggacgccatcgctgcggcacacatcggcagcgaccgcgctcgcaagtccacactacaggcgcttcgcaaggagtgggagaacctggccttcaagccaggtgaggacgctgatgacttttccctccgtctcaatactctgctgcagaagatggtgcagtacgacggcgacaactacgacgaggagagagtagtcgagaatattttccgttgcgtcctagagaagtacaagtagatcgctcgctcgatcgagtctttgctggacctctccacgatgtcgatcgaggaggcgataggtcgcctcaagttcgtcgacagcgatgagccacaacctttctcggggcataccaccattggcgggaagctccatctcactcaggagcagtgggaggcctgtcaggatgacgagaggaagggggagtcctcttcctcgacaggcggccgtaagcagcgcaaggcgcacggaggtgtccagctgcagtgggcgcgaagacgcgtcgagggtggcgcttgcagaggcgcccagggcggcgccgctggcaaccacaagctggcacgagacgacgcctgccgcaactgtggcaagcttggccattgggccaaatactgtcgacagccgacgcggccaggcccacgttgcacaggtggaagaggaagagccggctctactcttggcacacgcaagcatcgagctacctccagcggcatcggccgcagcggctctcctccaccttgatgagccgaaggcacatgccttcctcggagatggctctagcaacgacaagactgatgggtggtacctcgacaccggcgccacccatcacatgactggcctacaagagttcttcaccaagtttgactccagcgtccgaggctccgtcaagtttagggatgcctctggcgtggagatcaagggtgtcggttccgtcaccttcaccgccaagtccggtgagcacaggctgctcactggagtctactacttccccccattaaagaactcaatcatcagcgtgggacagctggatgagaatggttcacgcgtgttggtcgagcatggagtcatgagtatttgggatcgccgccgttgtcttcttgccaaggtaatcagaggcaccaatagattctacatcctcagcgtgtaggtggcacaaccggtttgccaagccacccattgggacgacgaggagtggcagtggcacgagcgcttcgggcagctccacttcgaggctctgaagcagctcagtgccaaggagatggtacacgcatggacgacgacgttactacctgctgctcgtcgacgacctctcccactacatgtggttgatggttctcgtggcagcaagggagaggctgcggacgccatcaggcgcgcacaggctgctacggaggcggagtgcggccgcaagttgcgcgtgttgcgcatcgacaatggcagtgaattcacggcggctgaattcgcgtcgtactgcgctgatgagggcattcaacgccactactccgcgccgtacagcctgcagtagaacggcgtcgtcgagcggcacaaccagacggttgtggggatggctcgggctctcctcaagcagagagagatgctggccgtcttctggaagaggtggtggtgatggctgtctacatcctcaaccgctcgcataccaaggccctcaacgacaggacacgtacgaggcttcgcattgtcgcaagccggcagtctcccacctgcgggtcttcggctgcctcatgtttgccaaggagcacgaccacatcggcaagctcgatgacaggagcaccccaggggtgttcatcggctatgcggagggctcgaaggcctaccgcattctcgacccggagacacagcgtgtgcgcacggcgtagtgttcgactaagggcgagggtgggcatgggacaaggcggtggacgatggctcgactctgacgtacgacgatttcactgtcgagtacgtccacttcgagggagctggggagtaggcagctgttcctcctcaccaagcatacctaccccagtccccgagtttccaccgactccggcagcaacacactctcaagctacgacttcagttgcgacgagttcttcaccgacaccaccacaatcagctaccccacgcactccagcaccaacaaccaccctaatgggcacgtccactcccatgccagctcgtgttgagcatagcccggtagagttcactacttcgctcttccacaacaaggagcaaatcgacacgtaccacgatggcgagccgctgcggtaccgtacgatggaggaccttctcggcgaccagccggtgccgggactggtgcctcgtgacctagaggcgcaattgcaccttgtgtgcaatgatagtgagcctcggtcattcgtagaggccttgagacacgcggcatggtgtgccgcgatgcagtcggagatggacgcgattgaggagaaccgcacctgggagctttctgacctctctcgtggtcaccgcgcgatcacccttaattgggtgttcaagctgaagagggatgaagccggagccattgtcaagcacaaggctcacttggtggcacgcggtttcgtgtagcgggaggggatcgacttcgacaatgccttcgcccttgtggcacggatggaatccgtgtgactcctccttgcgctggctgctcaggaaggccggtgtgttcatcacatggacgtcaagtcggcgtttctaaatggcgatttgaaggaggaggtctacgtgcaccagccgctgggatttgcgatccccagcaaggagggcaaggtgctacgcctgcacaaggccctctatggcttgcggcaggcaccgagggtgtggaatgccaagctggattccatgctcaaggggatgggcttcgagcaaagcccgcacgaggcggccatctaccgatggggcaatggtggaaatgccctgctggtgggtgtctatgtcgacgacgtggtgatcaccggcaccaaggatgcgtaggtggcgttgttcaaggaagagatcaaggccaccttccagatgagtgacctagggcctctctccttctacctagggatcgaggtgcaccaggacgactccgggatcatgcttcgacagaccgtctacgccaagcgcgtcgttgagctggctgggctcaccgattgcaacccagctctcactctgatggaggagagactgtagctgagccgcgacagcacgacggaggaggtggacgctacgaagtaccgacgtcttgtgtggatccttcgttacctcacccacatacggccagacttggcattctccgtcggctatgttagtcagttcatgcaacgaccgacaacgaagcaccagcaggctatgaaaaggatcatctgctacgttgtggggactctcgaccacagtctctactacccgaaatgtcctggaaaggcacacttcgtcgggtacagcgacaatgaccacgccggcgatatcgacactagcaagagcacgaataggatgctctttttcctcagcgagtgcctcgttagttggcagtcagtcaagcagcaggtggtggccttgtccagctgcgaagccgagtacatagaggcctccaccgcttcaacctaggtgctctagcttgcttgactgcttggtgatctccttggcagagagactagagcggtggagctcagggtggacagcaagtctgctctggccctggcaaggaaccccgtttttcacgaacggagcaagcacatctgggtgaggtaccacttcatccgaggctgcttggaggaagggagcatcaaggcgagctacatcaacaccaaagaccagcttgcggacctgcgcaccaagccccttgggaggatcaagttcctcgagctttgctccaggattaggatggcccaactttcctacaagacgatgcataagacttagggggagaatggtagaataagtcttgtgcggttggtcttcttgtgctgattggtctttgtgttcttttggtttttagcttttaggataggactagcatatttcagtttgggatgcttgtaggacaatatctcctttcagtttaggatgtttttaggatagcatctcctttcagttttaggatgcctaggacaacatctcctttttcaccttttaactagcaagaaatatgtatcatatccccttgggatagtatagcattcgtgaaaaaataaacagaaaattgctccagctcttccagtgccatcctctcgatgagagttctcttccagcgccatcctctcgatgagagtaaggattctgctactaacatgcatgaacattggtctgccccatgtcaccagtactggtttccttactttttcccttggtcaattttatccttgatgtttttcctaccattttttgtatcgttttgccttctcttttttctccgttgtgcttgctgttgcaagtacatgattgtcctgtctagattgcaagatacaacgtaaaatgaaagccgcatatttccccaaggttttcaggatttgatggagattatctaaaactgcagagcggatcaacggatgttttaaagcaaagtaagcaatcaacaacttctgaaacttctttactgttaaatattatatcccaacaatcagcgtcccatgagagaatcgccctgatgcttaaagaaggctgggaacatcccatcacacttaaacattggtagaatattcttcgagaccactacaagatccttcaacaaaatcttgacgctgcattttggataaaatggccttattatttcaacaatataatttttagaacataccgtaacatgtacgctagtatatgatgaaatgggataaatcttctttgcagtactgccctccgacttggtcaaacagtagtgtagtgtgtagaggatttgtttatgatggaaccatcttatactaaaaaaattaggatgagccttaaccaatctcacctcatctccaaatcacagccaattgatattgcctaaacgaagaaaacgattaaacccgataaccttacgagcgaaacattttgactttatcatatatatctatctacctattatattattaaaacaactttgaaaggagacaccacgttcgctgcgggaactataaattctcacattaatcagaaaaaagaaaaaatattaaccgttagatcctaataagtctagattttaatggttgagattcaatatgagtccgtacaaaagttctgaaaaattgcagtccgtttagctaaagcacaaggaaaaagttgcagtccttcaaccatcggtgcattacagctggactatgcatcagatatggattgaagtatgtatggcatcaacaacaccatgaatgagatcctatttgcaaactgacacaaatcaaaatcagaatagcaccatgggagacaccaataaatactacccacatatgattctgtcactcggttggtgactaataataattcaattcggaatacaatattcaaaataaaaataaggccagctgaaaaaaaaatacaccatgtagaatataacacgaggttaattaaaacttagaataaaaataaaataaattctaaaattaaatttcaatactaattccaaagaaacttaaaaaatcattaaaatacgaaataaaattataataaaaactcaatctagatgctataaattcccatactcatcggagaaaaaaataaaaagaattcatgtaggtatacaattatcaataattaaaatccaaaataaaataataataataataatttgaaagaagagaccatctagaatataaacgatgttacttaaaatttagaataaaaaataaagtaaattccaaagttatttctcaatatgattttcagataaacttaaaaatatcattaaaatttgaaacaaaaatagactataaaattaaataagtaaaaaccacatgcaagaagagtccatagaaaaatacagcctataaatatccaaaagtaagagtaattaaaattcagaaaaaaatataataaattcctaaattaattttcaatactaaatcggtataaactttaaaaatatcatgaaaaatcggataaagtaggaatataatttcgaagtaaccaaagttggcaatacaatgttgttgcaatatgatatatgtgccctaaatgaaaccaccaaattttattttggatatctagaaaataccacatttacttatcgtaccattcaagccttttttcatgcttttcccgaaggtctggagaaagtagtaatcaataggacttcccttatcctcccttcctaaaaggaagaacttgaaattcttttttcctttccgcagggaccgggaggttggatctatccataagaggaatgcttggtataaataagacacttcttggtctttgacccccctaagtcactacgagcgccctagatgagtgcaatgggatgtggctatttatctatctcttgagtcaaaatggaagcagggcaggattaaaaaggatcttagagtgtctagggttgggccaggagggtctcttaacgcctggtaactttaaaaatatcatgaaaagtcggataaagtaggaatataatctcgaagtaaccaaagttggaaatacaatgttgttgcaatatgatatatgggtcctaaatgaaaccaccaatttttattttggatatatagaaaataccacatttattgaaggaaaaaaatgaaaaggctacaccatctgactgtagattaagaaaagaaaacaaatgaagaattatagaagaacttctagatgtatatatgttcaatttttattacaaaataaaaaaatataggattgacatttaaaaagggcatctcgactttagaaacgttttctgtaaggctgctggatggcaagctgctcaagtgaccaataatgagagctacgagagccagagagctacgagtaaggcaagggatacggtggtggcaatagttgtgggacttctaacgtaatcacatcgacgataagttccaatcttctttggcgccgacgacaaggaagaagagagattgcatgtgctaacgagtggataggcgataaagggacagtgaggtggttattgctatgggagagcgagccgagaggcaacaaataagtaaaatggtagtggtggcatctaaaaagaataaaaatgagcccgatgatgataaaattcaatgttataaagtgttgatgacaacaaagttgacggggcaaaatggcgggccacaatggaacaaggaaacaacggttgttgtgggagagcgaaccaaggggtgacagatgacaataaagaagggggcaacaggcaggccgtaaagaagtagggtggcagcagctgataagacatctaaaaagtataaaatagaaactcaaagatagatatgtttgatttttagaatcccaataataataaagagttggggcagcggacataccataaagtagtagggtcgcagcgattgataggaattctagaaagtgaaaaagagcacaacaatagtcaagttcgatttttaaaatcctaatgacaataaagagtagagacgacaacggataggttggaaaggagggtggcggcatttcacggaacttctaaaacttattaaaatggaatccggcgagacaacaaaatctaaaaagaataagatccaatttttaaaggcatcaaggatgatgaatagaaattatgacgggtcgagcaagtaagtaaaagcgtggcaaatgactaaagagggtgacagttggtatgacttttaaaaactataaaattgaaaacatgagaataataaggtttaattttaattttaagaatcccaatgtcgataaagagtaagtgtggtgggtaggtcataaaggtataggttcatagtggttgactagactactatgataataaagaggggaggggcaataagcggacagtaaaggagcatggtgacgacatttaattggacttttaaaaattataaatacaaaacctggcaagacaacaaaaactcgttgattatggggttcaacttttataaagtcctcagacaatgatattattatttaatagttcttaaagaaaattatgtgtaaaaagattaaaaaattttatctagatactagccgcgtaattgcgcgggccaccctcctgctagttcctttaacaagaaacaaccattctccctttctttcttccctcactttggcgaaatatttctaactttatggagtaccatattcctttccttcttacagttcatactagtctcttcttccctgctaccaatctacctattccgctttggcactttgccaaaattactattctccacgcacgcatgcatgcagctcgatagctcatcactagccaagcaagcttgccagctgccagcagcagctgagagtcaatggcgacatctcgccggcttacaggctacagcctgaccggcaggccgtagttgtggaaggccctgatggcgccgccgcggctgccggtcaccaccaccatgttccacgccgccggaacctgggaccggcagtcgtccatcccggcgcagttcacgtacctcagcgacggcagcagcctctcctccggccacgtcgtagccgccgccgccgccgccccgtcgggcacgacgaaccacgtgccgaacgagcaccgctcccggtcgtagcacagcgtcggcgcgtccgctccgccgccgccgccgcccatcgccctcgcccacggcgccaccgccgtgacgccctcggagaagaagagctcgcgcgagctcaccaccctccgccgcctgccgccgccgtcgaagttccagatgcggatcttggagtccctccccgccgatatcaggtacctgccgtcgggcgtcagcgacggaggcaccaacaccttggacctccattgtcctggaaatataataaatgcttgattttttgaatattccaaaacatgatgacatatactctccctgttctagattataagtcactttgattttgctcaaggttaaactgccccaagtttgattaagtttgtagaaaaaatagtaatactttcaaccaaacgtaaaaatatattatgaaaatatattcaattatagatttagtgaaactaatttggtgttgtaaatattattattatatttgtctctaaactaggacaaacttaaagtaatttgactttgaccaaaatcaaaacgacttataatctgaaactcaaacggatggagtactatggccctgtttgggggagcttctcccagctgcttctgctataagctgccctaaacagtccacagcttctgagaatttgtagttacagattctaaaaaatgaactaagaagccagaagctggagaagctgggtttcagagcttttccagattctcataagctggctaccaaacagctgcttctcaaaatttaaagctccctcaaacagggcctatatatatcaagtgaaaaccgcttatgaaattttgaggagatttgttttcatacaatagaatggtgaaagagactgaaatgaagtcttttataccttgaaacttttgggtgatcttatgaccttcagagactcggattttgtgatctttcgatgtgattatcatcctagatggatggccctgagagaactgcatgagagatgacaataataatcaattggccggtattcgtgtagcaggctaaaatcataaactatatatatatgcatgggatgaaaaaaaaatttaagcaactaacctgaatattggtaatcttgttggcagcacaccgtctccgctttatgcgcatcagtttgttcctttcaatgtttcgacctaatgggaaaagacctattgggaaagaaaaataataatgtacaatgcttagttaataacaacattattccctccttgtccttaaaatgagaaatatctgaaggatcagaaaaataaaaataaaatgcagtcatatataccagattgatcatagaagcggcatctccctttgacagaaccgacaacgaaaccctgacaagggtaaaatgcaagaatcagcagctagttactgggaaataaaattcaatgacattttgataatcaatttttgaaaaaaatagcattttgataaagcatgaacctttccatctggtcggtgacttatagctgttatgatgtattttgtgtcatcccaatcaactactcgcttgtctgaaacatcccaaacacgaactttgccatctattgagccactgatgaagtacctttcatcaactggattgaattgaacacatgtaactgttgacaagaaaagaatatcaggtcaacatcattaagttgaatctactacataaggaaagaaaaattaggaaaaaatattttgtgggcaattaacttttttaggaaaaggaatatatttattccggcctcttcataagccatggactaaaccattcattattacaaagaagtatttccagtttaaaataaagaatgctagcaaaataacacgttcccagaatttgagctttgaataaaaacgcttaagcacaaagcctgtttgatatttccatcaccatagttaactgctatgggatgtttgcacataccataatctccatgtctgaatactgcaaggcagtcataacagccaactttccacatgcgtattgtcgtgtctttcgatgaactcaagagaaactgcaggaggtatatactactagatcagttcataccaaatttaacattacacttctcacaaaaaaaatacacttcaatcatttaaatatccaaactacatgagacagaagacttacatctgactttgaccatgccaaatccaggacatcacttgtatggccttgaaactcatgcagaggtgtctctgtgatactgaaaaccttctttggtatgatcgcgaggggcttaattttcacgtccttcttcttgttcatgtcttcaggaacatctctgccgtacaaatcaggcgaagattcaacctctgtgatctgccaaacgcgcacgacgcaatcctcgccgccactggctagatgccacccggatgaactgaacttcatcaccctgatcaatccctcgtgtgcctggatctcctggcacatgtagacggcagtgaagtccatccacttcttgttctgctgatgaacttttgtcctgtacaatgtgcctgagttcaatcctcttggttggacatgtacatcatccatggaaagtactctatctgaaaccttcttcctcatgaagatttcccacaagctcttgaattcgtttctcttagggccgtgaccgaagcgaatgcgcagtagttttcgcattagtttagagaatccaggcacaatctcaggcgcatttggagtcaccatttcatcagatgatgttccagcctcctcaacaatctccgagaggacatcgtgctggccttgatcatgagatgttgtgcttctccttccactactgttataatccacatcccttgtgcagttatcagcactatcattagtattgtctgttgctgccaaaatactgtcagagaagcaagaacggaaggaagagcagatgctactgatcctctcctcgaaatcgtgaaatgagcagcaatccgttgttgcgatttctgccagccactgggggaaggccgtcccggtaggaccgggctcaagaaaccccattcctttcaggaatctgtgtctcctttctctgacactcatcggctcacctgcccacagctcgtacccagcttcacttgtactaatctccgttgagcttctgttcttatcgtcgtcgtcgtcgtcgtcatcgtcaaacgcgtcgaagaagacgtcgtcttctccatcatcggaatagtctgatcttggcatgttcatcagctactttcaaaccaagcagaactgccaaacaaggccgtagatcgtaggatggacgtccttaattactcagtcagtaggaacaagtacattttggtatcttcaagaattcccaactgatgatccgacgtaagtgccaacaaagtattagacaaggaaaaacattagaacatgatcgacgggaaactattttaacagctcgagtggatgtctacccgtttattgcatgtcatctaaatggttatgaaaaaaattaaaaaaatatgaataagatagatcaatatctaatgtatcaatccacaaacatgcaagttaaaattcaacttctacagattgtaacaaaaataacaaataaaactcaaattactatatgtatatttacagttaaatttgttagttttgttacaacttgtagaagttgaattttaatttgcatgtttgtggagtgatatattacatattgatctatcttgttaatttttttgaaaatttttcgtaatcatctaattgacatgcaataaacgggtggacatccactcgagctattagaatccatcccccatgatcgactgaactactacaaatgaaatacatatacacgcacagactagagtaagtagtgaaggaaaataacgaagaacggaataggcgaatagcccatcaacacttcgaacatgtatcgaattatacatagagatcgttatgtcttgaaccaaatggagaacactttgattaaagagaagagaaaattccaatccagatgagacgagaaaagctagcacagagtgatgccagtttctgaagcccggagttgctgctgcactgcactgcacagatcgtgccgtgctgtactgctcatctccagccgttgtcagcctcacgctggcagtagcaggattcatcaagggaagcaaaacaagagtttcacaatgtgcagccgctgctaactgacaaaaaaaaagatacaagagaaacaaaacacaaaaagattgcactagaattcttccttttcattgtgatggtatactactgtatttcactagaagcgcagatacgtactgtgccatctccagcaataaagcgcgtgaatccaatcatcccatatcatggatggttgacagtgagagttagatgatcagaggacaaaagaaaaaaaaaagaaaagaaaaagaaaggaacaaaagcaaccctgccaacaagacaacaccaataaataatcccaaccactaaccactgcaaagaaaaatcttttttttgagaatgtgcagagacaaactaaaagcactaaagcagcaatgtactcggatccttttcttggacctcatcagtttccgatgatggattgatcgatcgatggcatccgatccttctgcaaacatgcaacttttctttctttgcagttcttgccggcaaccagggcgtcacgtcgggaaaccgggaatccgacgacaggaacacacacgcccatgccacgcgcgggtcccaagaaattacgacagctgcagaggccagcaggtgatcatccatggtagtacaagaagacgagagagagacggctgcacggtgcagagctcgtcggcggctgacgcgtgtgccgccgccgccgcaagatctcattattctcaccgcgacggttaccgttgatgtggcgtgcaggtacagcggccgtactggcagtaaaaacaaaaagacgcgatcttttttttttatctgttggtacggcgctggagggaggaaattaaattaacctccattaatgcaagcgacagagaatcaagcatagataagcttgaggaattcacttagttttctaccgcaagatagagagtcgcagacagcaagcataagaagcagaaattcttatcaaagagactgaattgttcagagagtactactactgttccattcgaacgaccaaaaatgcaacgatcatctcacaactctatccatcgctaagcacatcaagaagcgagaggagaaccaaaaaaaaaaaaagaaagaaagaaaacaaaacaaattcagacagaaatgatgcagaagaagaactaacaccacagcttattagctcaaagtctcaaaccaacagcagatcgctcacctgaggcattcatgatcgttctcttccggagccaagaaacagcagctagaagaagaagaagaattctcaggtcggtttcccggtggtcgggagggttcttggcgtcgatcagcgaactgaactgaactctgaactctgaaatggtgtggactctgaagaagaagaaggagaccgacgaatccgacgcttaaatacgtcgtgtccggtgcccctctcgccccccacgcacgcccggtattgcatatcctgtgggccaattccgccatggttttgccgccgctgacaggtggcactcgcctcctccctccacgtggacgtgcacgccccggtatcccccttccaccaggtggtctttttctggactttcccatgcataagcatgcaaactgaccgtatgctttgctgctgtacatgtgatgtgatgggggatgttgtttgcaatttttttttttgcactgttcgccgctggcatgtgggcccggcttttcgtatggctggagccctccacacgcgatgcacaataatcatcggcaaagcaaagaatttcgtaaacgatccaaaaagctagctagctagccactatatttcttgttccaggaagcaaaccaatctatcaaaacgtacctgtacgtagtgattccgaggaataatggtcgttctcgatcgtcggttcaccaaaaatttgccttcaaaatgtgtattggaatttcaaatctaattaagcatcagatttggagatgtggaacgggaaaaaccggttggaaaattttcagagcaaacacattgaaataggttgacaccgatatatgcagaaactaaagaatagacaatgaaattattcatcgaaatttcttaccgtacaatcacgttgtagtcgtagcattcaattctaaattgatagtctgaggatgatcaccatacttctagtttcattgttttgcaataattttggtgcaaaaacagttctctgtgtactagccatataaagttgccatttcaaaaaagcgcgggagcaaattaataggtgtctagaaagggctgagcgaagcattgcggatatatgccacaaaatttaaaaaagctaatttgagtaggtctaagcttagcacgatgacggatgcacaattaaatagaagcttcgatagaagcgagcaaagcataacggatactagaaaattaaataggagcatggctatagttgagcgaaggacaagacttgtacgacatcttgatactaaagattggtgggccataatttaccaatacatctggacggacaacaaattaaggcaacctgggctatcgttttaagaattgtttaattgggccataatatgattacggcatataatatttatttttatatatgtccgttttgttttttaatctgaaacggatagatctataaagtttcactcaacatcatggttagtaacctcgaaatatttaaggcttagtttagaaagtctgaaattcccacaacttcaaaaaagaaccgccaacaaaccaaacaaaaagtggcaaaaattaagaaagaagctaggatctattttgtttccaacacaaatatttttctccacctcttgttcttctaacttttattcctatttatcaatacaattgttagatatcattccatatcttataaataaaggacaataaaaggaaacagccaaatatgatttcactctacgtaccaccaagagtgcaagacaatattcttaccatctccaatagatataacaataaattttcatgttataacgggaaacaagcgagttaaccgctaacataataatgtttttcgttaaataattagtatatattccctctattcttttatatgtgacattggtttggttcaaaatattgtactaaccaacactatatagaaaaatggagggggcacacacaatagcatatataatgtgaagctcagatcatttgatggcctaaaacataggacgatggtcagagttatatttttcatgtatacagtactccctccgtcccgttatatttgacgtttccgaccagatcgtgaaaattaaggaacgtgtgaaattacatatttgccctgggccttctcctctcaacgcgtgagtcgccgccgcgagcccgcgacggaagaaagaggcggaaacgccgccacccccaacgccggaaacgccggccgctacgcccagccgccggggctcacctccaagatgccgccgccacccgtactcgctggaaccgtcgccgccacccctctttgccggagccgccggcgctctctcccgacgccgctactcataattgggcaccccaggcctgagacccagcagaatctttggacaaaattttacaacacttgtagtaagatctcatgccctccttttcacctacaacggcatcgatcgatcacctgagccatttgccatttgccactgatctatgaacactgtaaaaccttatcatttatcaggttcaggcacgctgcaactgctgcatctgccaaattgtgcttatcctgtgcaagaaatagctatagattgactcggccgggcaggtgagcagtagaacattcaaatctccttttctaaagatgaataaggaagaatgaatcagttgtgtttacaatattcagattttactttaaaagtttgtgtttttacagtattttcagagctgctcttggattgccagtttttcggctgaaatttcatagcagttctgatgatttactcccttcattgcccactcagaaaaactctcttttgcagtagtacactagtttatcaaatttcaacgtccaatcttctgggaaaagaagattcagaccatcatctgccagaagaagtgcattcatcatctaatgcaacaggacagtaactcctgagctatgcaaacaagtgagttatataatgctcagacagacaaagatcatcttatgttgaatttggctcagtaattttcagtgggcagatatgctcggacagacaaagaaaggctgacagtgtcttcagacttgttcagttgcagttcaactggaagagtatgtattgagtgtactcagttcttgagtttcattttatttacaaaatctgaattaatccttcagtagaaaccatgtttgccgctgggctgcttgaaccttcctggcttcatctcctagtagagcaatattttgtgcgtcattgctgtgaggtgataataggactaaaaagtgacaatatggtcagattttgtgaggtgataataggcctgaaaagtgacaatatggtcagattttgtgcatgttgaaattcagattttgtgataatgttggagaggaagaatccaagagcaattaggatgtgactttcagacctacattcagattttgtaatagtactgttcatttttaaatcttgaatttacttcagtttttttgtccccttagcagaatttatgacagttcttatgaattcagcatttcactgtgaattcgcaggacagtagtagcactccttgctgaaaccttaggttacagcttcatcaaagcagacaactaccattctcaggcaaacaaaggtctgaagaactcatcatctcacaaccaacctacatttccctttttcatttctgaacttctcagttcctccctgtccctgacaacagcaaagatgagcaagggcatccactgtgtgctggatgaatcatgccaaaaaccttatttataagccacagacaagtgcagcagctaagctagctcaccttcctcttcaccaccaagaacgcaagaacgcagcgagagaggaggagattcaagaaccggaggaattgatgtcgtcttcggctgtgattccgccgccgtcgccggagaggagggtgccgatggtggccgacgacggaggtggaggacatgggacgagatggtggcgtccgtctccatccactacttcatctgccacatgtgccgccacgccgccgcccggggctcgtcggccttctccgccgcgtcgtcggcgtcttcctctgctgcgccggtgcttcccgtcgtggtgcgtcccgcgttggtggagcacgcggcggacatggagcggctcatctcgcagctgccactcttcacgctagcgtcgtcgttggcggcgctcccgaagtcgtcccgcgcctgctgccgccatcccctgcttctccacgccgtctccggcgaggaaggtgactgtcgccgtcgaacagaggggtaaagatggaaacggtttttctgattgtactgcagcgtcaaacatttagactccttttaaaatgaactacaacgtcaaacaaaacgggacggagggagtaacggatttaaagtgtataaaagaattggaatggacgacatgtacgacaccaacagtgacctcctcatatctgcatggacggttacttgttgactccaataataaaagaagcccagtccaaataataataataataataataataataataataataataataatctttacctattataaaaattgaggatgattccatactcaccttagctttcgtccgtcatccgagttaaacacatataaaacccggatcggactaaaaaaaccatatagtagcgatacgactgttggaccggaaaaaaactgtctaccggcaagaaaaagactgggaaaaccatctaccggtgacgtggactatatactatgcaaaaatcagggatacatgcatgtgtgtgtgggattcaaactccggtctcctagggtacatactacatgctgcgctcatctagccaccagagcaatgtggttattgttttcttaagaaacttttctctatttggccggtttttaactcatcaatctccatcctcaatcttgttcacaggtccatgttacatcgcttctatgtcatctcagcttctcatgtgttattgcgaattctcacatgcttatcaagggtctaattggggaaaatttatacatcttttgggaacgcagtggaaaaattccatgcccgtattagggtagaatatggctcgagcagagggggctgccgcaagcgctttactggcatatcaaggcaaagcgtcgtccgagtccgagtcgtctgactcaataaagcgacgtgtcgttcgtgcatgataatgtagccatccgattctgactcggtaatacgtcgtgcatgcatgagaacgcagctggtgcgcttaggacatgtttttttctcatctgcatcgcttccccatgcagaagcaccatattcaatcaatatgtatcaatataattatgatttgagccagatatatatgatctaacaatctaacattgaaacttgaaagtcattataattggagtatgtaaattatttttatccgttgcaacgcactggtatttttgctatttattataaaatttaaagatgcatgcatgtttcataagcaagaaaacttctggctggcatgacatacggagcgtatacgtacgtgatggcgaccaaagtgatcgaggtttattttcccagaaaaaataataaaaaagtgagtcatatattttgtttcatgtctgccacggtgacagcctctggcctaagctagatcactccaaaacgccatctccagtgacgcacgctgtatactatagctactagcaaagagttatgccgtgtaaagtcgtacatacatacgatgtaccgttgattgatctgagaatttattatggtaatagttgacagttgttatacagtttcagggtcgtgttggacgtacggttaattcgcacggtaaatttgaagtgcacaatggatggatgcacaggatcttgcaaatgccaaattcttttccttatttgaggctacttcgtctcgatctctcttttcattttgtcaaacaagattatgtgtgcatgcaacaaaagaacgactagcttggaatattaacttgtacaaacacatgtttcgttccggcaacaaatataactaattaattgcaatagttaatatagagtacctccaaccttatcacaaacctatatcaagagaaatatgtgttccatgctccatctaatatgcagccttatctttttcttatacttatcagccaaaatttaaatttttcaaccttaaatttgaagctgattttgagtttttttttcatcgaaatttatgtttcagcctttgcttttagatcgctaagaacacatatataaaaattttattcacaaattacttttcatttgcaaatatgcctttctcttattccgcgaaatataccttaaacgatggctctgatgctaagtgcaccatgcatgtcggaattatcaacctaggatcttacatgaagaactaaaacgtcataataaatccaccttataagttagttaagatgcgaaagcgtgccaaaatctgtagccataatcatgagttgaataacaccaaaacattaggcacacctaatttcttaaactattgacgaggcatagtggattggtgcgtgtgccccaataagttgctggatttctattctaacacatcacataataggaaaccaatatccggtctctacacatatataaaagtacgcttccatataattaattagatgcttagatctcaatacaactctagttgatcgctttgtttttaggtcaactagtcataatagccataatatgttaatgccccccatagaaatttattctaacaataaatgcattaagcatctacttcagtgaatggaccaattaatagtagccaaacaacatggattgcagaagaagtacaattaaatagtagggaatacattctgcacacagttttggaaaaagaattttctgaagacactcttgattccatatatatatgtacacgtttgtttccttgaaaaacagatcaattgttctggcttcacttttctaaccacaaggggtagtaacatatttaaatcagattttgctaattggcatttgataaaaaaaattagagcaatattgtaatttatggagcatgggatcttctccatccactcattagcttccggggttagggttggggttggggccaagggggaaagatcccaatgatagtggtgaatacgggttggggggagggggtgtcgttagcaagccagcggtggtgccgccaaagcagcatagtcggtggaggatggtgcaagcagtagaggcatcttggccaactggttagatggtagtaagagagctgctggaggtaggagagatcgacgatgttggggaaccttactagagagctgcttcatgaccgtggttgtggagaagggtggttgattacagagaagaggataccggcaccagggagcgacaaaaggttttggtgggtggcggtagtgacggtttggggagcccggcatcgccggcgttggctatcggtgttgaggaaggaggcgcatagaaggggctgggcagcggggattggggtgatgtgactggaatgtgggaaaacaagaggattaggttttctctctttatatatgtgtatcagtgtttgagagttgatctagcccgttgaataatctttatttgagggatgataaaatagattgagatgggagaggattttcttgctaaagttgtataggccgtccccatttaattgtcacagttaaattgtacataattggctatttatggaaaatgcttggttgccacatcgtcgcatgcagtatattttcagcaccatggcctacaaaatcgttattttaccaagatgttctttattatttgcataacaaccccccccccccccacacacacacaaaatgaagatgccagtgcttgaatgcttattgtgacacaaaatttaaataacaaaaattcttatattttagaacgaagtgagtaattgacaaagaataaacttaattaattagttagttaaatatccgtaatctttatgcctttagcccttttgttagtttgtcttcacatcacagcagagaagatgggtggcagcagctagcagacacacttcatcccttccattccagccattccaaaagcatatgcccccaaaatctcagcatccctaccactccagggagaaaaacgaacaatctaggaccaatttaacatgtactagtacaattgttcctatctactactactctacacactgcaatttcttctcccctatctaaatgcagcactagctagcaatctgaaaccctatcaagcttccaaaaagccaattcggtcagcctaaaaacgaaaacggccgtctttgtggttgtggcaaaggcaaaaaggagtacagaagctttgtttcttcttggtctactagtaattcagttggtcccatgcatggcatgctactacttaggtcccttctagaacaaaacagaaaaacataaaagttgtagaggatttaaatcctatatatgggaaataattatgaagcattttaaaacaaaggattgattgtgtcaatgttctagatatgagataccttatacttatgtattatggctaggcgggctcaccatatacaaagtcctatatagaatattgatggttgttcatgtattcatctttatttcagggatctgaggcatcattttgggggatatgatatcttaaggacatgagggttcaacgaatcgactcaattcgagctggttgagagtcggccttttttaaggctcctggaacataaaggtgctgattctaaatttatcattggtgccagtacgcattgttgaattagtgttgcatgaaaaaccggcacctatgaccctttacaagctggcaccaaaggcgttcatttctcagccctcgtttctcattctcttctatttcaacatacaatctatatttatacctaatttaacaccataataattcaaatgtaagaatttaaccatatccgaatatacaattactcaaatataagaatttaaccatatccaaatatacaattacattgtacttctgcttagaatgtgtagttacagtgtaactacgatgttacatcctagttacatcgacagttttttagcgttttttagttaacaatttatagaacgacacccatataggtagtcccttaatttaatttaaaccgtgtgggtcgacggaaaacatggaaggtgtgagctggtcaattggaactgaagcccaaaattttttttcttttaaggaataagttcacctgcggttcctaaactttacatcgagtttgtttgtcatcccttatttccaataccataaatcttcatcgtaaactatacaaaaccgtacaatctaggtgctatagcaatatatatgtctggtttcgttgatgtggcatcctagttagcaaaagaaattaaaacaatgtgaggctcacatgtcagcgcccttttctttattctcttttcttccaaagcctcgagggagagggcggtagccggcgggagaggggcagccggcaagcctaccttggacttaggtcgggctccaaggtcagcaccggcgcgaccagacccttgctgcggctggttttggtactcttccaaccagcagcatggtggaggacaggtttgcgcaggatgaggggcactacatcgacaacagccaccgccacatccccagcagcggccaagaggagggatcctgcagccacgacgtcgtcgtccccaacaaccacgatggtgaggaggactatcacgatgacctcgacctcgacattctcttcgattgcgtagtcgtacctgtcccaggtggccacctcaactcaaatgccgccgtcttcatccccatcaccggtgggagccaggacctctactttgccaacaccaccgcttatcgccacctacatcaccttgtatgtgctcgtagcagccggtcacggtggaagaggtggaggtggaggcggccttggggcggacagatccagctcccccgccctcgcgagcggcagcggcttagggggcgggtgctgccggtgtgcggattcagcgacccccgctcttgggagtagaggaggcgccgccggccgtagatccagcacaccgcctgcagcagtagcccatgcgatggcccatcgccaatgtcacgccgaccgcctctcccctcgcccatctcccgtcggttgcctctcccaccctctccggctggccgtgtggcttgggaagaaaagagaagaaagaagagggccgctgtcatgtgggcacacatatttttttctattctttttgttgactagaatgccacgtcagcgaaaccagacatctataataccatgggacataaatttcacggttttatatagtttaggggtgaagatttctgatactgaggattagggatgtcacacaaactcaacgtaaagttgagggatgctggtgaacttattcctccttttaacaatgatgcactagctcggcccgactagttaaaggccatcaaggtacaaaatgggcttaaaacgcaacaacatggcgacgaaacccatgaacttgtgcatgtgggcctcaaaaggcaacacttgctagtacctgccctatctgccgctgatcggcttatttctgcgtgtgtgtcggtgtgtgtgtttatccggaataagttcacttcgtaaccctcaaatgtgatcgaaatccatgaccctaaactacaaaaccagatatctcgacccccaaactcctaagaccggtgcaatttgactccctcgatggttttggagggtggttttgctgacgtggcgatattgaccgagtcttcgttccacgtgacgttgacgtggcatttacgtggcagcagaattaaaaaaatatttatgggacccattagtcattcataaaaaagaaatatggggtccacatgtcaatcatcttccttcttcctcctccctctctcccttctctctctccccttcttcccctttggcctgcggcgggcgatgagaacgagcagcggcggcctccgcgcgtccgcgcgtgccgctcctccccccgcgcggatggccgacgtctacctccctagcatgcagacggccggcaacctcctcctcgcgcgcggcgctgccgtccggctggcgagctcctcatctgggatgggaccccaacgccgcctggccgcacatctcctgcaaccgcaccaaccacatcaacaacaccgacctccccggcgtacgttgccgccgcgcaacagatgcagagcctcagcctccaggacgaggcaacgtttgatggcaatgaggtagacatgtagagctcgtctccaagggtctgcaaggccaccatgatggcttcagcttgatgtatcagccatcgacccatcatggccgccgacgcaggccgccgtcgatgttgtctggttgatggtgacagctgcggtggcagaggaggaggagctgaccggatgcggcttgggcagtagttgctggtcgcctgcgctgaggcagtggcgtgtcgcgaccgtgcgcaagcggtggcgccgttgtgtgagctacagggcggagcgcctatgcatagcatgggagagaaggggagagaaagagagagaagggagagaaggaggaagaaggaagaggactgctatgtggcccccacatgtcagtgggcccacattttttttttttgtgtgaatgactaatgggtcccacacatattttttaattctgctgccacgtaagtgccacgtggaacgaagactcggtcaatatcgccatgtaagcgccacgtggcgccatgtcagcaaaaccatcctccaaaaccactgagggagtcaaattgcaccggttttagaagtttggaggtcgagatatccggttttgtagtttagggtcatggattagatttcgatcacatttaaggatcacgaagcgaacttattccgtgtttatcctctccctctttggtgcttccgatatatagtagcactctcatgattttaagagaaaaaatataatagtactctctacgtttccatttacgaagttttagcatataaaaattagaattattattaaaatattcattgtgatattcaaaatatttttagagacgtctttcctttcttcattgagtactattcctttgaaggaattgtactactacctccatttcaggtttcaggttataagattttttaacattgtccacatttatatagatgttaataaatctagacgcacatatatatttatattcattaacataatatgaaacagaggaagtacctgttttgagaacgattattatgatgcaattgataagagtagcaatgtaatttatgagttatatgacactttcttgtgagatttgatagagccatatatccgtatgtgttatggtgtctggatgtgaatttctctctgttattctatatgtcatattggttatttcgaacctcatatattaaaaatggcggtagtagtttgatgaattttaaattttcacatgcgcctccgtctcctctcaggttctgagattcagaagcttcagcgtgcatgtatggtgattaatttttcttagaaatattgtagtacaaacacactcactcataatataaatatatgtatgctcatcttttttaatacacacgtatattctacctttattatttccagtaaatcgaaccattattttaattagtctcgtgcatgatgcagagaccctggaaagggcgatcgagaattctctatcaagtgtcaactcactggcactgcacgtacatccatcgtagacaacagtttcacaaggctctcgcaaatgcacgagcatatatatacgtatgatttgtccctcgtccatcgatttaattagctagcttttggtttgtgttgtcgcacacaagagaatgatcaatcatgttgtccacagctgccaatcgatcgatcgagctttatttcgcctttaagcaacatagtagcatcgattgatggcaatatagaccactcccttcctcctcctgctagctatagccccgttcgacaataacataacggatgaagattaagtgttgacatacacaaaacgagaaaaaacacatggttaataatgtaaaatcaaatgtgtttttgattattattctgtgatgaacaattggcatcggagattattggttttgatatttggaatttattcacgaagtggttttggagatgattggatttcacaggtgaatctacaggtactgctggaattgggtctggtcagaccgagcaggtgttgccggtcagaccggcgtgtatcgcgcggtcagaccggcgcagcccgcggtctgaccggccgacgctgtgtcggtttcggtttcgggttgtttgtttggatatccgtgattatttcatgattatggcttttagatggatactatacgtatgtaatactgttgtttgctactaatgagtcaagttggagatagcttggtctcggaatatggtttctttgtttatttcatgtgtaggtgactcgatgcctcgggagagtatttgcggtgatggaccgggagtcggctcggggataagacgacgtccgtggtggtcagagatcatgcgggatacttaggctagagttgatgcacgtggttgatggagattccatatggcatacgatggaggtattgtgtgcgtatgggatgcgaagtcgaatttgcaaggagtccaaatttagtatgattggttatgtaaagtttgtttcttgtactagagggtttcctagcttgccgccggtcttaccatcggtgagtcgttggttagaccgctaaagcccggtaaaacataaatcgaagaactcttagagtagtagatgacgactttattgattctctctgtgtttacaaagtgcaccaacaacactccttacaaaaatttcgactaaactcgaaaccctaacttaaaactcaactcaattgctctccaaagcgataccgggaagcctcatgctccccctctatttatacccgaggtaggcagcctaaagtcacgaaccaaactcatactaaaagttctaaacaccttacaaggcgacggtcagaccggcgggagcgaggcggtcagaccggcgacggcaacaggcgcggcaggagacttcggcgatcggaccgattgatctatatcggtcagaccgacggcatccacacggtcagaccggcagatcaatctcggtcagaccgatctccgtcgaatttgagggtaagttttatttccgctaaaagtttttggtttttgggtataccaaccattcacccctctctggttggcttagttattgtgattcgatcctacaaataagacgtgaatgttaggaaaaaacctaatatcaataattagaaggggtgaggcttcgaacccaggtcgcctagcctaccactttgtggagttagccggaacacccctggtgtttctccatggtttattaaactttaattatttcaaactctaaaaattagatttacttcatattttagagtaaacttcacaaaactacagatactttgaccaaattatcacaaactacagatttagggtgatatatcacaaaactacagatttaacactaaatttctcacaaaactacaaatttaaggtagaatatcgtaaaactatatacttagtaataaaattatcacaaaactataggtttagtgataatttaatcacaaaacttgcacgtttataactcaaacataacactaatgctaaggatttaaactctaaaatctgtaattttgttattaaatttgtagttttgcgatactccatcttaaatctgtagttttgtgataaatttagtgctaaatctgtagttttatgatacatcactttacatctgtagttttgtgataatttgatcagaatatatgtagttttgtgaaatttactctatattttataacatcttctatattaaaatatatgtacgaaatataccggttagctgtttaaaaaatgtgataataaaaatgaggtaaaaatttatatcttaattaatcagaaaagaattaggtcctcgacctagctagctctcttattctgcatatagtagagtagttcatgttgaaacgttattcctgctcggttttctgtagagaggaggacgatgcctaatcatggagctcatgaatgttcatggaagctaattaatcagtgcacatatcgatatataatatcagaccgtaaatcttggctgtcaccgcggtgctggtcgtcggacaaactgatcgtgatagatgccggtgaagatgtcgctaatttgctggcacaaacgtttgaaatgttccgacaacgacatggaagtggaatgtcaccaagttgcctccttgccggcataacgagttgatgggggtggattttcagttatacacccttattgtttgggatgccctaactctcttaaaattcataacactacgccggattagatcacctttgacggactcgcgcaccatcatctttgatgggtttgaccctgattagagatgaattgttactgatgactacactcaccccgttaatggcgacagacacctctaatgggcccgtatatttttggctcgtcaaaagtgaggatctccacaaatcaatatgtggttgtaacccgttagagctgagacacctgtgatgggtgcaaaattcacggcccgttagagatgaccccatctctgacgaatctactttggcgcctgtcacaagttacccacctctaacggagtgatataccaaaaccgtcacaaccgaggttacttgtgacggtctttatttacgacctttagtgatgaggtaatttcggaaaaaaaataatttctaaatatttgctagcctcagtatttggtaggcatgctctctaaaaaacagtacattacagatattccaaccacacccaatatcacatatttttacaatttatcacagatgcatcccaaaattaacattctacacatgcattctaaaatcccataaaaattacatagacagtcacatattcccaatgcacattcttacctcacatttcttttgagcttgtgaagccacaaacttacccaatttcttgcattgcacatgaagctgtaaacttacccaaattacttgtagcatatgccttttaaagaagaacgatgagctgccatttaaaaaagggataaaacaattgaaagatacaaagtagcaattattgagtagatgcaaggcgtagtaaccaatttttatgatatgttgttcaaaactgccttaagttataaaaaaacgatagaatacgagatgctaggggtcccaaagtgttttaaacgggccgcggccggtggcctcacctgatacggtctcccgatgaacctatcaaaggtaaggctatccttgatgagtactttggcccatcactgctgggctgtcagaggtgaatagttctgacgtagtgtaaacatgtacattaattttgaaatcaggtttttgaagctccagaaatgggcatggacggaatagcacaaagcacataattaggtttcaagtggaagaaatgatttatgtaaattgcactgtcaatgaatgaactttgtgcaatttaggacatcaacttataaatcttgtgggaacagatgttgtccacgagcccatgttgccctagcagcagttcattatcaggatagatgtcgtatactccaaagagagacaccccagtataggagacaccccagttcggtgtcacccgttggataggtgacaccccagtagtttattccgacaaaatgctagaaaaggaggttaattacgagatgacaaagctttctgtagtgttttattcttacatttattagtggaagtcgccaagctgccggcctaactagcggtggtggaggtgatggattttcagttatcaaatcatatgcattgcgtgggatggctaattacctatcaaaatattcataaacatgtaggtatagttttgaaatactcactccgtttcacaatgtaagtcattctagcatttctcatattcatattgatgttaatgaatctaaacatatatatctatctagatttattagcattaatataaatatgggaaatgctagaatgacttacattg

SEQ ID NO: 75324 - DNA, 3662 bp, Oryza sativa
atagtcagctttgtcggagtaaaataattgccaaattaccactgcgataacaatataatgagttacccgtagtgattattactcactccgtctcaaattataatgcctatatatttttttacacggtgttattgattttgactttaatttatttcatattatgttcttaaaaatttaaaattagcatcatacttagtatatatatagtatgaatcaagggatataatatgcataatacttagtatatatacatagttagtatgattattagttaaaagttaccaagtttaattttttttaaaaaagagatgccctataacttgagacagagggagtagtacatagtacaatactaggctactgcagccacgatgtgctgttttattctgggttgtaggaacattgtagcacatttatttagaccattcattttagatcaagcgatagaaaacgctactagctaatgcgcaatatttttttttgaaactaactacaccagatgatgtgagattttatattaatatagaaaaaactataaaattacagcctagaaaactataatcaggaaaagtgaaaaaatcgcacctccacaccctgacgactcctacacacctattagaggacataaactaacatcgagccaaccgttatacatgactgttcgccatcaactctataacggggttaaggcactccacactataaatttagttaaacttagaaaaatttaagtagaaaaaaaatcaaaacatcttataatataaaaagaaggaactactagctaatacacaatgacgttcaacgctactgtataacgagcagcaacggtagaggatcacaatcttcattggatatatatggtttgagaatagagctgagatagattcgaggcagaaaattaacgaagagaaacagctgaaccgggaaaggaaggtagaattgggagagagtaaatttgtttagtttattgtttttctcctcttttttgtttttctttttatgcacgtgcggccgtcctcatttcgtaccgatcgtgtggaaggcccaactgcagtgttcgtgcttggtaggcagcctttcatttttgacaggaactgacggctcctttgcaacacatgatttcaaaaaacataagcacaagaaacgtaggtttaatatatcatatcttgtgaatttctcgggaaattagaaacatgggaatgttcttaaaaatagtcatttgggtgatacacagggaaaacgaagtaattgtagacacgagaatagaataccaccaagaggtaggagtaggacctcatgtatgttttccttcaaatctctatataaattagttcatttcgtaggattttcatgcatcagtcctctcttccaaatgatttcagaggaatttcatcctaagaattcaaatccttttcctttgttagtcgagcgatgctcctaacaatttgttaaacgatggaaaaaacatttgttgctactaactaaaactctatttctttttatatactgacgttcaatcagggttggatatacagtgtaacggctggaatcaggtgacactgacgagttttggcaaaacctatagttaaactacttattcatatattatagcaccatgatctaagcataattagcatactatgacactagtagatacattatgacaccaacgaatcaattttctagatacgccactgcgttcaatctttatgtgtgttcgtgaaaaaacattcgctgctggtaacagatggagtccttgctagattttggcagcaggcaggcagggtgctgcaattacgatctgtcggattcgatcgagcagggatcgatcgtactcgtgtgtcggccttttcgcctgcatcttgtcgccttcttgctcatagctgcttactcctactacttgtactatttacaagtgcgtatatacagtaccagaatttctgcaacggtttggctaggtagaaaaaatagacctgaacatttttttttaataatgaaaatggattacatctctggctttctgtcataagacacacagccataagtacagccataagtttaatagtaataaaaaggtaaggtaaaagtaaatcaaaatgagaaataaggtgatgggacaaatctccaactcccctttattattgactagcgttaaaccacataaaatttttttagctagcaattctaatagaactacgccacccatagtggaacaagagacccttagctaccgattccaagagtatagcaccattgcgcatagtatcctgctcttcctgtggtagcatcgtaaaccaaaagtggagctagtaggaagatatgaagataacctgtataaggttagataattgtttaccattaaaaactttatcattacgacaacaccaaattaaccaacatatagcactagctccaattagaatcatctttttaatggacctagatatccctctaagccaattaccgaaaatgtttttggcgttacggggtgggggatattaaaagcaaaaaacacacatctccaaacaaactgagtgacatgacactcaaagaaaagatgttggattgtctcttgtgcatagcagaaagaacaatgtttgtccccctccccctctccccaaattttcttttagccaggttattatctttcgttagaattactttcttatgaagaaaccacataaagaccttgatctttagtggaattttcaagtcccacagaattctctttttgatccgaacattacagttcatgatcgtggcatacatagatttgatggaaaattgaccattcttatggagcgaccatacaaagctattcttttcatttgacagagttatattagcccgaggatcaaatcgttccactcgattagcttttggccaacaatagctctcctaaaagatatatttagcggcgttgtgtgtaaaatcaaaggtgctttttattattattctgtgatgaacaattggcatcggagattattggttttgatatttggaatttattcacgaagtggttttggagatgattggatttacaggtaaattacaggtgctgttattttatgtgaccggtcagaccgggcagtcgttgccggtcagaccggcgtgtatcgcgcggttagaccggtgcagcccacggtctgactggccgactctgtgtcggttttggtttcgggttgtttgtttggatatccgtgattgtttcatgattatggcttctagatggatactatacgtatgtaatattgttgtttgctactaatgagtcaagttggagatagcttggtctcggaatatggtttccttgtttatttcatgtgtaggtgactcgatgcctcgggagagtatttacggtgatggaccgggagtcggcttggggataagacgacgtccgtggtggtcagagatcatgcgggatacttaggctagagttgatgcatgtggttggtgaagattccatatatggcatacgatggaggtattgtgtgcgtatgggatgcggagtcgaatttggaaggagtacaaatttggtattattagttttgtaaagtttgtttcttgtactagagggtttcctaaggtgtttaggacttctaatatgagtttggttcgtggctttaggctgcctacctcgggtataaatagagggggagcgt

SEQ ID NO: 75325 - DNA, 629 bp, Oryza sativa
caatttaggcagctgtgtaagttgataaatatatttcatgacattccatccttgtagtactaaacattataattaatggataagattagaaagtaatgcggtggttcgatttaataacctaaacacttgtgtatattgtctcacaaatttccattctatttctaacaagccttatgacatatattttctcttgttcatagagggccaccaaagaacagaacgaagaaaactaatgaagcaacctcagagactagtatcatggctgctccaatagttacaccaataatggcataccctcctaggttagcctatcttctttatttcattctacattggatttagatcaattagttacataacaatttatttttcacagtcaaaactttaatttcaccgaggacaataggacattgaacaatagctcaggttcaagtatatcaattaggtaagtaattagatcaattatgtcaatttgctggtattatgttgttctatgcaatatattcacaattctctttttcagatcaagatcacttactggctccaaccaacctgagccatctaacatgattgtagccttgccatgtctgggggaggaaacacctacagttgcaccaaaaatgaccaag

SEQ ID NO: 75326 - DNA, 8049 bp, Oryza sativa
atgatttctttagaaaaacagttcaacacctggaatggcttgctattcttctcgagattatgagcaacttgggatatctggcagcaagacatgacaggctgatgaactgatgacatgttgcaaacctaacaagcagtacagtgaagtttgtttgtactagtagacttactaaaactattacctgccctcgaggacatatataaatctaaatcaaaccattattaattactgaaatcgaaacaatttaaaagtacagctggagtcgtgtcgtatgaatataagcagatcagctctgctaaatctcctttcagtggcggtcaatgaccgcagcaaacgcttactgcacgtgtatgtacaatctgaagactcgtttatcacttatcacttcatcagtccattttttttctacaccaaccatagaattgaaggaggtggcataactatttgaaactttaatgactcagagcgcagtaaattaattacaccgttgatggatcgatcgatcgactgctcgatcatcagattcgtcaaacttcccaggagtagaggtaacgatcgctcgttcctcccggcctgtacttgcacgccaccggcaatctctgtcagctgttcaaccatttttatgtgacagctagttcaagtacacgagattacgagctgaacaattgtaaattgtgcggattttcgcttaactgaatcggaaactgccgtggaaatcgactgctgccgatgacccatcatcacacgcagcagtggtccagtccgccgagagccggatcagctgacagcaacaagcaggcaggagctagccaaaagtggtccactggcttggctcgcagtcgcagcctcacagtgcaaatgcgtgcagaagctggcctgcatggatagccgcagcctgcagggttgccgtctcgcgcgaagactttcttccccttgccgagttgcctgcaggagctagccaaaaaaaccgtcgcgctcgatcgccctcggcgctgtgcgcgttcccggtacatggccgccgttgctccagcgatcaaacgcgactactctgctacgctctcccggggctctcggtgcaggatgcacacgtcgccgtctccacagcaagaggggcattgattgattgatcaactagggggactcgctcgtttttctttttctacgaaggcttttgaccgttcggcccgatggtgatcacgcgcacactgccgcgcccggccggcgtcccgtacgtctcgtcttcctccgccgaccgcgcgctgccgtacgcgtcgcgctgcagtggtgaggtgatactctctcgcgcgcacacgtatatatacacatgtgccgagtttacttctaaactatttcttcgaacttctaactttttcatcacattaaaatttttctacacacataaatttttaattttttcatcacatcgtttcaattttacccaaacttctaattttagctgagctaaacacacgcatggtggattggtgatacgtacgtcgttttgatgggagaaacgccaagaaatctctccctgtcgcggcagatcggcgaatcaaaactagcagctcactgctgctgccgtgttctgactttcgaccgggagattcaacgggggagggagtcgctgggtcgacatgcacacagacgcaacgcacgcctgacacgcccggtgacccgagtgacaagtctacggcatgggctgtctgtgcaaggactgcatttcaccactcagactttggagtcgattgcaacagaagtaaccatatatacgcccataccgaaatgctgtatagtatctctacaacaacatactaatagagtaatagtaagtatccccattacgcgacagataccgtattgcgtgcatactgtgacgaaattgtcggcaagcgacaatatatatatactactgcatgatcgtggctgcaacaacaagagtacacgtacgatacgcatgcgggcaggcatacgtacaaaagaaactgttgaactgctcgaccggctttactgatgcgtgcattacgtcggctatacaatacagcatcaaataggtcccatgttactttcatgtgcaaaattaattcgtccgtagtttgattgagcgaatctacaacttgtttagaaaaatatcgttttcaactgctacagtggtctagctacgtgttgtgttaagtcaacaagtcaacccaaaagggctactattaaacgtgtaaactgattgataagatgatgcggctgtggatggaacaccgttgtgatggactgatagcattgccatgtactcaaccatggaacgaaatggaaatattatttcaggccgcaaaagaaagcatttcaattttcctgcttatttggagctcaggtatccaataacttttttttaaaaaaaataatttttttgtgtatgttatcagatgccgagtagattaattctgatgcgggactcagcatataacccatttttctcatgtagcagtccttttcatcctctttcgctctctgtaaatatgatcttctaagatgcctgaatatgaagaagaacaccgcggtactcaagccaatccaacagtgacacacaccatgtcgtaagtgtagtggcactaaccagtagtcaagattcaccgtggaaaactgaaggcatcggggtccctgaaagaaacgagccagggctaacccactgtgtgctcgaatggccagtcaggcaatgggccaatgacctcgggggcacaggtcaaaaaagatgctccaatcaagctagtattgctattattccctctattataaaatatgtatgacataactataactatatttcataatataaggtgtgcatgcatatatgcaattgactagcatctcttctccactatattattgtttttcttaactatgcatatcactctcaaatatataattttattatgtgcacttattgtatttattaggatgattcaaacaataatatgataataattattttttgatccttaaattaagaataattatgccttatattttaaaatgcagatagtaatacttttggcctgtcgctagggcaaaggagagagtacggctcaagctggcttgttcgcgagtcaaaggcacgcgctggacaaaataatacgtttagcaggcccaatgttcagttggtttcccactcgatcgagacctcgtactgaactgctcaaggctctcaagcatgggtgcttggatgatccgaataatcttgattctgtaaatttcacaactacagataatactttgataaaaactatcacaactctacagatttagcatcaattttataccatcaaaatatagatttaaaatcagatcataaaaaaactacatatttatgaatttatccttctagctaggccgaccttgctccttcacgtggctgctcacttcaatacttgtggccgacttcaaggacctgtcttcctgagcctcttcgcaagggcttcgtcttcttaatcctcctggtctcctagcaattgtggaagaagcggaactttagggtgttcgattccactctctcgttggtttttgtggtcctgagagcccattcttcaggaaggtcatccgtggtcaagtgctggcaccacggtttttaggggtatgttgggagtttaggggggggttcgcctccccctccctcatttttagagttttattttttccttagcagtcttttcttctttattttcctttgacccctgacaatagccttctggctggttgcgtcgtgtaactgaaattttgttttcttccaatatattaacgtgcaatccttttgtatgttcgcaataaataattattgaatttgtcataaaactatagaatttgtgttcaaatccttaaaatatatgatttgtgatgatctagttaaagcatgcgtagttttgttatttctgattaagatatggattttacattggtttccgctaaacacgtttttcaaactactaaacagtatatttcatgcggaaactttatataaaagttgttttaaatatcaaataaagttattttttaaattaaaaataattaaaactcaatcaatcatttgctaatgtctttcttgttatatatgctcttgcttaatcttgatttgctatgttctcgactggggccttactcttcttttctttttggaggaaaagattgcaaaatacgttgatctgcatgtttgaccaaattcatatataaaaatagaataacatttcaaacccaaaacaaatatactatagaactatattttatggtggattaatttggtgttatagattatgttgctacgttttcttataaacttaatcattcaaaacgtcttttaatatggaacaatatatggaacggagaaagcaaccgcttttacgaagaacagatactatagcatgagacaagcaagtcaccgtttgctcaaccactgctttgtaaattagtgatgtgattgcaagagatgaaaaatcggtcgcattcctaattcacctgtgatagtctgatgccgagggtgttgaatttttcgtcacatcttgtccaacagacgagttaaaatggctatgctatctgaggacagatccgttccttaataaatcaacgtctcactactaataatttataagtaacaacatgttctaaccaaaacgtgcgagaggaagctaataattgtggaatacatggcataatctacacataaggttcgtttcaagcaattcaaaatttaagttcggttgaagacagtgacaaaaacaaggacccgaacccagaaatgacggtcaaaataaatcctatgtatgaaccgtacaaaattgactgcccaaatgccaatcagggtagtaaatgaaatcaccactcaccagcaaatgagaaaacctgaatacctgataatgacatgctcgatcagtttgtacttaactagtacgtagcttaattaatacgtccatttcagatcatgaaatttatatcctacacggctgcgccagcgctagatgttaaagttgacgtatgtgtgcgacaatttagacatcaaacgatacagtgacggccgcagctttaaaatttagatgggatgaagattaaaatttagatgggatgaagatcagagatgttcacttgataagagcaatcgaacaaaacacgtatcatatttatagtttaatagcatagccgcctcgaccattatttgcggcgtgctcgcgcggcgaagagatggaataatttgtttgacgttacaccttgttatacctaattttgatggcctatgactattttaaggaggcatgggagtcttagaagtgtggggcgacactggtcgtagctaggtcaatcaatccaccctgcctaatgggtagatccgcccttgaaacggtaaccatatgtgaacaaagaattggtgaaataataatgtgtatagagtttgtgtcggatatgtgtaaatcggttataattttagggattggagttgaactaggtgttaggaatagtgtaagagccgaactctatcctagactctcttaaatagagggacgaacctattgtaatagtatggcaacttagcatagcgagagggagcggctgttggcggtgtaactttgatacccgcactataatatgctggatcggggaggagcgcctgtaatcagtgtccggctaagggttgttgtaattctgatacgctgtaatacgctagatcggggtgaggagcgtctattaacaagggacaattgcattcgtgcccctactttcaactgcaattatgatttttcccttactttttagggtttgcaattttacccctatttttttgaaagcgaagcaacatgttacccttggtttggatggtcagtttgacggtgttaaatcagtggtgaaatgacatatatacccttgtttggtattgcatatttgccctacgtctctatattgaaatgtgtatctccccctgtttggataagatggagtttgacatgaaatttgcccccgttttgtactgatatttgacgaacttctagcaaccttgataatatgacaaagacaaaatggcacaaatattcatgcaaaagaagcctcacaaaatgccacaaagtaaaagcagcattcggaattaatgttttcatcaagaagctaaacaagcattccaaatttgttgctgagcactaacagtgctgccctgcttgccttcatcggctcgccacgcggagccgccggtgcctcctgcagtcctgcctcgctacgcaggctcaaaggagtcgccacctcccgtttccctcgcggagccacgccgctaccggtgctacctgctcgccttgcaactggttgctccggcgtgcccgcctgctcgcctcaccttgcctgcttgcccaaccgccttttcgccctgcaggttgcagctagctgctcccattgccaccggctcgccacgaggacttgccccgccgccgcccgtttgcctcgccgcactggcttgctagagcctccgccgctgccgcctgtcatggattggggaatggggaatggatagggaacggtagagctttaggtcagttcatgcttccaagggtaaaccggtaatctaatatatcaaaaatcatttttttttcttttcatttctaattctttacctcacaattgtgggtcccatataactgccatccattctaggggcaaacggcgatttcgttttaaaaaaataggggtaaaattgtaaaccctaaaaagtgagggcaaaatcataattacaattgaaagtaggggtacgaacgcaattgcccctaacaaatattatgtcttgatgtcgttactgtgtatggatattctatagtattttttcagtgtttggttcttgatattacttgcttgcaatagaaagtcttcgcgtaaaacatatataaagaagttgctatttatccgagaaaggcactaaggccccattcattttaaattaattataaggggatggatattatgtttggattatttgtaccatactgattcgaaaagttcgattatttttttttaaaaaaaatctaatttatccatccaatcgtccatttcaaaccagccgttagcgagaatactaaacggcccagacaaattcaagcccatcaattggacgttcgaaggttaaaagtgggccctttattatctccaggctctgtatttggtagcccatataaaggagctaatccatttagctagttgggccaaacgcccagaatccattatgttagcaggcatgataatagtagatgaattatgcatcattttttagcttttacaactttctgaacatatgttctctttatgtttaagtggtttaagccatgcagtgaatcatgttcagactttccataccttcagaaaccatatgcattttttctgtgagtacaagttgaacgtcagaaatatacaatttttccgtgggctgtgtgcgggaccgacagaaaatatactgacctacaggcttgctccaaagtgtggtagtgagtatattagtatatatgtcacacactttggcagtgctgttaagttgtttagtgagatcaggaaacaataatgcgcacccttctggttgacaaaagtttcacatagcttcgagctctcacaatgggaaaaaaaaaacataatccattcgaaagccctttgcaaaagaatggtaggagggtttctcagagaaaccagacatcacatctcatctccccttggtcatcggtcaagatgatttattaagcatctacttcgaatgatatctgatcaatcaatcccaaatcttctctccaagcatatctcaatccctgttaatgactgagaagcatatgctgtccaagccgatggttcgtaagtaaccaagattattccactgcttacatgggtaaaaaaatcatgcgacgcatccttcttccttgtcaagctgtcatcacattgtcaatgcaaatcctcctaatcaggagtaagaatatttgggctatcattaatcgctagtataccttcttgcaaccgaaagagaagcatgagccctccagttaacttctgtcgtttgtaagg

SEQ ID NO: 75327 - DNA, 1766 bp, Oryza sativa
caggttgtgagctattgttggtgcatcgtggtgctgcctgttagtactactcctacgtaatgtagcagtaggcatgcccattaccttggcaaaatggcagccctagctatatctttgttgtacacttgtgatagagagagatactagtgcagtgtgcacacacatctatcccagcaaagccctcaactagtgtagtaccgtcacaagcttcacaaacttactctaattcacaatgtgtttttgatgacctgcgacggtttctggcagtgtacgtcgcttcgatgatcgatcatatcagtgcatctcccgatccgatgaaggctcagacaccaaggaaaccggcttgattcatgtgtcattggcgccgcagccgcgggggcgtgctcaccagcaaaagtgaagtctcgtcgtggggcaaaagcaggcaaggggcaggcaggcagtatagcttagctcctgtataaatcgatcggcagctgagggcggcgaaagcgtcgtctcccaatggtgggggtgggtctccccgtgcggccggccgacagcgcgcactgcttggataaggtgccggacacaacggccggacgaaaggcgcgccgcggggctcgattccagcccaccacctgatgatggatggatgcaacctgcagatggcgtacgtcacgtcgctgagcgcagcagcaggagataccggagggtttggactttggactgcaccgggtgttccacgcggcccacgctgggaggcagggccccccccccgccggttggtgtcgcccccgtgccctggtctcgacacgagtcgatcgatcgatcgatcgaagaaaggctatagctcaacctctagcgcaagatgccggcagcgcggatggggattgagacgggcgctcgacaacttggccccctcggatatgctttgctaggtaggagtaggacgcaggacgaccacgatatatctcggcgacgtcgctggctgccggtggtgcgcgcgcgggcgcggaggcgaaggcgaaggctttttccgcgggcgcgctgggctggctggccgctttctgtcgcttcgtggccttatcttgcactccgtctttgcaggaatgggccgcgcgcgcgcgctcatgatgagatcgatcgtttggctttggttggatcagcgcgggcggtgcgtcgctaggcggtttaggctttagccctgccgcgcgcacgttcatgagcgctcgtagcggtacgtggtttttgtcgatggatcggtcggtttcatcgtaaatctggtggacgtggccgtaggggttggtttctttctcgtaagctgggtgggggccgcggcgcccggtccagtcgaaagtcgaaaccgtcaaatcggccgagagcagtcgcaatcggcacacgtcgatcgctttcgcgtgcgagcgttgtttcatgcctcgtcaagatgacgtcgtcccgtgtatagttggccatatgggtcgcccggcacggcacggcccaggcacgaccgggcctgggccgaggtcagtcgggccggcacggcacgacaaacatgccggcccgacaaacaagccgtgccagcccacgggctacaaccacggccccagtagcctcgggccgtgccgggctggcccgacggcccggccagcccatcgtgcccgtgccggcccaggcacgccctggcaaaaaaccccttcaaaagttcaattcaacacaacaaattgacataacacctcaaattcaagaaattcacatgtaattcatcaaataactcagggctgcag

SEQ ID NO: 75328 - DNA, 684 bp, Oryza sativa
attattaagtccctcattgtaagttcactgtcgtatgtattcttacgtaaagaccctctataggaccgcgctctgaaacagtgcaagtaaggatgttttctgagaaatagaacaccctatccccccattcccccgaaaccctaccactaccctaccagtactgttcccccatccctcctcttcctttgccctgccctgccctagcgccgccgccgcttttccttccctccccggcttctcttcgccggcgacgacgatgcggtgcggtgtctccggctcagattctcaagaattctcgagctctccatgtcaagtagagggagtggacggtgcggtctgttccccgaaaccctagccaccactattcccccacccttctctcgctctctcccctgacctttgcgacggcgcagcctgacctcgacttgccctcctcttctcaacgccgccgccgccagccttcctcgcatgccctcctctgacctaccccatatcctggagctctccctaccaatgctcccttctctctctctctctctctctctctctctctctctttctcccctcagttgagctagctccggggaatgtggtgatggagatcaatggtgagggggatcaatccgctagcccggtgcttgatttggtggataggcgcactcaatcttgaatccggtggtgttg

SEQ ID NO: 75329 - DNA, 20046 bp, Oryza sativa
gaaattcagctgcatctgaatttagtactactacactttcacaatttgtactgtgcttaactgacctaccgcatgttataagaagacaaatacatatactaatgtatatacattagtacagtacaataaaattgtcacacttcaagcgccagttcgttaaaaaaaaggtgaggtacagcactcgagagtcgagatgtgctatgagatactgtaacaagtatatacgggttaaggataagattcagctttttgctaatccatgcgtgggcatataaaagtctttgcagtatgcacttttggggggagactttttccactcttcttggacactaatcccagaaaaaagattgtgcagtacttgctctatgaaaaagcaagcagattgatcaaacaatgatagagctttatgatttgttaatggttgctgcattaccaaatgcagcttgtcaaaaagagccgttgtcccatttcagccatatcggcgccagaagttgataatcacatccacctactctcggaaaaaaaagggggggggggggggggtccagcgacgtgtgagtgacccgaaggaatcactagtactttattttgtcttggcctaggaagcttaatcatgtagtaccgataattttataaggcaggaggtggctaagcaagtactccctccgtttaatttgtttattataccagcactcagttaagatacttactcccttcgtcacagaatataaatatttttagaattagacataattattaagaaagttggtataattaaatggggaagtgttgtgattggagtagaagtaaaggtagataggaaaattaaatgatggagggttgtgattggttaagaagagaatattggtagataacttattatattttgagacaaattataaatactagaagttgttatattttgatacggattgatggagtatcttcttactaccttctaaaacatatgagatatatcttccccttctcaccattcatccagcggttatactagtactaatactcttataataaaatgtaatacttactctaaaagagctaattagaatagagttaatgacggtagtaatgtaatttgtcaacacattctaatttagggtacgatttgatgaaatgaaactaaaatgaaaggtgatgaagtaaggtgatcactgttatatgggacccataactattgagcccacatgtcggccaccacgtccaattcccggcggctatgcaacggccggggacaggtcatacctgggcccaccttaccagaggctgtcaagatgggcccacacgccattcggattgtagtcggagggctcggaggtgatccgaccctgctgcctcctcgcctcgcgccgtctataaatgctggccgatttccactgactcctctgccacacagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacggtaactaatcaaagcgcattcacttcccgcccagcacagcacgagctgctgcttctccccagcatgggcgctcatggcgatgtgcatgtgaccttgcagatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactcgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccaaggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagcgacggccggcgacgacaaagctgagctccagctcgagacttcttaaaatcatcttcaagtacatggattttattttgctctttgctttgtccgtaaaagttgtactatgcgatgaagaataccagtatgtagcaaggctgaggttgtgtgtagctactagaagtgtcagtcacgttgttcttgtaagaaatgtttaactgttaattaagcagtattgttgcagtaatcaacaaccttagccagttattcctcgatcgctgcaaggggtcaagcatgactgcatgaggttagaaaaattggcggtggttcgaggattctgccgagtgagtcaagcaagagacagtaaagtgtgaagaaaaaaaaaactatctgtcccttttaaaatgttgtcacggctggttgccacggagaaataatgaagttttaaattaagttgttcgactcaatcacgggatcggaatcttgtgacgatgcataaagcagccaacgcctgatacgaagtttattattagcgctctcacggtctcactgattagactacctaatggtttacgaatgtgtcattatgctagtgagcatgcacgctgcacaagtgacaattccaattgatattttttttgtttcatgaagaagttaacaagaatgcacaatgataaatactgataattgataattccagctttgaatttttgtttcatggagaagttgccaagagtctttccctgtacgcggcggagtcctctgcttccatggccgtgtcgtccatgccgaacaccttgccgatctcctccagcgtctggccgcgcgtctccgggaggcgagtgaagaagaacacccacgcgagcgacgagatggcggcgtagaggaagaagctgccgccgatggtgatggcgctggagagcgacaggaaggtcatggagatgacgccgctggtgacgcggttgcacgccacggcgaccgcgaagcccagcgcgcgcgcccgcagcgggaagatctccgaggtgtacacgccggacatgggcccgaggccgacggagaagaaggcgacgtaggccaggatggacgcgacgcacaggccgacggcccagctgggcacctgggcgtccgggctgccgcccacgacggtgagccccgtcgcgaggccgacgagggagaagaccatcccgcccgtgctggtcagcagcagcggccgccggccggcgcggtcgagcaggaacgcggcgaccaggatgaagaccgtcttggcgaagccgacggcgcaggtggtgcccaggagctggtcgtcgccggtgatgcccgcgctctggaacacgcgcgggctgtagagcacgacggagtcgacgcccgacgcctgctggaagaagtggaggccgaccgccgcgagcacgattcgccgcatggccggggtcggggacacgacgagctccctccaaacctgcccctcctcgccgcctctcttcttggacacggtgaccacgtcgccgtcgaggtcatctgggatgccagccgccgccttgatgtcagcgagccgctccgacgcctcctccggcgtgtcagcgatcttctccagcacagccttggcgtcggcgaggcgacccttcatgacaagccaccgtggcgactccggcatgccgagcaccatgagcgcgagcagcacggatggcgccgcgccgacgccgagcatgacgcgccacccgagggagagcggcaggcgcgcgaaagcatagttggagacgtagccgaggaggataccgaggttgatggagacctccgggaacgacgtgaggaagccacgcgacgacgccggcgagatctcggccgtgtacacgggcgcgatcatgatcgcgtaccccacgccgacgcccgccacgaagcggccgaccatgagagtggcgtagtcaccggagaaccccatgagtagagctctggcgaagaagaaggcggcagcgaagacgacggtgaaccgccggccgatccagtccgccgtcctccccgcggcgaaggagccgacgagcgagtagatgttcaggatgcccatcaggatctccacctgcacgtcagtgatcttcaggtctttcttgatgtacagcgatgcgccgctcatcaccccgatgtctgcaaaattttggcgcgaacttgaacagtcagtgctcgctgacagtacactacacttctgaaaacaaattcagaccacatctgaagatttttctttttttttttttttgagatgatgtgaatacgattgtactacgagtaccatagccgagaatgatggaggccatggaggcgaggatggcgcaggtgaatgcatagctggcgttcttcttcttggggtcgacagccatggccgtgagcttggtggattcgcggcattgtagtttgcagcttttaaggaaaaagcaaacgccgttaatctgatcgaacaagcgattgaaacgttggctgatctacgcatgcatgtggaaattaaacacaacacattgaacacgaaaactgactttttaaattttgtaagcgtctgcgtgcaagcaacttcaaaaatcctaggcttatttgactcctggagtccacaatatttgcagccattttaaaacctatattaaccaactgaatgtgctcagattatcctatctccaaggaacgctgagctcagtatctccatggaacattaattgattaatacaacttgaagtagcatgtagatagaagtatagaatgggagtggattctaatccctcgagggggatatcccctcgtatatctttttcttcaaattcgatgcaaataattgtgaaaaattttgaaaaaaaatcgacaatatagagtataatgatacctagtagtccaccaaaattaatgttcaattttgatctacacatcgagaaacaaaaaagataaatttagatataaatagtacgctactattcatacgctgaatttgtcttttttatatctcgacgtgtgatttgagtttggacttaagattttgtggagttgtatatatgtgttgtatgaatgttgtcaaatttttccagaatttttcataacagtttaaatggtttttaagcaaacgagggaacatcccctcgagggattagaatagtttcccatatagaacttaacgcattgctcagaatttctttttagtaaaatttcacaaaactacatatactttaataaatttccacaaaactacaaattcaagccatagtatcacaaacttatagatttaggaacgaatttatcataaaactatatattttagccattgtatctcaaaactacaaacttagtggatttttttttcacaaaactacagatgcatccattttctcataaaactacatttttttttgcgaggataaaactacacattttaaaatttaccatggtaataggtgtatggataacacatctaaaatatgtagttttgtgaaaaaaaaagacaatactaaatttatacttttgagatataatagcttaaacatatagttttgtgataaaatcatttgtaaatctttagttttatggtactgtggcttaaatctgtagttttgtgataattttatcaaaatatctatattttagtaaattttactcttttgttttctccgattattctgccacaacaagaatatcttgatcagttgctctattttcaagtttaagaagttagatactttttaataatgaaaatggtttatatcttcgacctctgcacaaccactaagttttggtatctataatataaacttaagacaatgtgacaaactcccaactctctctagaaaaggttcaacttaaaaaaatgtctcaaaatcatattaattctaacacatcatatagtagacaccacattatctaaaataaaataaaaaactttgactattgattttttttttgaaatgataacctcagagaggatagggagtgcctgttttcatttaagaagaagagacttggtccagtttttgagggaaaaccagtcccaaaaatctcatataggcacggtttaaggggaaaaccgagcgaaacccacacaaagaacaaaccaaaaaacttgcgacaacacaactcaaggacaaaggacatcgttgccgagctcaaaagagcagctccgacttcctaactatacaccacagaccatgtagggcaggatcttcaagacaaagcctccaaggaggaaggtagcgatcaacgccaaacaacgtctgtccgaacaccggaagaaggttttcacccgaagaaatgggtaagcaaggaaacgacgccttcaagaaggaaatcggcgcccacatgcgtcgacatcgtaggctcaacccaagatggagtagggccttcgccctggctctctctctctccctgccaactacaacaacccacgctaccacagcgaagacaagacgaaagcggaagagggttatcgttgccgagcttgccacttgacaagcagctccgactcccccccccccccccccccaaatgactatcgattttaaaagtatgagtttttttgaagtcactttggagtacttctaaagttagatacagttgggccaagagtgagcccagctcaactccggcctgggatcccaacgctataagcccacgtagcagagtcagtaaacccagccggccgggccgtgtgctccaagttggagtccgagtcgtggctcttcacagaaacaggcgccgaattggaactggactcctgtactgtacatcccaagaataaatctgacacaacacggtaaacacgacccccagctaacttcaccaaaacaaccgtgtaccggcgccatcagatggcaaagcgagccaggacgctcaccggcgatcacctccgctcctcctcctcctccaaccaagccccctcttggggtgctaagcgagcacgcagcggcagcgctctccgtgatcggtcgcttcccgattcagagtggtacgtcacgtacgtgtcgaagcttctcttcgacaggtttgctcttttttttttcttccctcaatttgatccgattcgatttatggcgggagcaggagagactggtcgagcattgggaatggcccggcgtggctgatctccgagcgcgtgctcgccggcgacgatgtcgcggactacgtgagcttccgcgccgtgtgacgctcgtggcggcagtggatgaccagccctcgcgcgcacggcccgctcgacagccgcttccacccgcggcaatgggtcatgctccgcgactagctcgccgtccccgatcgccgccgcttcctgaacgtctcctccggccgctgcatccaggcggacctcccggagctccggggccaccgcgtgttcgggcccaccgcggagggcctcctcgtcctgctcgacgaggccaccttcgccgtccgcctgctgaacccactcacccggcagctcaccgacctcccgccggcgaccacggttctggacccgaccagcctaatgatttcccccgtacactacctcctccacgttctcacggtgcacggcgccggcctcgccgacggctccgcgacggtggtggtctacttcgagaacgcacgtaagctcgccgccgccaagcccggcgacgagcggtggacggtggtcgaacccgacgccagcttcgcctccgtctcgtcgttcgcgggccgcttctactgcgccacccgccacgccatccgcccggtgatcgtggaggtgaggacgacagaccaccggctgccgccgcagctggtggtggtcgccaagctggccggggtgccttccttcccgcggaactgttagaataattgggctaggcccaatttataatattaaatctcaaaggcccataataaatgttgaggataataataccacttcaggatttaagcgagaaatatctcaacctaaatagggagttattagaggctccctgttgaccagttgaggtgagggtcggaatgccacacgcgcgcgcgcgcggggcgtgggcgaggttgcggcgtcacgtcgctatccttttgtagccactaacccgagggcgaggcgtggcgcggcgcggcgtgcgtcacgtcgctatccttttgcagccactaacccacgttcccacgattccctccgcaacagcgcatccacgttctttctcctgataaataaggaggccacgagtccgatccgacttcttcgcttctttcccggtgttagtttcttcttctccgcgcctgagttgctctcgcttccccgcttctgatctcttgcgcgcacgagagattggaaggagcaatgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccgccgccgacaggagctggatctggatccggagctggtgcgccaggaggaggtgccgtgaacgactacaacaacggaggcaattctgcctcaccatccagcggagagccattctcggggtataatcttctcctcctgctactgctgttagcgctattcatgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttggattaaaatatgtcgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaaaatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaatctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtctaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtatggtaaaatattacctacagttctctctgtttttcattcacctgattggtgggtggatactggtgctaatattcatgtatgtgctgacatttctctgttttcttcttatcaagtcgggagaggttcctccttgttgatgggaaacgggtcgcttgcggctgttcatagtgttggtatggtcgatctgaagtttacttcgggaaagaccgtgcagctgaagaacgtgcagcatgtcccttcaataaagaagaatctagttaacggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcaaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggcctgatagaggtggggagtatttttccaatgagtttgcatccttttgcgaagagtttgaaattattcatgagatgacgcctccctattcaccccaatcaaatggggtggccgaaagaaagaaccgtactctaactgagatggtgaatgccatgttagatactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcagaaacttggaccaaaaactgttgattgtgtgtttcttggttatgctatccacagtgtgggttatagattcttaatagtaaactcggagtacccgacatgcatgctggtacaattcttgagtccagagatgctacattctttgagaatgaatttcctatgaaatatacacctagcacttctagtaaagaaactgtcatgccccatgagcactttgcaccgatagaacacgatgatcaaacgcctgaggaaaatcctgaggaggacaacattgtagatactcgcaagagtaagagacaaagggttgcaaaatcttttggagatgactacattgtatccctcgtggatgacaccccaagaaccatagaagaggcatattcatctcctgacgctgactactggaaggaagcagtacgcagtgaaatgaactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtagccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcataagaagtttgacaccacgcttacctctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatatgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgggaacatttcttatgagccttgaaatttggtggggattgttagaataattgggctaggcccaatttataatattaaatctcaaaggcccataataaatgttgaggataataataccacctcaggatttaagcgagaaatatctcaacctaaatagggagttattagaggctccctgttgaccagttgaggtgggggtcggaatgccacgcgcgtgcgcgcgcgccgggctggggcgtgggcgtgggcgagggcgaggcgtggcgtggcgtggctggcggcgtgcgtcacgtcacgtcgctatccttttgcagccactaacccatgttcccacgattccctccgcaacagcgcgtccacgttctttctcctgatagataaggaggccgcgagtccgatccgacttcttcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccaccgccgacaggagctggatctggatccggagctggtgcgccaggaggaggtgccgtgaacgactacaacagcggaggcaattctgcctcaccatccagcggaaggccattctcggggtataatcttctcctcctgctactgctgttagcgctattcctgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttagattaaaatataccgattaatgactatatttccaacaggaacctgatgcccgaccccaatttctaccgtacgccgcacgacctgcacctggtcggcaatggcggcaggctgatggttgtccaccgtagccgcagctaggtctcgcactcgcacggcggcggccgcaggagcagcaagtacagcgtgcactgggtgtatttcgattcgaagaggacggtgtccatggtcgtgactcgctttcgccggcaagccctgttcatcggcgcgtaccgtgcgatttcggttaatccagaggcgttccccggtatcagcccggacaccgtctacccaggctttgattgcgatgataaaccgagctcgcagcaagttggtggtggcttggatggatccaacgtggcatttccacatacagctgttgattgtttatccctatgtataagccagcctccgcgtcgctctcacgcgggtggctcggggcgaaaccctagccgcccgcgccgccaccttccccacccgctctagccgccctcgccgccgccggagcccgccgccggaaaccgcgcggccggccaggaaggcggcggcggggaaaaccagccggcgacgatcctccccctcggcgtgggaggtggagtggcgagcgtcaggcggaagacggcgtccgaagaggtccacagggcgaatccggccacgccggaggcggattcggccccctcggcggctgatctggcctccccgtggccggatcgggagctggcgactccggtggcggcggaactcgcggggcggtgcgtcgactggcagaggaggctgacgtcatcgccaagcacgtctctgaccggcggagctcgcagcgacggagatggtagcagctggctggcggcgggaggcgcgggagaaggcagcaagtggccggcacggctggcggcggcggagggcggcatggcgcgcgcgaggaggcacgtgcggtgagaggggacacgcccggcggcaacgtaggctggcgaggaggcgcagacggcggctgtggaggctggcgcggccggcacggagggaggtgaggccagcggaaggaacgggccgttggcggaggcttggaggctgtgaggccagcgtgggcgcggtggcttcgctgagaggccggcgcggacgacggcatggaggccgtcgtggcgagtcctccagaggcggcgaccggcgaggtgcacggcgagcacggcacggtgcggcggcgagcctaccgcattgggaggtcgggtggtcagaggcggtggcgatgcgaccaagtggcccctcaagggcagcttggttgaggcggcgacggcggtaacgccatgaggtgggagttgaaggctgcggcgatcttttctccaggcgtcagtcctcttgcggtggcggcttgccgctgcaagatgaccacgttggacgggccagtgtgggggagagaggattcatccttctctctcaccctttccctttccaacccgcccgcgtggatggagccggagcgagccgaagtttgagatcctttctgatggccgaccggcggcgaggcgtcggcgcggtggccacgcgttgaagaggattagctggtggtggctgttgattctgacgagcactcgttgacgcgggggaggaggaaagcaatgggtgaaagcctagccttcgggccggcaacggcgacgcctgcggggcgttgttgcgctttcctcctttggtcctttaggtgaaaaccacatcctgttctaggacgggcgacggcggtgctctttggcgtcgcttcctccttggaggcgtcgtttagaagttccattcgtgttgtgtgcttgttgggtttctgcagtgggatcagacgtagacgcgtggtgtggttgtattttctttttcctgactgcagtctcccaggatcgtaatcttgtattttttttcttctatatcaatagaaacgtcgcaatatcttgtgctggttgtttcaaaaaaagtggtatttgaataactgttttaatttgaagagaaatgggtggaaatttgtcagccatgggaggctagtgcaccttaattaatatataaaaaataaagaactaaatatagagaaaatacgattaattaattaatctcaatgatggtaaatacattcccagtcatatgggctgtagagcctgagcgtggacctgccagagtacttaagccgcttgtggtcgtctttgtcggtctagagtaaatttagtttctgaggtactaaaattttttttatcttatagtacctcacaaaaactgtaaaattgctcacgataacatggatctgtcctcgtttttctttttcaacgagaaagaatcctcacctctccttggcgccaaggacgccgaaatacacgaggaaccacgcgaacacgatgatcgcggagcacgcgagcaagttgccgtacacggctgtaacctcgtaaacccacgcgaagctccacaggatcgccgccctgacggcccggttcacggcggccaccgcggtccgcagccaccgcggccagccactggacgacgacgcgtccgccatctgcacggggccgagcaagagccacaccagcgccatcagcgacatcagcatggtcgcggacaggctcctcgcccacttcagctgctcccgccgccgcttcatgcccatggcaacgccgccacggtgggcgtgaggcgacgacgggtggtcggccggcgccggcgcgcgcctcgggcagcagccgccggcgagcgctttcaccagcagccaggcgagctcgagcagcaccgtggagacggcgaagaaggcgaacacgacgaggccgaacgccacgagcgccctcgtcatgcgcgtgtcggacgggacgccggcgtcgcggaacgcgcgctgcacgtacaggaacatggacccgatgcccgacgcctgctggaatgccttggcgaccagcgcgctgacgatgttgcgccggaccggctccgtcggcctcgccagcagctccagccagagcgcgcgctcctccctccaccgggttcgccacgccggcgttgccaccgtgtcgtcgcagccgacgtcgtgcggctcgccgagctccgtttttgtctcgagcagacggagctcggcatcctccagtgacaacgtcctggagaggacgcgacgtgcgtggtccttggtcaagagccactgtggcaactccggcatgaggaggacggcgaagccgagcaacgccgggatggccgtgccggtggctacggtcagccgccaggcgacgcgcacggggaggttcaagaatctcggggagaagcagaggccgccgaggatgcaaccgaggcacacgaagccgtcagggtgcgaggtgaggccgcggtgcagcgacgacgggctgagctcgccggcgtaggccgggacgctcatgagcgccaggcccatgccgacgccgttgacgaagacgccggcctcgaacgccgcgaagctggtggcgagcccgcgggcaagcgcgcccgcgcagagcaccgccgccgagagcagcacggtgcagcggtcgccgacgacgcactgggctcccacggcggcgagcgcgccgaggacgcaggacgcgacggcgacgcacgccaggagcttcacgccgggcggctccggcagcgtggccgagccgcacaccatgacgaggtctgcatcgatcaccaatgcgctcgcaagatcacgccgtgcttgatggacagatcgatgcatctgcgcgcgcgcatggatgggatcgctggttcttaccgtagcccaggaggagaggcgtcgccgacgagagcacggcggtgacaaagccatatttgttcttaggacgcctcatctccggcaagaaaagaacaccgtctctattcactaatcctaccaacaaatttcgagtggtgaatgctgatgaaattctctgcaaatctgataaaaagaatactgatgcagatgagaggaagcgatttgagtggatctgtaaatcataagagcacgaacggtctcaagacgaagatggctctgaatcatacccgtcttaaacacaacgatcttcccaacacctgattttttttttcaaaggtaaatctcttctcataacactaatccaccttcagaatcattccaaggcttccttcttctcgttgaaatattggagtttcctcaactctcatccatgtgttgtgatctcccttttgaaagacgcagctgctgttgcagcgacgacgtaacaaactcctgaaaccaagtagtccacggccgaaaaactctctccaggtagttcattagtagcaacagctaaccgatttactagggagcaagtagttaggcttgaaaatgccagtcaaagccatactttccgaagataataatagtagaagatatatataacattttacatcctacaggagcaatagatagacagatttccaccgaaacatcatttgataaatctgaatacccatcctgaatcctgcatccgccacaccctatgagcgttgtacgatgttggattaaacacacaaacataagttttgctacttcttccgtttctcaaaatatagtaacacagtactaaataagacaacatagatccatactactaaattagttctcatg

SEQ ID NO: 75330 - DNA, 14839 bp, Oryza sativa
aaatgggggaggaggaggtggggatcgagtccacgctctcgcggggcggggtggagtgcgggaggcgcggcgtcgtggggtgaaaccggcggccatggcggttgcagccggtcggatggaggtagggggagaagctgacgagtgggccccgcggtcccacttgtcgacgagaggagggggaggaggccgagggggcaaaagcagacttttgtgagggagtggggaaacgggccgacagcccaagagaggagaacgaggccggcctgggaaggaggggaaaggaggaaggaaggggattgggccaagcccaaacggagaaggggagggattaatttgtttttctttttatttaattgattaaatgaattttgtgacttttaaaattatttctcgagctccgaaaattcgcgggaaattttagagtgttttttttagggcacaaagaatattacaaaacattcccggccaatgatttttaaaataaattttaaattccctcaataattcacttgattaaattgctttaacttttatttaatttctagaaaatgcattatttaatgatatttaatcccgaacgaaaatcggggcgttacaaatatgatcaattgtaatgtatgacttgccttgctcttgcactgatcagaccacaccaacgtcttcgagaaaccgcggatcgacgaaacggccgaaatctacgcgacaaacaaagcatacaaggaaaacacactataagtctactgaaacaggaaacaaaaccatttttaatggattctatacatttttcttgatttactgagacttgaatggacttaaacggagctcggatgaattacttatgaattttagaaataaactgtttttattactataaaagaaaagccttaatgagttttattgcgcaataaaggatcccggatgacgtcagcaaagggggggcggcgccgacatgcgggaccagcccgacagtggctcaagggggaggaggtggcaccggctggtgggtgggccccaccgggcagtggctcaggggggggagacgcccggttggctcagctcagctcggcttcaaactggccggccggttaggcgatgcggctgcggcgagcggccaccgacggcggcgaccggcggcgcgggagacagcggtggcacactgccgaagcggcggcgcggacaggaggcggcgaagcgcccaaagacggcggcgcacacggggaagggggagtaaaagaggggggagggagtcctcaccagggattcgaccggcatgggtgaagacgacggcggacagcggcggcaagcggcggacggcggggcgcgcggaatggacgaaacgggcctcgatctcacgaggccaacggcggcaacggagcagatttatctaattttcttcatttatctagcagtagtgtgtacagtctatttttaggctatcgttttatttcagaaagcagagcattgcaataccagaaatgaggcttattccttttgtacatctagagcttctcatatgttgtaaaagagttgaactagctcagattataaatagtataatacaagttcttgatagattactaaccatcaatatccaaatcctttgtttgggcattcacaagcttccaccatccatggaatcctccaggtccaggttctgtagataaagatgaatacatgatagagacattgaaacttcatattccaattttacagaaagctagcaagtagggcaacaaacccatataggcattgtgcaatactggataaatagaaagacaaaaagctggaagagatcttgcaagcaatcaagcaaatagacatctttctctttcagaaaattaaatagacagatgataagaagagcacgagaaatttactgaccacaaaattatcactatagctgatttcatttagatttactgagctcactgttgctgccggtggagtgtcctccggagcacctcgccggttggccaccaagcaggtagccgtcgcccgccggtgcctccgtcggccgccgaaagaaggaactgcatagaagaggaaccaaagaatcaagaaccaaagaaaagaataagaaaatcaagaaccaaagaatccgttgcttgttgctatcatgtgaaccacactaccagtcttggggggagttggagacgtgaggaggactgaagaagcacacctagccaccgctgcctcaacccgtggtggatcacaccgcgaagtcgaagccgccactgccgccgcctccgcctccgccgggagccgctgccgccacctcgatccacggggaagctgcgccgccaccgctgccgcctctgccgggagccactgccgccggctcgatccgcggtggagccgcaccgcctcaggccgggagccctaaagccgccgacgccatgcgaacgcgagcaagcggagcgctcgaacaaggccgacccgaaaacccctaggatcaactgactcatggacccattgttacctaagaaaatatggaccggcccgaaaacctattggtgccacaaatttaggttcgggccacggacctaacgggtcgacccgccccacttgcaggctgaattaccgactcagagactatcgccaccggtcgccacgcgtggcatgacttacctccgcgcctcaactcccatatgacactacccagcctcagctgtgtcgtgtacggtgtgacaccggtatggctcccgtggcataagatggccatgcgtgcggaccgaggctcgcctcagcacatggtctccaccgcgggccgtcgaggagaatcttaacctaataggcgcacaacggcacaagcgacatcaattgagcgctcacgtgcgcgctgccgccgtcgtgcggtcatcaccgcccatatcactggagaagcaggtgttaggtgtcaccaggtatcagttttggctcatttgcaaccgacgcccgcggccgtctactcggactgcattagcttcatgggccgagcatgtggacaacagcttttctgaccgtataattttggaataagttcatctaggtcccttaattttacacagaatccgatttacgtccttgaaccccaaaaccagatacaactggtccctgaactgtcaaaaccggtgcaaatgaggtccctcggtggtttggaaggcggttttggctgacgtggcgtctacgtgactaggtctccatcccacgtggcattgacgtggcgcttacgtggcaactatatctcggaaaaataataaaaaacggtgggtccacatgtcagctaccaaaaaaaattaaattaaaaatggtgggacccacgtgggcccacatgtcagcgaaacaaaaaaaaataaatatggaggggcccaagtgggccccacatgtcattccctctcggctctccctcttcttccctccgccgaccccgacctctttttcgccatcctcggcggcgtcggccagttcggcgtcatcacccgcggccgcgcccgcatccctctctctccctgcgccccgacctcagaaaagtaagagagagcgagagccgctgaggtccatcgaggtcacctcgcccggcccgcgcccctgccacggcggccgccgccaccagtccaccaccgtcgcgcagccccacgcagaaccctgtcgcgctgttgcagctctgcgtcgaccgcaggtgcctcatcttcccgttcctccacaccgactacgtcccgggctccctccgccgcttcatcaccggcgccgcggactgcttcgtcggccttggcgtggacaaggaggccgagcggctgagcgacgaccacggcctccccgtggggaacaccgccgaccttcgccccctcgcggcgtagaggctgggccgcccggagttcagacaggcctacctagattagatttagttgctgttgcatttcgctcctgctgtctcgtaatgttaggctacctagattcagttgttgttgtatttttctcttgctctctcgtgatgttaggcaaggatttatgagatttaaggtgctatgggtttatgcttagtactgaagaaattgaagaatcggatgaaaaagaacgtgcagatcttctgatctagactatggttaatgaaatttccagtgctgatcctttatgcgtttttagtgctgttttaatatctgttttagatgatactgtttgcagatcgtgtcatcaactggaaatggctcgtttgctcaaattgttctgcggctccttgcacggcggtcggacgcggtcggaggagatgctcccactactcgccgcacgtggtcggaggagatgctcccagtaagaagagctggcgacctcctcctctgcctcctcctcctccggccaccttcgccgcccacggcctgctgtcgtcgccgctccgcctacccctccgctccgccctgccgctccacccgcggcctgccgccgcgccgcttagccagcatgcttcggccgccgccgtcgtcggaggcagcggggactgagacgacgacggttgtgagacggcgccgcggcgcgagaagcgcccgaagacgacgcgttaaggaagaaggggaatagccgagagggaatgacatgtggggcccacgtgggccccaccatatttttttttttgtcattgacatgtgggcccacgtgggtcccaccatttttaaattattttttgtgtgtagctgacacgtggacccatggttatttattatttttctgagatataattgccacgtaagcgccacgtcattgccacgtgggatggagacctagtcaaactagccacgtaggagccacgtcagccaaaaccgccttccaaaccgccgagggacctcatttatactggttttgacagttcgggaaccagttgtatctggttttgacgttcaaggacgaaaatcggattcggtgtaaaattaagggacctcagatgaacttattcctataatttttgtgcctgggttgggccgtaagaaaggctgcgcctatgatgaagttttgagccgcaagctaatcaatcatcaatgctataggtgaagaaaggaaaaagtatacttcgactctctaaactatcacccgagtatgatttatatcctccaaccacaaaccagatatatcaactccttcaactattaaaaccggtgtaaataatgtctgtcagtggttttagaggtggttttggctgacgtggcgcctacatgacattcttaaccgagtctttgtcctatgtggcacttacgtggtattagaataaaaataaaaataaaaaaatacgtgggacccatacgtcattaaaaaaaagtattgtgggacccacgtgtcatcctccctctcccttcctcctctcctctctatcccttatctctcgggagcggcggtgacggtgggagcgccggccgtggcctcgtgagtacactcggcggcacgacgaagttgctgatatggagcacgaagatgttgtacggcaccgcggcgaccaccctcttgagcgtggcgttcaccagcgcggagagcgcggcggaggtgaagacggcgccacccttggccgtcggggtgatggcaagaaacctggtgcggcggcacacgttcccggtggtctggaacagggttgtcgacacggtgggcctcccccgcggcagcgcggcgatcttcgcggcgtcgatgtagtcgagcacgacgtggacggagaggagctcgacgagcgccgcccgcggcagcctggcggctgcggcggaggagtcagtccacggcggagttgtccaccagcacggtcaccgtgttgcggctgttgatgtcgcggtcgacgtgcgtcttgctgatcaggtagctgaacacaggccgaactctgggaaccgcccgaggatctccgtcacgttgaacgcgccgcggcgtcatcgccggaagccgggaggacgaggccgaggagcaggagaaatgagagcctggccgccatgtgttcgcgtgaacaggaggcagatatgcggtggaatttttttttaatgacatatgggtcccacagttttttttatttttgttttttattctaatgcgccacgtaggacaaaagctcggtcaagaacgccacgtaggggttacgtcagccaaaaccaccgaaggacattgtttgcatcggttttgacagttagaggagttgatatatccggttgtgtggttgaaagatatgaatcatactcgggctattgtcgagagagtcaaagtatactttttccggtgaagaaatgcggatgtgctaagctaattaacgggccaaattaaattttctattattttcttggcctatttaaatattttatcaattacataatgagttgttgcacctttggatgatttaaaatttgggagaaaaacaagataaaaaattatcatgcatattatattatttcttgcttaacggaaccggatttattttgaccaatattgattataggcccccatcgattggcttattctgacgacatatttgcaaacgagaaatataatttataaataaaacttttatattagtgttcttagcgatctaaaagctaacgctaaaaaataaacttcgataagaaaacctcaaaatcaactccaaatttaaggttaaaaaatcaaaatttagctgagaaacataagaacaagagcatgtacaataacagactataagccaactataaacaaatatcaagaagataaaaagggagagataaaagtagcaagctatatatttgagctagctgcagcacagacttcaaatataatgtgtgtgtgacatgtgggaacatgtattaatactatagtatatgtttatagataactattgtatgaatttactattaaattggctacgaatgatttggagttaatagttgactatactattaaactcgctctaagcaaaatgatgaggctgatagatgtaaatctcttatgcttaattttcccgagtcatttctagccaaatagaaccaaccggaaatatggtttgaaatttctcagttatgtggaattattaatttcatgtcagtaataatgttatttattccgatttattattctccatgattatttcctttaccatcgtatgtctaattttggtattattaaggattttcattcatataattatggttttagtttcttcatctaattttgtccaatgctgaattggcgaggaggatagcgagctgagggctgctccatgattcagggcgaccgagctggcgccattgatgccgatgggaaggtgatgcgatgcgggagagagcgacacatatggacagtccgtactccgtaggccgggggagggactgggagggggaaaaggggccccttaggtgaaggaaggaagaagtgggagttgggctgagagaagagaaaaggcggcctagcctggcctaggaagaaacggcccaattgaatggtaaaatctgttattttccttggattttcagagttgggttatggacgaatttcaatggattttgaatatggatttgagttcaaatgtgatgtttggcctgatagagtgacagagaataaaaggaaggtttcaaaatgtatgtttgaacaattttgaattagaagttgatatttgaggagatttcgtgaggaagggaaagagatggatatttgattcaaacttgatattttaattcacataaattcaaggaactttgggagaggatatttgaattatattttgatatgggatgcagaacttgaatttgaataattgagagtggagaggaaaacggggaggatttcaaagggaagtttgattttaaaattgacatttgaatagagaaaaagaaaaatagaaaggatgaaatgacaggtgggggtttggggccaaaaatttgatccacatgcagagtgatatgcctgccaaaatcgtttttctacttgtgtatccgtgtatgtatattactagcaaaatgcccatgtgttgtaccgggtaataacttttaaaatgatttttcttttaaactactgatccaatcggcgatttgattgcaccactgtattcgttactgttaaatctttgtaataagatttttcatggttatatttctaataaaatttatagatggttcaaccactacaatttgatgtttcacgtataaaaacacgaatgtttcaacttgaattcaactttattaaacagtatatttttctgattttatgatttttattatgtattcagtcaatatgactaaatgtttcatatagtggttgtaggccatgcagtcaatattttttaatgctgcattttttaagatattttagaagtaacctgaaacatttattattaaaaaatgtttcatcgagtattgtgtgatgtttcagtagtgataacttaatgtttcatgcgtaatatataaatgcttcaattagaaaaatatatgtttcttactaggatataatcatatgagatattgttttaaagtttagttggaaggaatataatagtacaatcggattataaattagatacataatttaggaaaaaaggtgatttgaatcttgcaaaaagttgttcatacataatactgcataggcaggaaagtacgtatttctttatcttgctgagagatatctaaattcctaccagaaaaaaacaaaagaggaaaagataaactggctgcatggagggaagggtatttgattttgggaaaaaaactgggtgcccgatctgtagtcctctcccaatttttgttttgctagcgccacaatttggcactaccaaatttagtgtaaagaattttaactagtgtgggcaaaaataggtaacaaaccaaacattcttggtactattaaagatgccaaaattttggtacgacataaattagcttcaaaccaaacaagaactaatgatcccactaaaattggatgaaaaataataagtagaacttcaggcatcgctgggctcacatcggtactgctatgtgcactattgtccatttgtcctcctcattcggactccatcggtttgctgctctagggccagaacactgttcgtctcctctactccctaagaaaattaattaaaattctgagaatgattttaaacaaactctacggccatattcatttgttggattgggttttttttaatatataattacaaacggagtacgatggcgactgcgtcctgccgacaatgataaaactaaagcatgaaaaatctggaccgccaaacagctgtttcctaagccagcgggatttttcggacggctccatgattgcatcgatctagtcagcattcagccaacccaatttggattctccgtaatctgtgggtgttccaaatgagcccattatacagtaatcggataagcacgatagtattgctactgtgatacgtacttggattacttcttgtctcaggctgacaacgagatgtcgatcatgcattcgcacgcatgctgcgcccattcgagcaaatgcaaaacagcgctggatctgacaattgagcctaggcggctaatagcgttgtccggtgattaccagttttattttacgaacattggtgaccttccataatagacgcgttaacggaagaggctggacagcccgtcgacctgcgtgagagacttgtacagaaaagattttgtccagcctgtcgacctgcgtgagagacttttttccgtgtggttaaaatgttttttttccgtgcgaaggtcttacccatctgcacctagatgtctgagagatggccctgcctgagaggtggctccgccgatgacattaaggtgcatcatatcaatatggcatggagttattaatgattcaggaatgacgggctagtgagttttaaggcccgttagattaatctaagtttcatttgttgttgatgctaaaaacatatactggcctagaaaatctgtttagctccagtgcagttctaaagaattgctttcgggttctgagcgtaccaattagtttgatcctgcaaccaacaagaaactaggaaaagatgcaaagttaaatccataaacgacagccgatcagctggatcgctgatgacatatcattcaatatttagccgatgtaacgtgtatcagatcggcaatgcgagataaattatagaaatagttaggcccgcccgatcgtctgaagatatcaatgatatacaatctatgcttcggaatacatttataaccaagtgattgggatagatcgtacagcacaccgaggcggtataaatcacttatgtctaaaagtactttgaagtgtagattatatatattcatagcatagccgatagagcaaaccctaacatgtctcggctactactccgatactactttatactgagatatcgatataagggaaatatactgaacgaggatcaatataacaggacaacctaacagaccaatagcaggcttaatatatttcaaagaaacaagatcctaatataaatggcagatttagcatatcaagcaaacacaagaatgacaagataactaaaccaggtaagatcaattgaaactctggtactatctctactagcaaccataaaacaggctagatagtgcagttcaaaacattacttaacagattgaacctaaccgatgtagcattaagcatgaagagaaacacaaaatctaaacaagccgatggtggcctcatcaagatggtggatatgctgtgcagtctaattcggtcgccaatgtctaaccttgttagctgttttcgatgatagaggctagtcgataaagttaaacaatgggaccgatctagattacacagcgttgacggtcgttagtgatcagtttcgactgtcaatattaccaaaatagaggagaactaactttgcttgcaatgcatattcatgttagaataataatattccactaatattgggattactaaccttttgcagagaataaccataaagtggaggagaatcgacatcaaatcagacgataaatcaatcggataatgtcgagaatcagacttatgtataaatgggctcagaattgacacgatgaactgggccaaaattcacaagtttgcgcatgggagcaatagaggaggccacttgccgattttgggccaggctggcccagcccatggttcggccaaacccaccacggcgccattcgatccagggttctcctggacggctgggattgactccctatggcggttggagggtatttccgaccattccaaccgccacaaccgtcattctcaagctataaaaggagctctcatcctcacttcactcacactccaagcaaagctctctcatattctctcaagtttagtttagtgttcttaagctagtggagtaggaatagaatagaaattggagtccggaagccttcgaaagagttcaggtatggctctagtagcttccctttcctcttttgtaagttttgtacttttattagaatactcttctttatatatttatggtattgaaatactttctgagtatataaatgccaactttatagtatgtttatgttatactgattatactgctagcttatctaggagatgcataggtacgggtataatgtttgctattgcaattactctatatcatgacgatgatattagagtagtatctggtagtttagacctggtgtctagattacgggatatcattatttgtggttatatgctgcggatgagaggtgggctgctgatggtgacagctcagtatatatagtcctaagttaatttcctgggaagggtactcctccgtatttagccccgattgtatggtcatgacgggctgtcgtaagaaactcgacagttaggagtggcttctcgaagtactagcagggcatcggaaaaagggtattagctagttaatcatatagctagaatatatgtatactatatatatatatatatatatatatatatatatatatatatatatataagtataggaatatattctctttctattttctttccacttagcttagatattttagtatgagaatgagtagctccctgcttgtgtatcactctacccttgatttatcttaacccctgcttagactatgattagggcatcaccaatgtatatgtcaaagtgatccatataaatgaaacccacataaatagtttatccttatagcaatctccacaatatatatagatacaagatatcattaggagaagagagaggagtagagatagataatataatttattccatatgggtagtccatatgcatatgggtatcttttgctattttttctatatggactagttgcacaatgataataggtggctgatggaatattctattgcttatggactacttttacacaacattgtggatgcccttattacaagtaacatataaattattagtccggttctctctgctatgatctttccacgggattaaataaatacgatacccttggaatactctcgggtgaaatgctacaatggtatatccgtacgcttgcggatgaactctgtaaccataacataccatgagtatttctgcgccattgctgggaattatatttctagtaatgtcgttaagaaataccaacacacagcatatatgataactcggcgattcacataagcaggattagaatgtcatgaatatgcaaacactaatcccgagaatgcaaatcgccataacaagccttacctcttcgtcggagatcgaaaccgatgcagccggaagtattattgaactgatgttgtttgtttacaatgtctcgggccatatttatacccaaaatacataatatataatatgttcttgctggacacaactctatctctattacaacttaaaatacgaacaagtcccttaggacacatgatacgattgccttttctagactcaatccttgcgtggcaatgcctgtgtagtgccttgatcgatcccaacaatgattctagaaccatattcctgggatcggctgcatcagcttctccttgtctgactcaatgtcagccgatgcagacaacagttgatgtcgtttgtagccgatgcgtactctgcttttgagaagcaaactctctccaaatcctcttcgattctaacttcgaatccgatctatgatttgccaaatttggtcgttaacagttgtatctatccattttttaaccgtggatgcacaataaactaagcatatgtttggttagctgcatcacctttagcccgcttagttgcccaaccgagtatagaagccgggtttttcccatgcaaacttcttttccacagccttggattttcaaattgtggaaatgtttttgttggttccaaattttatttcttggatgttaaattgaaaaatttcaggattacacgcgtgaatctttgtttgcttgcccatgtctctatccatgttcgtatgtcttatatcttatataggaaagggatttgtgagagaatgattcccctcaggtgcccaatattccttggattttatttcttttatgccagtgccaacattcaaaattttcaaactaaaattgctaaattgaaaagtttttttttttgcaacgtctacttttccctctttcttgggctcaattctcctcccctttctctctttcctctccaaggtacgtagagagtgcttatgaatgagcaagtggggacatgtaatgccactttgcgatacaaatatatatgaaaatgtttctgaaaactaaacttaacatgtgaaactagttttgactgtggcattatggatttatttaggtggttcatagacactactacagattcgatttctccatgcggccataatcaattttcgcatgcgggtgggtggctcgcttgcgcccaggtgtctgcgaaaattggattcttgcatgcgggtagagcaatcgtgtgcaaaaatagcatgcggacgcttaagccatccgactactataaggaaaaaatcgcaaaaaaaaaccaaaaatcaaaaacctaccccgaaaccctaaccttagaatcctcccttcaccaccatcgccatcgtcatcatccttgtcctcctgtcgccgccgctgccgtcatcgtcgttgtctttgtcctcccgtcaccgtcactgtcgtcgtcgtctttgtcctcccatcaccgccgccggcgtcgttgttgttgtcctcgtcctctggtcgccgcctacagtggatgcgcgcgcgagggtggtgggatccatacgggtgggatagggggcgttggatccaaccctaccattgccaccaccgatggatccatgcgaatcaggtggagcggtggccagattcttgcaggagggagagggggtgccggatccaccctcctgtcaccaccgctagtgggagccctctcagccacactcgccgccgccgctctcacccgaacctgccgtcgcctgagcctaagagcgccatcctcgcacgagctcgctgccaccaccggaacgcaagcctgccacaggggtgccaagaagtgtggacaggaaagagtggggagaggaatgggagagttgaacagggagtgtgaggagtggacaggggaggggactatgggagagggatattttcgcatggcgttcttgaactgtgcatgggagattgatttttgcaggcggaagtagttatgatctgcctgcaacctaaaggagatctcgtctagaaaaaatcaattatgtagtagtcacaaaatggttattgttgaccctattttaaggactagtcaagaaaatagataggaaacgaatatgagtacgaccattttttcgtatgagattagacctagtgaatgaggtgattctagtgaggcagcacaccggtcatgtccagtacgttctgatcgctgtggtcctatgtgtttgaataaagagggtagagtgtggtgttaatgacaagtagaataaaatg

SEQ ID NO: 75331 - DNA, 10088 bp, Oryza sativa
gtaaaagtcgaatttgaacttgcatgtttgtgaagtgatatattacatattaacctatcttgtgattttttttggaattttttcataattatttaagtggcatgcaagaaacgggtgtacgttcacccgagagattagaatccatcctctagagtccacagcatcttcctcctcctctgtctctcttttctgccttccagatccagtgcaaggttgaaagtgactgattaaatcttagcaatccttttttctggtgacggcgacgacagaagaacatgcagagcggccaacaccaccggacaaccgcactactgttggaactaaatgggcaaggcggctagctcgacgcaacacactggaatctgccgccaaaaggtagggacgaggccggcctccgtatgatgagattcttccaggatccttccttttcccccgccattcttgccattaacggagggagggagaagtagactggattagatatattatcgagaggccaacaaggttggagacgaggtactctctctaatctctctttctccttcgctttaatcgtctggatcgatcgtgggttggtcatgccacgtcaaaatcgcaggagactctctgatgctgacaagtgacaaccatgagatggcagcgaaaatgcagttcatggccgccatcagagttgaccggccagccgcttgagatctcggctcgaattgaatagcacgttcttaatttgttggctgccccctgcagtgacccctaactgacgccactaacctgaatttcgtgatccgcgtgatgaattgcgggcgaaagattggttgacggtaaaagaaaacgaaagagatatgtagagaagagatttaattggtgcagggtgcagcaatctggccagctgcttccaagtaatcctcctgtcgtgcttgtgtgtatggtcggattcatggacggggcctgcagagccaactaactgaagatgatgatacagattcctgattccacttcactagaaaattcgcaatcctagcgtctccttttctgtccttaattcgtacgttacgtacgtctctagctggctccccagtgatctttattgttggtaatgcaacttcacatggatagccacttgaattgtttacaatatattgggaacaatggtttaggtttattagataacggatacaaaaactccttactaatagtagtgcatgtccgttactacttactaggccaggccggcctcagcatgaataatctcaactcaaacggacctaaacgacttttttcgatttcgtgtgaaagacgcacgtgcaccagggtttgcaatttcggttgccgccaaaatttctgaaatttcagtggttgctgaaaatttgaaaatttcctgatttctaggtttttctgactgaattgtttgaatttataacatattttgactaaatttgaacaagttttgaccaaatttacaaatatttgacaaacaaacgaaaatctcggggagatttgtgcttgccggtgagggccgaaattaccgaaaatttcaaaccatggcgtgcacacatcacactcacacacccatatgagtcccctaacacatacttaaggagataacccacgaagatattgcgacctatagtattgagtatatatagtaatttggaagtcatatatgctttactttgttcgaaattgcaacatgttctatatatttaagcactgttcacaagattttgtttaatttcctgctgattaattatttctttgactttccttctctgttttcctatttcatctgcaattctgcacttgacagttgtacacagcataaatactagtatactagagtagtgggatgtctgagactgtgagccatccttttggaccaaggctgagagcctcccgtactgcattgcatatgttcttttggctagttgtagtaataatgaagccccatattaaataagtcaaacgaaataagttgaaacctttttgcaaaaaagggaaatgaaattgaaaccattatacacacacaaggttcttgtaaaggaagaaacatgcattaattattgaattttctgatggcatgaaaaattaggatgatatttcctaaatgaatggatttaccttactgccgagggctgggttataccgcacccctgtggtaagcatggttaatacgcgctaacaactttttatattgataaacttttagaatagttcaaattattttaaaatttatttaaatttgatatggttattgcacggttaccattaccgtaccaagacggtaagcctggttaccacatattaatattatcaaccctgtttggtggtattttttttcctaaagatgaagatgaagattaagttttttacgcaaaacgaggtggtattaacgtatgatagattgagttttaattattacaaacttgaaaaatagattaatatgatattttagagcaaacttttatatagaaagttttcgcatgaaatgcaccgtttagcagtttgaaaagagttccacgaaaatcttaatcttcatccaactcttgttggagaaaagaatgggatcttaatttctagaagaatatataattttgagcaccacagaagaagaatttgccataagaaagtgcatttctcatttaattatgtaattacaaacacatctcttcacttggaaatacaccattctacctccttttggttaacattaacacggaccagaaacaatcaaaattagtagcatcggttggaattaatacaggcagtatacaagcaacaatagcataaacaacactctatgcaacctgtctcaaattcctcttttcactttttttttcaccacacgtgtgacaataataactaaatagtaattagttaattaattttggttgattaattgattaattaggatacaatcatctgtacttcatctcgaccacgcgtaataacgtacggtatgtgcatgcacgcgaggtgctcgatgaattagtaggtggtggcgaacggcttgtagaccttgaggtcggagaggattccggcgatggagccggcggcggaggcgacggtgatggcgaggcaggcgaggctgagcagctgcaggcacacccaccgcgtgctccacctcggtatcctcttctgcacgatgtacatctccaccgggaagtagacggtgagcggccagaaccccaccgcgccgaggaaccccaccacgtcgttgaagaacggcagcagcatcgacaccaccgtcgtcgccaccacgaacgccgacctccatgtcagcctgaacaggttcagcttgtagcaccttccgccgccgccgccgccgccggagagggagagcggcacgtcgatatccttggtgatgtaccatgatttcggccaccgctgctgcgcccacttctcgacgaaggcgaacagcggctggcagtagacctggtaggcgccgacgaggtggacgacgatggcggcgttggcaacgtcgaggagccagaagggctcgtagaagccgaacccggtgaggaggttgcccggcgcggcgtcgccgaacgccgcgtaccccgtgcagccgcagagcatgtagaagagcgtggtgacggcgacgctcaccacggtggcgcgccgcatcaccctcgactccgacggcggcggcgcccggatggtgtcctggatctcgatgaggatgagggagtaggagtaggcgaaggcgatgtcgccgaacgcctgcaggctccgccacaccttgtccatgggcgtcaccacgccgatgctgatcccggtgaggctccccttgacgccgccgttggccaccacctgcacgacgccgaggccgagcccgatggtggagtaggtgaacgacatgacggcggcgaggatggacagccacgagatctggtcgaagtccgggatctgcgagaagaagatctccgccacgccgaagatgatcatgtacggcgtgctcgagatgttgcacgggtcgccgtgcccctcgacgtggaagcagttcgcccgcttgatcgccctgttcatgccatgccaaccacacgcgacatgagctcaccacgaatcaccatcaatggagagttcgtgcggatcgatactcacagcatgctaatggaggcggcaatggtgtagccgatggcgacgccgacgatgttggcgtactgcaggaacccgcagacctggaccttgatgccacctgttcgaagaaatgccagcacagtgagcacgacgacatgggcgcgtacgaggccgtctctgacaatgatacgtactcaggttggcgttcacggcgtccatgtaggtgtagttgcgcttgccggtgctctcgtcgccggagcggtagcagtcggcgagcagcgcggaggtgtagtaggtgacgaacgagaagagcagcatgacggcggggccggccacccaacccagctgcgcgatcgcccaccccagcgacagcacgccggagccgatcaccgccgtgatgatgtgcgcgctcgccgtccacatcgtccctagacaacacatcaatgtcagcaacgacagccatggtccatggatgaagcttggctcgaggcgcgagctccgatccttaccggtgcgcttgaggcggccgtcgtcgtcgtacagcttggagccggccgtgtggccgagctcggcggcgaccacctccatggccgccgccgggtagcacagcttgctcgccaccacaccgttctcccccatctctgcactttccacaaacacctgatgagcagagagtgatcgatcgagtggcgccaagactttgcgttcaaagtcgtacgtgtttgttggtgggagagactgtgcgtgcgagtgagagatgcagagtggacgcggcaatttatagccgcgacgccgttgcgctcgctcacgcggccaagggttcgggtttgggggataattgtagaaggcaattcaaagggaatattaattatttgtgcagtggccctatggttttctagctagcatttgtcccttgctatctttaagaagaaatcgatgtaaagggttaataatgtgagggacttgaggggctgagtttgttgacgtatatgcctctggcatgtgtgcggaatatatgaccacttgtatgttcccgctttcgtataatatagacgtgtaagagcatgatagtacttgaatatggtggtagttctgacatgttttggcataaaacctagttgtgtgactagcacacacctctaacaaccttttttttttcttaaaataagttttaaattcaaagcacatccaagtatatctgaactaaatgtatttactcacaaaaggtaatgcaaccatgtgtatagttagtggttgtttgatgtcgtaatgactacaaacccttaggacggctcactagtagtggtagttagactcatctattgttgcaaggtcatatgtgaaaaaaatatataatttattataagctacttttatttattgaggggctagcatctatagcagttatccaaccataacctcttaaaacaaccactgtgtttttgacgtacatgttgcagttgtccataattaatgctataatatatgagatttttcgagtatagtcaatccaatataagtacctatatatggtccatgctgtacaaacatatttccaaaagcttttttaagactatttccgaaatcaagcaccaactaaggttttctcaagagagttgagtgtggaccacacacaaaacacaaacttcatggcgcaaaaacaaaacgtggtggaatataatagttgggcccaaagtaaatcgatcgcctccttccagggcccaaaggcacatgtctgcaacttattgctcctgacttagatctctattaagctagctagccggtacttgcatgcagtatacattggactcacggtggtcaatgactcaatgatgttatcagcgagcttacctacctatatttcacctgcatatgcccccacacatgatcatcaaatatcacggtgttacaatgcccactacatcaagacaggtaacttataggaatatatgcacttatcatagctagcaaagaaaagattgcagcagtacagtagtacacatatgttgctagcacactgtacagctagcttaattttgatcatgcatatatatgcatccatgcatatttacctttgcaaaagtctcctcttcttgatcccctaaccctcttccaattgaggaagagagaagtgaagatcaaagagagagaagaagcagggttacaaatagagatatagttggggttgaacttggtgtggtgtgtcatctatgtgcacaatggatgggtttttatagggagagggtggtgtactacatgcattataattagttgtacgacataatggtagtacttaattagtataccaattactgagagaactagctagggaggtccttgcatcctaaggtgtttttgtgccccatggttctcgaccaccctttagttttagagggaatatgttcggtgttccccatctctggcatgaaatttaataagttcagtgcccactagggatagagatcatatcaatgatcttgttctcttggctggatcattccccttgtatcaaaggaaaagggaagactttgtggagatggttttgcacattctggttatgtcaaaatggcccttaacggcaagtaaagaggttatttatgtgatagttttataagtgctgggagagacctaatataattgagcccaagtgtgtattatttaggccatccattttgcatcctagctgcatgttagtgaagggctcggttaattgagcccaatgcaaactcttcatgattgtgcatccccttccctttcatttttttctttagaaaaaaacatgactttgtaatataattttaatatcaaatagatagcttcaaaataatatatgatccgtatcatgcataagatcaacttactgtactgcaattgtttactcatgttcatagatacagaacatatatattgtcatgcatgactcgtgaatatgtagctttgcttcattcagatttttcttttgtcgtggagaaactgaaatgctactgatcccagaacaaatatataagttttccaaagccaaaatattcaagtattaatttggagtagtatatataatgcacgaattcattcaattctgaagttgattactagagagtaatgatcaatgcatctttgataactaattccggtggattatctatttcatgagatgaattaattagcctatgaaagcacagcaaaatagtaacttaacaacaattagtttgatactcacaaaaaaagcgatgacacaaaagcgttgccaaattaatgccttgcatggttcctcctttcgtaactagaatgccgacatcagcatagctaacgcacacctcaaatcataagctacttcactacactactactaaatatgttactaaaataacaaataatctagttcccctttatcgccttttgaaattcgaatatcaccctacttttgcttggctgagagattccactcgattcatatgatgaaaccctgttaatttgaccagcctaattaaacacattatgatcaggagagagaagaaaagcagtggcaagaacgcaacattccttctcgatatgagaatcttttgcagggattaagttgaacacaatattttttttttgtgtgtgtgtgcagctgcgggccgtgggatcacctagatacaattatcaaattaataacagccgagctagttgcacatatataagttacacacagtgatgatagatcactgagctagagctagtgtttagtatcactttatctcgagcacttaacggaaaggagaattaaatcaagagtaccctgcacacgtggatcaacgggtaacgctcgatgttgtcggcttaatttaattagatcctacgagccgccagctgctgctgtttaattcacttaattagaaatcaattaactagctggggtagtacaccgaagattctgaacttctgaccatttggaatatcaaagtcagctgtggtggctggctacgcatgcattcatagggcgacatgttatatgctacgagcagtaataaacttggaaagctgacgaggatatgtggatttttatttgtaaaaaggtcatcacaggggcccccatgcacgaggcacacaatgtacagccacctgggaaagctttggcaacagcaaccagagagagtatgatagctccggtagctgttcgtctgttcgatcccttacctaaattccccattacagcagacgagatgcactgatgcaggcccggttcagacaatcagaaattcagaatagtagctgttactatatgttataaaagtttgtgtgtgtgtagcggcacgacgactaaccttctcgatcgcttcagacatttatcatccaagacacgccagatgacgacacaggaatacacgatatttgttaacgagattcaatcaaaacctacatccccgaggctctgattataggcactcctccctaacaaatatagctcctagcagctacgagttcatggcctcgccgccatcatctccctatgtgtctacgctacattgtagtcgttatgcatggttatattatagttacagagcacctcctaccacctattataactctaagtctaactataattaaataggactagtatattcgacatgtattaatctaacactacgcatcagtagtggtaggagtacctttttgagagcgtgtggagggggaggagtcggccgcgcgcggggttccttatcaagcgtttgtggattctctgggatgagaatccgagaggattttgctgctatcagtgcgtgcgatcgatctgccactgcatgcagtgctgcactgcagcagctcatcttgccggcttttccagccacatcccccctgccgatcgatcagctccgctcctgctcagcctcgccgcgcacagtgtttctcgtacgtacgcgctcgctctcgccgtttgagagatcgcagaggccaaagcgtcggcatcatcgatcgcttccgctggccacgcgctcgctgcgcggctgcggcgggagtgcaccggacgatcgatcgtcgatcgatctgtgtacgtatatatcgggccctatttacgggatctgcactgtatcagcaaaattaggtatgtctggccggcctgatcacatcgtacggttcctttggtaggagaaaagggctgggctccatcatccgctagctggtggtctggtggatgtatggatcgatcaaccgtgcgtggtccacgacaccacgacgggaagtcaacaaaacgtaacgtagtcgagtggcgggcgctggcgcgcagtcaaagccgatgtccgatgaccgagcgcgacaaagcagcgggagcccggaggcgcttttctgtgtggaaaaagaacaccgaaggtccctcgacttacacaaaaccgttcacttaagtccttcagtggttttagccccggttttgtccgatgtggcggctgaatcagcgtaggatccacgtgggccccacatgtcagggtgtacagtcagcacctccctctttccccttctctccctgcctcctctctctctctctcacttttctctcgtagatcggtcgacaggtggggaggagaccgatgggggcatggggtgtggcgggagaggatttctggcgaccggcgacgccgcggcggcaggggtggtggtggcagcgaggcggagctgagcaggggagtagctctgctctcttctttcttttcttctctctgccatagtgaagtagcaacgggtagcagcgagcggggctgagcggcggccggcggaggcatcgtgcgagggcgcggcggctagcggagccgagcggcagagggcggaggcggcgtgcgagcgcgcggtggccgacagagcagagcggagaagaggagggaggcaccacgactgtacctccgggagccccgccatggcctcccgcagcgccacgctcctcctcttcttcctcgtgccctcatcttcttcctcgagccctcgtttccccttcaagggaatggcgtaggagtggacggcggcggcggggggggggggggggg

SEQ ID NO: 75332 - DNA, 41153 bp, Oryza sativa
  unsure (1)..(41153): unsure at all n locations
agccctcctcatcgcgccaccgtcgtcaggaaacgacggcctgcccctaatccactctgctcttctaatcggtcccaaacctgcgcccgcgacgcgtcgtacaccgccaccgccacccagagtcgtgtgccttggcgtccttgccgccgccgcccgggcctctccgacggcccgaccccgaggtcgcacgcgcggtgagccggtgacgctctcccttctcccgcatcgtcgccgccgccgctgtcgcatcgccggcccgccggatgtcctctcccacctcaccccgacgacctccccacccgcggggcatcctgcagaggggagaaaagtgagagagagagagagagagatgagaggaagggggagaagggtgaaagagagaggtgctgacggtacaccatgacatgtgggcccacgtgggttccacgctgactcagccaccacatcggacaaaatcggggtcaaaaccaccgaaggacctaaagtgaacgattttgtaagttgagggatgttctgtatctggttttgcggtttgaggttgattttgtaattcgatgacaagttgagggaccttcggtgtactttttcctttctgtgtagcactagcaccgcaaccacaacggcccaagacaaacctgtccgtgtaccacttctctgacggcccacgtacttactccaacctagatagaagtaaactacctaccggtggaagcaaaaggaaaaaaattcactttagatcacttttgtcgccgagtctcaaattcgtcactgaaccgaaataccagatatagcccatctcccaacttataataccatgttaactttagtctcttagcactataatgcccggttttagtttacgtggtgagtaggacccatgtgagccccacttgtcattggccgtgtgtgaattgagagatttgaatcagcaaaaatagcacatatgcctatctccacacgcacctaagtccttgcttcaccatgcctagcgtgccctagcatatcccctctgtcgtgcctccctcgacgagctctagatctgggttgccgccctcgagtactggccgccacccaacttgccagtgctagctccaaccggctatgccggccgctacccgtggtcgttgtgggtatccagatatacaccactctccttatctacatcgatgctccgcctgcctcatcgtcgaccaggggataggcccctcctcgtgccgcccatggtgcggccaccgccctcgctgactctgcccgttgaggcccctcctccaccctctgctctagacaaccgtcatcgaccgggccttgctcctactccctcctgtgcccgcaaccgccgcccttgggggccccagcgctgccaatgtgttgccacccttcgactgcttcccaggcgtcgtgctcctctgctggtagccttgtgttggtctttgctctctatgctccgtcctttctcttccctatgaacttgtgtatggttaccaagggtggaaggagagaaaataggtgccgatcagatttgagtaagttgttgtggggtgcagaggatgtgctatttttgctgctcggcctcgatgttcttcatcgtaaagaccccttggccgtcatgtgtggaccaactcgacgtgcgtgcgcacatcgacagctcgtccatcttcttactcttggcgtcgcggcgccacagacaacgacaattgctccaccatagcaaacgagaagcagcaggacgtgacggtactgcactccactgcctctctccggccacctccttgcagacatcactccagcacgtacatgggtcccactataattttattatttttaaccaatcactcactggtatataggtcccacagttttatctaactttgtcaatgcctcgtagctgccacattagctgaaactgttgttcaaaccatcttgggaccttatttgcactggttttgggagttgatgaacgcatcatatctggtattgcggttcagggacaaattttagaccccgacgacaaaccgagggacctcaagtgaacttactcggaagcaaaataggccactacgcgaccaatatgggccaaatcacagggaaatctgttgacgaaaaacacgaggcttgggagatctgcttaactccagtgcaggtccaaagctcgcctttgggtgtgttagcgtgccagttgatttgatcctgcaatcaacaagaaatagaaacaaagaaaccatggttaaatctataaatgatagccgatcggctaagtgccgatgacatatcatttatctttgagccgatgacatatcatttatctttgagccgatgtcatatgtgaatcgatcatcggttataaatagataataaggaactaaatctactcgatcggctgtagatattacgaatatatagttcttatatcgatatatacttaaatcaagtaattgggatagatcggtcgccatgacgagacagtataaatcacttagattgaaatatatattaataacggaactatatatgtttatatcatagccgatcaaatagatctagcgtgtatcggctaatactccgatactactctatatcaagatattaaaacaggtacaatgtattaaacaaaagtttaatatatttagattgcgacgatatcttgacacaaagggcagatttaacatgtcaatgaagtatatgaggcaaatatagttaaatcaaataagatcggctgaaactccgatgctaccctaatcggcaaccagaaggcaggctagagattgatattctaatcatgatttaatagatcaaactcaactgatgcagcattaagtatggaaagaagaacaatatctagacaatcaagccgctggaagtttcataaagtggtagatatcttacataatctaaatcaacgtcaaaatctaatctaatcggttgccctctactagcagatgttagccaattatagattagatagcgatattgccaaagattatgtgagatatatgataactcgacgaattacataaacaagattagagtatcataaatatggaagcactaatcccgagaacgcaagccgtcataacaagttttacctcttgttgaagatcgaaaccgatgcagctcagcccaaaagcaagaactcgtcaaaataaaactaaagcaaaagggtggcgatgcgccgaaattgtattgaacgtgtgtgtgtttaattacatagggctcggggtctatttatacccgagaattacaagatatgtccataccggacacgaccattatctctaagaaactctaagataccataagtctttgcggcagacttttgcccaaacatatctctaaggaaattatataaaatatcctaattaatagatacaattgtcttcttaggactctatccatgtgcggcaattatcttgaagcacctcaactcaacctgatgtcatacaccaagttgtactgtcggaatcggctccatcagcttacttagtccgactcagacctaaccgatcctaatcgtagccgatctggactccagccgattcttgctctgttatcggatcgatctccgcctccgactccacttcgatctaatctccttttccgatgccgatgttaccaaatttggttgttaacaaaattctagaggaaaaagtacaccgaaggtccctcaatttgtcatcgagttacaaaatcgtcccccaaccacaaaaccggatacaacgcatcccccaacttataaaaccagtgcaaactaagtcccttagtagttttgaccccgcggttttgactccggttttatcccacgtggcggctgagtccccacatgtcagggtgtccccgtcagcggctgctctctttcctctcttctctctctgttttctctcctcccttccttcctgtcgctctgtgctctccaacaagaggcggtgcgcgcgaccgcagggtggtgcagccggcgacgacggctcccgggtggcggcgcgcgggctcaaggcgacgcgagctcgccgccctccccgtccccctcgtgcgatcggcgatggcggcgcggctgcggccatcatcaccgggagtccgtcggagatggcgcgcggctgcggccggcgggggaggcgggagtccggcagcgaggcggcgacggcgacgacgcgacgacgaggaccctctcgcgccccctacccctccctccacctcctcctcccaaaaatccccatccggccatccccttcacaaccccaacccgacagcttcatatgctccatggtgcccggcaggccggcacccccacggactagacgcagtacagccgtggcggcctcctcttcaagctcagcgacagcaacatgcagtacgtcacctccagctccttcctgctgctcacctacgccaagtacctcgccttctccaagacgactgtctcctgcggcggcgccgcggtcacgcccacgcgcctccgcgccatcgcgcgtcggcaggtggactacctgctggggagcaacccgatgggatgttcgtcggcgctgccatcggagggcccaacatgcaggactagttccccgaccagtgcagtgaccacgagcactccgagccagccacctacatcaactcgccgctcgtcggagcgcttgcctacctcgcccactcctacggccagctcttctccggcctccccgccatcgcctacggcgtcctcaagcgcgccaacgacgttgtcgacgacctcctctcccagatcgacgccgccaaccgcgaccgcaacagggcgcaggagcagatggagcaccgcgccagcgccgtcggcggcgccgcgtcgttgcctcgtcgccgccggactcccacctcccccaccggcctcctccccacccgccggctgtgctgcctgtgagagaaaagaagaggagagaggaagagaggtggagcggggaggggaagaagagatggatatgtgggacccacgtgggtctcatgctgagtcagctgccacgtcggataaaactggagtgaaaatcgctgagggacttagtttgcactggttttgtaagttgagtgatgcgttatatccggttttatggttctgggatgattttgtaactcgatgacaagttcagggaccttgggtgtactttttccaatcctggaattggtagctcggcaaaccagcccaacgatgctgccgccgccgaagaatctgatgacttcgcctccggcccattttcggacacgtgtgctcccagattcgttcctccgtcgatgagtagaagtcgtccaagcgagcacgcgcgcgtgcggctctgtgctgcacctgcactgctgcttgctcaacgagtgaaaagaagcttcagagcgagttcgtccaaattaaagggcaagccgccgacaacgacgacgagagagagcaaacatttcttcacgaaaaaggattcacggcagcattcgtccttccgacttgtgctctggcggtttcactgattctctccgagattgatgcggcgaaactttcgtactacattacggatatgtcattgttatctggtagttactgatagttactacattacggccgtgtctagttcactctcaactatccaaaacttctaagtttctatcacatcacatctaaaatttttctacacacataaacttctaactttttttctaaactttcaactttcctccaacttcaactttttttcaggaactaaacacagtctacacgtaatagtagtaactaattagggccccctttgaatcaaaggatttatataggaatttcataggattcaaatcctataggaaattttcctatttgaccatttgattcaaaggattgaagcttttcaaatcctatgaaattcctatggaatggcacattgcatgtggattttagaggaaattcagcaagagctccaacctcttgaaaaatttcctttgagtctatctctctcatccgattcttgcgtttttcctgcgctccaatcaaacgaccattcctgtgtttttcctgtgttttgcaatcctttgttttacacttcaattcctgtcagaatcctgtgttttttctattcttctgttttttctaccctgcgattcaaagggacccttactagttcctgtgaactaattgtgtcaccttgagaacaagatgccaaatgaagtatcgtttctccgaatggatgcatagggtggtgaggcagagtttcttgaggtcgttgtgttgaacgtcgtgatcttcctttttggactttgcttggaccggaaccggaaggttgcctggctgcccatgtgggcttgttgagaactcgacgacttgtcaacttttgcattgctactgcatcctgcatgccgttgtattgtagcagtagcacagcagctgtctcatggcttcatcgtcgtctggattagcaactctctagctgatgtgttgtactaaggaaatgatgaggccagaagggtgcaagctggtgttcggtgctattgtgctaagctctttgtcctcttgatggcagatttgtctaaagggaataaagggaggatcaggatgccccgtttactgattgaatggacccaaagtagacagacacctcgctgttcagttcagaagcagattcgatttggacctgtttcttctcgcagtccagggacaatgcatgcgtcaatgctgatgataatgcatgtgcgccaacgagctcgtgagtaaaagtgcagtttctgagtaaactaattgccccttgccacattgcttgactaatatataaattctgtcgtgaactcgtgatatactatatatcaaccctgtccacacatgacatgggcgtgggcacatggcaaagaatgcttggctagtttacatatcacctattatctgttttcagtcctaaacattgcagggtgataaacctttttttctcctagaagacaaagctataaactaatccctgtctcgtggtttatgatacaccagtatcatctcttaaccacataacaattgactaaaaaaaagacggtctattacacatttgatagaaaatacctatcaaaatcttacaatcttggaaccatttgatcactttaagattcatgcaaacacacaaaccctaatcctttttccccttagtgctgcactctcgaaccccccgatgccctacatagagtctagactcctcgtcgccgccaccaccgtcccagcacgctgtcgcctgacctcgctggctagccgacgagatatccccgctctatcatctttatcatctccggcggatccccgccacaggatccatccccatcgggcagcaacttctaacccgttgctccgttttaccatcgccgctaataccaatccaccgccaactatcaccctcccgctacgctgcctcctacggtcatcactctaaacctggggatctcccccttcttcctcctccctccaaccccaaagcacgttcggtggcctaaaacctgcaagatttagggatgaatttttcatcaacagaaggttagcaatcgctaaaacatagtagtttgtgagtcgcagttggttgtaccatgcacgctttgtatcgggctctgctggcatgcaccatgggacggggatacgctattatgtctatacttctatagaacctcacacaaggtgaaaatggtaggaaatttcccgatcataccgcctacctttcagttgatttgtgccaaccatttaatttcgattgtatattgtccggaaatgttgaagttttattcgaaccgttttagtagtatacggtttactgactgcccatccgaataaaaagaaacataatatttatctgttatcgaaatattcaagagttttattctaatcgttttaatagtatacggtttaccgacagccgatccgaatataaagaagcataatctttatctgttatcgattattctattttaatgatgtattcaaaccagttatagctttgaatgttcactaatagtttcatgtgacgttaatttgtaatgtaaacatgactatgacttatttaccccttgatatatttttttggatgctctattttggtaattctattttagatattttttttcgatgtttcaatagtaccaatatcgttactattgaatctggatctaccgttcaatcacgtttccaaaaagaattagtttgagcttttatttgaaccgttttatccctataagtagcaatggtgctgtagattttccacaagagtgatggaagctagctgaaaaagaatactccgtatcgcttttatggcaaaagtcgtggagaggtaaggatgacgacgagaacgagctaggctgaaaagctacaagggccagaaataaataattaaataaaggcatacttgttgtagtgagatggggattataagattattcgggttatggtggatgagggagaagtatttgggaacatcccaacttgatgggcttgttcaatttgctatcatttttaactttatctttttttggtaaagtagaatggctatatttagtttgttgtcaaattttagtaaatacatatgaaatcttgccaaaatttagcaacattgacaaaattttgacaaccttagcttactaaaatttggcaatgtcaaaacttggtaaggttgaaaatggtagcaaagtaaacaagttcgatattacaaaagtcctaattgatttcttttacattgattattcaaacgaaatagcctcctagggcctcatcgtttggcatattcatatgcttatcagccaaatttgaattttcaacattaaatttggagctgaatttgaggttttttcatcgaagtttatttttcagcctttgcttttagatcgctaagagcacatatataaaagttttattcacaaattaatttttatttgtaaatatgccatattcagaaaatatgccaaacgatgaggctgctagtgatttaacgttacatatcaatctaagagtaggatggtacaaacagtaaacaaatggatagcttagagccaaaagacaggaacattagaatttagtactagaaatcaagcactaatccactctgacacgtcatcatgtatcttctaatctacgccacgtcattaaaaaaaaccttgacctcatatcagaaactttcttttcggccaccacgtgggcccacctctcgtcctcctcatttcgagcgaccttccggtggaccccgccggcggccatcggcgtcgcctacgtcgccgtcaagcctccccggcgaggtgggccccacctgtcatcctccccggagcgagacgaaaagctccgcgcaacgtataaattatttatcccgtacacgccaccttcatctatagccgccgcattttactactgcccaccaccaccacaccacccaccccctgcctagctattagctaagctgctctgctccaccactcgtcttccgcgcgcagcaactgttcgcggaaatgccgagcctggcgctgctcagggcggtcgccatggcgctgctgctgctgctcgcccgctcgatggagggggtggatggggcgggcgggggtgggaacgcgacgtgcccgctcgatctgagctacgtgacgacgttcccgtgggacgccgacctgtgcgccggcggggcggggaacatgacgaggtgctgcaatacgctgctgtccgtgctcgccatcggcctcgcggagcaggtccgcgccacgggccacttccgcatcccgtcggtgggggagtccgcggcctgcctcaaggactacggggcgaagctgtcggcggcgccgctctccctcccgggagcgtccctcgtgcagacctgcttcccttcgccggagcagttcgtctcctcgccgtccttctgcgccggcgtcaccaccgccgcggagtacagggcggtcgtcgggaacgactccgtggccgcgctggactccgcgtgcggcgacctctcctcgacgccgcactgcctccgctgcctcgacgcgggcatcgccgccacctcccgcctcaaagccgccgccaacatctccgccaacgccaccaccgacggcgccgcgacgacgcgcaactgcttctacctcaccgtcacgtacgccgccggcatctccaacgtcgccggccccaccaacccacctaccgccgcctgcaccctcggcctcgccctctccaaccctcccgccgcgccgcccaaatcccacgacacggtcatctacgccaccgccatccccgtcgcattcctcctgctcgcctcgctcctcgcgttcttggtctggaggaggcatgacaagaagaagaagaagaagaagatccacgagatctccaaggagggatcggcgaagcggcggtcgcatccgcggccgaacacgggctccatcctgtacgacattgccgagctctccaaggcgacggacgccttcgccgaccgcaacctcgtcggccgcggcgggttcggcgccgtctactgcggcgtgctcgcggacgggtccgtggtcgcggtgaagaagatgctcgacccggacgtggagggcggcgacgaggagttcaccaacgaggtggagatcatcagccacctccgccaccgcaacctggtgccgctccgcggctgctgcatcgtcgacgacgacgccgaggaagggaagcagaagttcctcgtctacgacttcatgcccaacggcgcgctcgaggacttcatcttccgggacggcaagcggccggcgctgacatgggcgcagcggcggagcataatcatggacgtggcgaaggggctggagtacctgcactacggcgtgaagccggcgatctaccacagggacatcaaggcgaccaacatcctgctcgacggcgacatgcgcgcgcgggtggcggacttcgggctggcgaggcggagccgggaggggcagtcccacctcacgacgcgcgtcgccggcacgcacggctacctggcgccggagtacgcgctgtacgggcagctgacggagaagagcgacgtgtacagcttcggcgtgctggtgctcgaggtgctgagcgcgcggcgcgtcctggacatgtcggcgccgtcgggccccgtgctgatcaccgactgggcgtgggcgcacgtcaaggccgggcaggcgagggaggtgctcgacggcgcgctgtcgactgcggacagcccccggggcggcgccatggagaggttcgtgctcgtcgggatcctgtgcgcgcacgtcatggtggcgctccggccgaccatcaccgaggcggtgaagatgctggagggggacatggacatcccggagctgccggaccggccgctgccgtacgggcacagcgccatgttcagcgaggccgggagcaacttcagcgcctcgccggcgttcagtggcccgttcattgacaatggcgacatgctcaggtgatgtaggaggaggtgatctttttcttggcgaattcaagaatcatacagcctactagataagaacaatagccgatatggatgtagtgctcttgcaaattctggtcaattgaactccagaatcatatgtttcgttatctcttgatttgcattgatttttttttcccatacaattcattccaagcgatgaaacagatggaattattatcagagttggctgctacttgtgaattttactgatccttgccaagataactagataatacaaactgactgttcaccatctggaaacaagaacagtggctaattaaacaagcagggagaagcacaaaagcaactgacattgagtcatttctgaattctgagtgctaatgctgggagaagcacaaaagcaactgacattgagtcatttctgaattctgagtgctaatgctgggaggagcacaaaacaactgacaccctctcatcagtgtgagttcattcagacaggcatgagagaaaccacagatacatctagcagcgcatgaggaaatgcaaagctagcaagcaggaggttcagccaaattggcagtgctcagcagcctacttctcctgctggaggttggggtggctgggctgcaccctgaaggtgaacggcatcgaggccgcgaagtccctgtcgtcgtggtggtagccgagctccagctcccttatgccgccgctcagctcgacctcctgctggtgctgaaaacacggggaggagctcagtgaactctcagctttcaggcttctttcagtaaagcttccctcactgaggtttgagctctgtgcagggaagtagtaatcagatctggcatttctgatcaattgctatatggatccagaatgcaggggtagtttgttcatagatgataacatctaatggagcagtcaattagatcactggtcaagattcaataggatgttttgtcatatatgaacaaactacacctgcattctgaatccatatagcaattgattagaaacaatagatctgactactactactaccgtgcacggagttcaattttcaatcgctatatgaattctgaatgcaggggtagttagtctagagatttgttgcgtagaatggttctgattgaatattgaccagtgatctaagtgaccgcattagaatgagcatggcactgaaaaatagctaaagtagtgataggcgcaactacgaagggtcacttattatcgaacctagttgaacagttagagcagttatatcagatggtatttgtcctcaatttcagatggtttttagaaatagaaatgagaacacaaggaatttttcaagtgaaagttcaatagaaaaacaagttactctgaaggaaattaccaccctaaaagccaacatcttgtgctcgtcctccagcatcttctcctgaagccgaacacagagacatgtgaggtgagtgatcagagcttgcaaaagatattgacttcatcatccacaaaagaagcacaagaatcatccagatatctagagctcatacattccttttatgcatcctccagtggtccatctgcaacatcatggaaacaaaggtgacatcagaaacaaaaactctctctgaaaaagaagagatgcggcacttgcaatctctgcatgccatgctgaagtaaacatcaagcttcaaagacagtaatcaccatcttgtcccgcagattggcctggccgttgttgagcgcctcctcgatcgcgatcagctccttgggctgcagggagttcagatcctcccctttcatatgcctgcaacatggaacaggcttgacaaatcaccaccatccctgatgtccccaacaagagcaaaatctaaagctgaaaacgctacaatgggtgatttatagttgtctctttaattaataggaagtgaaagaaataaagatgcatgatagtaataagttgggacactagcctgagctcgatctgcatgttgtcgttctccttcttgacacgatcgatctctgcgctgaggctctgaaacgttttccaagaatacatttttttaagcatttctattcgattttgtaggaataaaagtttggaaaaaaaataatccagaaaagcacgcaccttgtgcttctcatcccagagtatcttcccggagttggtctggtacttctccaagatccttgacagcctaaaacgccaaaaaaacaaatcaaattaaaggccaaacacaatgcaaagagaacatgcatatctcaggaaacactgaaattaagagcaagaaaagaagaaaagaaaaaaaaacaaggaagaggagagagagagacgggggaaacacggacgtggtcttgggcgtgcagtagtcggagagcttgccggcgctggagaagatgacgacgccgacctcggcgtcgcagagcacgccgatctcgcgggccttcttgagtatcccggcgcggcgcttcgagaacgtcacctgccggttcgtcgagttctcgatcctcttgatctcgatcttgccgcgccccatatccaactcctcctcctcctccactccaagaacacaaaccaagaaacaaatcttcacctcgctctcgaagaaacaagagggttggggagttgccgttcttccggtctttaaggtggggatggtggggggtgtggacgactggacgccatggttggagtggagtagtaaaggagggtgcagtggaggaggaggagggaggccgccatggaaggaatggaggtgaggggggctttcgcggtggggcagggctggagcgccggaaatggaaactgctctctctctctctctctctctctctctctcgcgtggtgcattgcgccattgcctggctacgtttcgaccgggtgcagtccgtgcagatcgatcgacgtaggggtagggctcggtgcttgagcttgagctgacctggtttgcgtgggactgagatggaaatgagaatgacacatggtgagcatccactagtggagaaattgtttttagtcccggttcgtaaccccttgtagtttcgggactacgaattcaggactaaagatccctatctttaggccctgtttgtttcagcttaagattattgtaatctagattattaaatcagattgctctaagctgaattataataagctaatataaaataagctacgagttgtttgtttctctggattattagaggcatctaaggatagtgggtctttagccactcaataatatggaaaaagcttccctagaggagattattggattatagtaatctgacttatatattataataatatagcataataatctacttgtttgtttcagcttactcctaataatccagattataataatcttaagctgaatcaaacagggccttagtcccgattcaaatactcgggactaaagatgggagaggcagtcctggttagtttttttattttcatttattgctacttactactcaatctctaatttattttctcccaaattatgtgggatgcatattcctaaatcaaaccccaaatcaaagtaacatcccaaatacacaaatcaatcatatacaccacagattatagatcccaaatcaaaccccaaatcaaataaacatcccaaatacacaaatcatatacatctcagattcatgcaatgaatcacagattctaaaaaagaaattatacatctcaattcatgcaatgaatcacaaattcttcatctcaacctatacatagatcacaaattcttaaaaaaaaagagaaaaaacgcaaagccgccagccggctcagccgctgccgcttccccggccgccacttcgccgtgccaccgctgaagcatctaggcccccggtgttaattttggtaattaatgacaagcattaattgtggactaaccgttgtctttgagctatatattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgccagtttaattttagtttcgccgtactattaagaggggtaatgacctagcaaagagatgattttaattgccacattaggtcattgcattttcatttgtgctctctttttcattacacacacattcacttgcaaattcactgggttcggcctgaccaggggcggtcagaccggccacatagtggcggtctgaccagcgtgccctggccggtcagaccggctacatagtgacggtctgaccggcggcactttcccggtcagaccggccccctggaggccgagatggtgctgctcgggatggccgatacagagccgacgaagccgtattcggtcagaccgaactgatggcggtctgaccgagccgaggccggtctgaccggccaccccatgccggtctgaccggccaggccgatggggccctctgacagggctacaacggctagttttctagccgttgcagagtagcacggtctgaccggccacatacctccggtcagaccgacagagcacagagttgggggatttcgcccccaacggctagttttggtgggtgggagtataaatactcccccaccagcagcaagggggctctcttggcacccaattcaattgcatacactccttgcacctctctcacactcacttgagctttgtgttcatccatctagtgtgttagagggttgtttagccaagagtcaagtccatttgcttccattgtagagctagtgtggcacttgatcatctccacaccgggtcattacttgttactcttggaggttgccgcctcctagacggcttgtggaggagttgctcggtgacctctccgagaagattgtggaggaggcccggcgccggtttgtgagtggtttggagttcaccaccttcagagtgaaggaagaactaccccgagtgatcgaggcttgggtagtcctctccgtgggccggctcccgccttgcccaccccttgatgaagggggcgtgcggtggcttcgtggttgagcggtggagttgggctcgcctcaacggggagtaggaaaccggcgagtttccgaacctcagtgaaaaatctcttgtctcattgtctcatttgattgtcgcctttacatttgtgcaatttacatttctagagacacacttgagatcatatcaccctaggattgcaaaacatcgacataggagcgtgatttactttcctagagatataattgagccactatcaccctaggtttgcaaaacataacttagttgcttagttagagttcaccctcaccaagcctagcaacttaggttagatttgattaggtgttatttagttttaaatcgcctattcaccccccctctagtcgacatctcgatcctacaaccgcgcggccctccgcgccgcagcgccggccgccaccgtccggcccaccctccccctcctgctgcgcacttcagccacacgcgaagggataaggaaagaaaagagataaggattagatatgaaaagagagagagaggagtttgtgtggatgggaaaagacgataagtaatagggattatatagtgcgttttgatctttagtcccggttagtaacaccaaccaggaccaaagatcatcgtgatctttagtcaggattaaagatccgaactttagttctccaaccgggactaaagatcctggagggccctgacaacacctcatagcatgtgaaccgggactaaagatcacgtagtcccgttctgtttataaaccgggactaaaaaccatctttagtcccgattttttattgcaaccgggactaatgtggtttttggtcgaccgggcaaagatggtttatccactagtgatcttttctcctctagtcgttctcttttgtgtggaaactattctgagctctcgagggaactgtttgagcaacatacaaacaacgagatgatgttccttcgagagtttaaaatccacactcctcttttgtgatcttcattcactcattcttgctcgagggaactgtttgagcaacatacaaacaacgagatgatgttccctcgagagtttaaaatccacactcctcttttgtgatcttcattcactccttctgcaaggagcaggaatgagcatgaggttgggcagattctgaaccattcaggatgcaaactatgagggcttcattgctcaaccatgtaaggcaccggtaaagccattcacaatgcaccgagatggcgagtggttccaactcgtcatgttggtgtggcaggctggtggctccagctagactaaacccgtgcctctgtgaggtttctagttccttgcagagggcgtgagtgtcccgatagggttgaggggtacttgtgttcaaggtacagctcgtgaggccgggcggtctcgttccccattctttctttcaaatggcggtgaccaaaataaagtggtgcgacaaatgtcattggggaagagaactagcacaacggagaaggagagaataggagtgtattgtctccagacatcacagagtctatcacacaatctacggccatatttgttgaggtcttcactcaatccgtcgttgtcggttacctaggaactagggttcccatagcagacaacgcgcacaaggcaaatgacatgtgtcagctcacccagctcgttacccgcgctggggaacagtttgggggcgacacgtggcccatctcagattgcaaaagacgttgccttcggggcaccccgagagaagatcccaaatcgtattcaggctgatcttgggtctcatactcttttccatttattcatgataggacgattatctaccccagggcaatgagtatggaagacaacgcctgtcactttagtcgtgttgaatctgacactagtgttggcaatggcatgcgggccctgtgtccaggttcaacacggctaaggagatgtggtcaggttctaccataccccatcgagacccatgccttttattgggcaatggcaggcggaccccatgtccagctaggcatggtgaatcctattcatcgtgtcgttgcgtggattaagtagggtgtgtggcaagttccgtgatgccccactcagagtagaccctactcaaagttgccttgaggcttcggtggattcgacacggtagcatgccgagctctcgcacatatatctcgcgaatagtaggccctgccaggtgtaccccccaggtcaacggagtaggtaagaagaggagttactgagaagacttatcatacttgatcttgatatgaaaaaagatatttcctcgaactttagtcatgtggtttcccccaaagaaggtataaggggaaaaccgagaccaaaggagagcggattggatggtggtgactaaggagagacttcaacacattatgtcaagctctcttaataaaccccaaaaagaaaggaagcagaactactccgagtagtcgataaacctgtaaaatccttcaagcgcaagaaatcaccaccataagagaagtagggtattacaccttcggatagcccaaatctgtatacttcgatcgtgttcgtttgtttgtttcttgcgctcttgaggggctcaagtcacctccttacacgtgactagctcctcaaccgaactcacagaagggggtcctaccagatccccattatcaaggttcacactccgacaaccgccccctccctcgtaatggatctaggcgtcaatgagctcatcggccctagccttgaggccgctgaacaaatccagcggtagagtgaatccgccttcgattttcgttggagatagagatgaggtcgcgagcgtcaggaagggatgcaagtgaggtgggcatgagcgctgggtttatcttatggaaatgtatctggaatctagaaagcagtcttaggaacatctttctttttattaacaaaaatatgtcaatcaacaggaaatcaatagatgcagtagcttagagcatctccaacagagtgaccatttttggctctccaaatgcctatttggccagcctaataaaagtttagagagtcaaatttgtcttctattccaacagactctcccgttccactctctattaaccaatggaccccacctgtcattctcctcctctttcttcttcctctctctccaatcctctgctcgtgccagcgggtcggctgcggcaacactgcggaggaggtggtgaaggcgtcgagccgccccgctgccgctccctccctccctccctcgccgcactaggagagcgatgacggcggcactgggcgggcagatcaggaagagagggagccgctgcggggaaaggtaggcgacgacgcggacggcggcggcggtcgcggctggcgacgacgcggatggcgacggaggtcgcggccgccgatggtgcgaacggcggcagaggtcgcggccgtcgactgcggtggaggtcgcggcgggcgacggcgcggacgacggcggcggtcacgtgtgaccacgtcggcgctgggggctatgcgagagagaacagccggcaaagagaagatgggaggagaatgtgtgtggggcccacaattgcccagcgatttttggctggctaaatttggctagtggagggagggttggagagactgttggagcgcgttttttttgttagagtggctaagattttgcttagagagtaatttggataggctgttggagatgctcttagtactgctactgtataatgcgcaacagttgtttgtgttggtgaactcagaccaaattccattgtaaaacatctgaaaaaacgtggctgttcggaggacatcacctgtgaaatccattatgactttacgaggtcttgctcttgcagtcatgtaactattcctccggtacaaaattatccgtaaaaggttgaaattcacagaaacttccttggcttggtaactaaaaaataaaaaagcgtacactaactacgttatcaaaataaatctaatttctgtagcatcaacgactccgtggcccaatggataaggcgctggtctacggaaccagagattctgggttcgatccccagcggagtcgaaatagcatattaattttgctatgtcttttgtttctgttttactacctggactcctggaggtttcacttccaacactgccacttgctcgaaatcaatcttttcccatttttttgtcactcacgttggtcacagttcaaaaggtattacctcttcatgcaaatgatgatgatttctcttttcccttgtctcttccaagcataggtcatcagaatcgctaattagcaatcagccacgtacatacaaagtttatacgtaacatataaagtttatgtatatggatataaattttatacatatactcaaaacgattatacgcgcatgtataaaaaaaatgatacatcaaaatatgtatgcgcataagatttatatacatatattttttatataaatatatatataaagtttgtacgtaattttgcccacgcaactccaccccactcccgcagcccatcccaacccaacaccagttcagagagtagcagtgcagcacagccaaaccaggccactcaagattgcaatctctgaaacccaaactggcatttcaggagggttttacaggtaaaagaaaaaattacaaccaggcaggtagtgcagtgaagtcgcagggctgagcagaaagcaaaggtgggttcgcacaacagagaccaactggaggaatggaagctcatgttccttcagctccaaactgggacctggcaatggagacaaatgccgactgactcagtctccgtcttggataatctcaatggccgtcgggtcatccgtttcgtagtcgtctgcgtcgatcggattgcaagctagtggcttgtcgatccatggcatgtaggccccctcgtggcacaggttctggaaacagttaaaacaatttaggctttaggaacaatttaataacttattattaatgccttcagcatagctatccttaattcccaaacgaagaacataataaggagtacatcaagaacatcattcttgttccctagagttatgttgtgagcattcattgattagtggccagatctttcaaagattagtaccctgtgaaatatctgaatcaaagaagtaacatgcacagaaggaagatcggacggactagttccctctatgtcaatgcggtgaaaaatgctagcgacaactgttccttgtttaatgtattttatagtgaaatcattttagtcattgcaccataaaaggaattactgtgatttatatcttcttcttttttcgaaacggaatcacagagacagacacctaatattttgacatagtttcagccattagtcaaatgaagaacattaaatctcaattccacttatagggtagtttagagatcacctccaaccagaagaagaattttcgcaggaggcaaagttttctctcatcagagtcagcagaatctatttgtatggctagatctgtatgagagaccaaacattagtgttgataaaagaaatcaagtactaagcagaatctgctaatctggcttatgtgaagcaccaagtaacttgcaaatatgcaattatacatcgtgccataaaaatcagacttcagcaattgttaccagggaaatgttattcacaaatgcatggatgccgtaaatttattttatattcaaaattgacatcatataatacaaccctcaatggtaagctactaataaaaaaaataagaattccttttccctgtgatatgtgcctatgtctcattttattgaggggttgcagtaatgaactagtcagaggtctagcctattgacttaacaaataaattccactgatcctttgcaactggcgaaagacaaaggccttgaaagttaatccgtaggatacaacaacaggctggagcacagatcaattatgtgatgctactagatcatataatgtacaacgagtgtcaaagcttgtcaacgccgctcaaatttaggacaaaatcaagcccttggactgttagacatgaggattacgaaattactgaccagaatttagtgattacctgggtagtgatcaagaaatgacaacccaactgcccttgtggcatagggcttggatgcatttcgcaagtgtctctgtctactcacaagcttccgatctgtagcttttctcaaaagctctttatattcatttaggtcatacggcttacttaaaacatcattaagtttttcatcaaatgtagagggaatgccacaactaagagcaagaggttctccttgttcatctccacatacctgggtccaaaaagcaaggtacataataaataaaacatcattaaagatattgccaagggaacttaagcagacaaatgactcacattcaaatcagaaagttcagtacaaggtggaagtccatgctcatctatgcagactagatcctgaccacccatgttctctaaagcaaggccatccatttcacgttcagatgcagaattattgatcttcccaagcccatctccatcagtattcatagcattctcttcacccatgttttcaaatgcagtcatcaaagaatctcttccatttgtggaagtggctattctcaattcatcatatccaaccggtgtctcctctgcttgcccatatacaatggtaacgcctggttctggctcaataaccatgagaccattcttgatcttcagaagtctcagaaatgtagcatatgactcatcgatttctgacgtctccatcgcaaatgatgtacctagtgaaaaacaatgccccgcatttgcactgccagccttgtctgatgttacacctggtccctcgctgttttgattacaatggcttctacgcaatgaactttttgtgatatttgtgccggatttggcattagcatatccattggatgcatgatcttgtgcatatcttagaaaaacaggcgagccatggtcccctctcggcgcatcaagtacatagccgttcccatcttccctcagatgttccaagaaaagcctgtaacttggatctatttctgggatactatcaacaggtagactaccaaacactttgttcttgctgcatgatgatctgctcaccatgtcctgggccttcatctggcaactcccctggaaatccaagaagtgtaaaaaaccacagctacatcaatccgaagagcaacaagcacggatacaacctactgagagctgcatcaagagtagtaccacggtgttgaaaaaagaaaagaagagaaaaaaatcgagaatttagagtatttaccatcaaattcgcgtgcctcaacttttttaccactcaattcgtatgccctctataatatgtcattaggagtgctaaactgctaatttgtctatttggtaccgttttctctgtttttcatgtatttctcatttcttaattttatttgtatatttttttactggtttgtggacatttctacccctgggcccacctgtcagatccaaaagagagaaatttctctctggatcgatcgatccctccaggcaagcgcccccgaccggcatcggcgccgtcgaccgcgaccaccccgctgcgcagcgtcactaccccaccaccaagcgccgccgcagatcgccaccgccgccagggtgagcaagctcgccgccccagcccccaggtcgacagcatatacatgtctattacgctcaggcgtaacaatttaccggtcaggcgtctacagtttacaataatttgctacaatatacatgtctgctacggaatcaggcgttgcaaatgagcaaaaatggctcaaccaattcctgctgcaaccatatgatcttcaaattgattttgggagcgattgaaaaactgaagaaaaagagaaacagcagctttgccaccatcttatctccttgtttctgctttgctactggggactgccctgctcatcgcctccatcttccagttcttgcctgtaaaaggaatcggaaagctacttactctttgcagaccatcggcagcgccccgcggtgtaggcggtggggccgtcgagctggggcggcgggggtggtggcgctcggcggtgggggcggtggggcgtcgagtcagccgcggcggcggcagctctcggcggttggggcggtgctcgggggcggcgagcttgcgcaccctggcggcggcggcgatctgcagcggcgcttggtggtgaggtaatggcgctcggcggcagggtggtcgcggtcgacggcgccgatgcctggagggatcgatcgatccagaggagtctctcactttggatctgacaggtgggcctaggggtagaaatgtccacaaaccagtaaaaaatatacaaatggaattaagaaacgagaaatacatgaaaaacagagaaagtggtatcaaatagataaattagcactcctaatgatatatattatagagggcatgcgaactgagtggtaaaaaagctgaggcacctgaatttgatagtaaatactctaaattctcgaaaaaatcggcacactgttgtagttaaccaattaaatgcacaataaaactagtccacaataagaactagtatcagcttgtaggcctcggccatgcacgcggcggaggttagccagatagatgatgatctcccgcattacctgaattgattaattgattacctccaccacatgacccctgcccctgttcttgatcccttttgctgcatgagcagcagcacagtcgaacaacctaatctctcgaagaggagagagagggggactggcaggaaatgggtgggggtttacagtgggagaggtttacagtgggagagagcggatgcggtggccgcaggcaaagaggaggaggaggagagacgatgtggcagcgaaggttggtgacccagcggacgacctgtttgaggagaggagaaagtagccaactcacgggtgtgcattaccaagtatccacctaggaaaatatatactgcaaaccacttatacagcaaaaacttaaaaactattgtttagatctaaaaacgagcctatgagattcgtccacatcaccatgagtaaaaattttactccttgttcacatcaccattactcataagtaataaatgtagtaaaatttttactcattgtaacgtggatgaatcttggctacaatattcttctccctcccctctctacagtagcttctctctctccctcgtctcccatcccctccttcccccagattccaacggttcaccgccggcgagggttggaggaggggtccggccacctccccctactagtgtagtgtggttaggtctgttattaggtcgttaggtgcttcctgtagttagggctagttggtgcttttgccggtgagtctccacggatgccagtgtggacggcggcggtgatggttggtggtggtggcggtgcgagatccgaagatcagtggacgaatcgacgggtggagatggctccttgtggtagtgttggttgcagcaccgtcttcgcccgggaggtcgccacccagctcctattggctgctgcggcggcttctcgaggccttcgttggctagcgctggcagcacatgtccatgtcgccctactatttcccggagcttgctactcgcggatgtcaagccgataggtcctagtgcgttcactggttgcagcgacgatttcttagacgtcgtggatttgttttcgcccggagctcgcagctcgtgatgcgcgatgacaacccgatgatggcttggtacatccaatggatgtggcggtggtttctctagtgcctgaacgggagcttccaatgccaaggttccattagtcaagattcacacgcttccccaaccacgtacgtcgatccaagaagacaacagttcgtttgccaccattcgagttcttcagtggttatgggaacctggatttgggctccatcttcccatgtgtttcctaacagcttgttccatgcagagtttgttgttcgggttgagcttactctccttagatttaacgacgaactccgtggacaactcttgctgagcatggggatgcttacaccaaaatttgtgactcagtagcatacctctattttgtgccgtcatcgtggaggcaaccgaaggggattgctggtttgtcaagcgttgtgcacgccaaaggaggcccaaggtcgcaatcgtcgcggcattgccgcacctccctgtcgatttgcaccttctccgttgtgtggtttcattaggaagtttgtggccttagtgcagtccccattctttagaaacggatggttttatgctttcagtttatctgtttggcaatgtagatttattcccgtgaactctatcgttttatattaatggttgtttaagtttaagaaaaatgtggacgaatcttaaatatctatttatcaattctcaatccaacgatagtttttagggtttcactagtttctaccatatatttttcctatctaccatccgtttcagttcagttgtctcaggtttatctttcttctcctctttaagaggccattttctattaacgaaattgctagaaaacacagcacagtttttctccccgaaaactattaaatttgtgagcattagataactttaagagtcgtgcaaatgaaaagaataaaataaaataacctatacacaatagaaaattgaaccaggacgtttctacctatgtcgctatgcccgtgctaacacaacggtgataatcgataatgcaaaaaccaaaaggtaatatttaagattcacgaataaaataacgatagagagatgtgtattgttctcatgaatattattatactgttaataaattcccaaagttggccatgaatagagttctacaatattttaacatttcaaaacacaaacaataactcatggtgtctaactttctataccacatatagatacaaatatcacctgcaagttctacaggtgttattttttcaatacatgtatcgcctagaaacattctgcaacttctgctcctcactggtcaccttcctccttatagagcacctcaagaagccatatgaacttctctatcgaacgcatattagtagaagcaccatattgaagacaatgtgttcgcctaccacgagacacacgctcataaagacatattcatcacttggcattagtaatttaactcccaaaatatttggcaaaatcccggtttctattaaggcaagaatatgtagcaaagcaaatatataggcttttacatggctccaattttgttcatgttaatgagttgaaaaaggtaaaatgaacatgaatactttgttaaatctgcagataaacttttcggatcatggaaatgcatttgtcaaatttcatatgttcagatcaaatttcattataccctacgaatacacaggacgcgtaaatcatcaatattgcacgctaccaacagctaggcaccacagaaagcagtccgaaaaaaccatagaatgcatgcgacatttcaggaaaattaagaacgatacgatgtggttcaggagaagggggatcggcgacaaggcagcggcttggacaggggaccagcggtgtggaaagatgtgttccaaacctgctgatgttcaaaattaagcacatactccctccgtcccaaaaaaagacaaaccctgggtttgtctgggtttgtctttttttgagacggagggagtaagtcagttcaccgaatccaacatgaaactggtcaatgactgatatagatttgttttttgaattaaaccagattgccactatggtgctttatctcaagtattcagctttttacaagcttaaatgccgaccctaaaatatagagatcattaataaaaaatgtggccccttcctaccctatgctcaggctatcagttaggtccatctcacagaacctcaatccctattgaccccatattagaaaaccctgaatctcaagtacaaccgttacatatatgacacattaagatgtagaagacactaatttttatatcagtttttaataaactgatttgacaaagctagccgggtccatttaccattttatcataccagataaactaacacacacacacacacacacgcatattctcttccatgaagttccaatatgcatgtttgttttgttccatttttctaccaaaattcattttgtagtgcattccctaagacccaacgatccccagtcatgcatgatacaaggttgcattaaaaaccctaaactcaatattttttttccaaaaccacaatatgaaaccatacatacatccaccatgcatgaccctgttgaataaaaacgaacactgcaaatatataattgcactaatggaaatgttcattggactttttgacgtcgaaggaacggtttgagtgtgacatacaggggcagcggtggatcttgaggcaatgggggcagtagcacattgatggaggacacagctacgtgtcggtgccaccgatcgaggcagggcgacggtggtccagcggcagagaatggtgtctccatggggcggcgatggagcttgtctccataaaattagatgttgccccgtcccataaaaatttcagcctgccatataaaagagagtcaagtataaactccatgtcatgtggcttgccatctaaaagggatttcagaaatcaaggatttggattgatggcataatcctatgcacaaagttagaaagatcactcttgaaaatttaaccacctttcttgaaacaaagattacacaggattggttcatatttcaaccattttaaaaagcgggattgaattagtacaccaatttcattaccccttctgacaacatatgagtgtaacaggggccatatatattgagataagttaagaaaatggatctaaaaaattttgcatgacaaaaaaaaatctaaaggcattttaaacaaactgagagatcagctcagagtcatctttgttcagatgcaaggaaggaataaaaagaaaattaaacaaaccaagagatcaagggccaaatagagccagcaccatctcttagtacaggaaatatatgatcaaaccccaaagtaaaaatgcaccatttaatttctaatttggatgaatggcaatcgagcccattgcattaagagaataggcaagcatgcataggtggtacggtggcaaacagcaaaaacggatcaataataatataattctcactcatattcttgtaaactatttaattctgatatataagataaaatgctgaaggaacataaagagaataaaatccagtatcaatagaaacttatgaaagtgcagtgtgacagtagaattcttctgtttgacctttttcaatgatgaatagtttcagcaaatttggttctattttaaatgaacaacaatagttaggaaacctattcatctagatcatagcattttataaacctatgcatctgaagatcaatttgtacaaagcatcttactctcttccatttaaaataaactactatcttccatgaaggcaaggtataagttacaacgctatgatggcaatacattttaacacaagcaaatttatctatggtgccatcatttttttagggtggcaacaaggtaccaagtacccagctggttagggcattctcaacccaatgactaggatggtgtccatagcattaaataagttgccacctaggacaaaaaatgatgtggcaagtgaataaatgaggaaagagaaggaaaccatgtcttgtatgagacatggtttctacacaacattcaagacatcatgtgagataagtagcattaaattgaagtatggaatagtggtatttgcattggaagagtagtgtctagtactagtttctgcatgatgtggagtttatggaaacaatgtctagtgttatgggttgggactgctcttatataattgtgctactccatgcaagaagacagagagattaatcaaagccactaaatattcagcataatactactaactaccaagatattccatcttataatattcagcatggtccaaatttagtagttagctacattgtcatcatatgctcttagggtatataattttacgtctatctgctcatgttcaaaattatttcctgaaaagtatataactaactgttgttacctttggttcatgtacgaaaacctaaaattgatgtatacatccaccatgatctgaatccatacttgcatccaccatacatgaccctacaaatgaacacaaattgaccatgcatgaccttgtgggatgaaaatataccctgcaaatttcccagtgaaagaaatgcgtctgtctaggaaaggttcacgaaaaaaacataataaatattgctactggcatttgaattttaaatccatgaacacaataaaggaaatttttttgacccaatgaggcattcaacaggcacccaaatgaaccggtacgtcctatcgctaaacataaaccaaatgaaccttatcctgtcctatccaacagccacccaaagttctgtataatcccaacagcattcacatagtctcctctatcatcaatataagtttgaagaaaacaggaaacatgtgtagactaatggcattttcatttggctgggcaatgaaaatcctaaatgatagagcagaactggacagtgaagcacgacttggtcatcaaacatcagtttcttatggtcgcaaggtctcaactaaactgcaagctcaacaaacataagaatcaatatcctctcagtttattttttgacatgtacaaacatatgaagataatcactttctttgccacacattcgcataataatttattttctcacaggtttatgcacgtacacacataatagccatgacactgtaataacgaaggaacaggatcgagcgatgattaccttgttcgcatcgcggtggagagggctaaggtggaggcgcaaaggagagcagatggcacgagggagtcggcggcggcgtcgcggtatagaagggggcgcgtgggcgagcagtcccggtggcggcgcgaggggccggggatcaacagcgcgtgacaacgatctgcattgtgtgggggctttggcggtgtcaatctggaggcgggaatcgacgacgatcgtcgtgaggggcgctggtggtgtcatctggaggcgggaatcgacgtgctggttggggcgtcggcgacatcgatatggaggcgggattcggtgacgattggcgtgagggtcaaggtggagagacgggaatcgccggtggcgtcgatgtgaaggcgtgatggggcatcaatggcatcgatctgaaggcgggagtcgacggcggctcgatggcgggacgtgggcggcgtcggcgcgattgcggcgcgtcggaatcgacggcggcatcggcggcggcgctgcggttggcgtggggagagagagagagagaggaggttgtgcgagagtggagggggagagggaaatgcgtgcgggagattagtgtgaggttgcggggagatacgtgggaggagctgagccattggattcgatgattctcggtcgttggatttgatgaatgagtacgtaggtgtaagagtgagttggtgaattatagggtagactagtaattggcccgtgctaacgctacggtagcatttagaaatgcaaaataaataattaaaagaatatatattttttgccaatcaagcattaaatgagacaagttaaaatttaaaaactgaatgacaaagcaagttattatattgttaatctttagccatgtgagtaaaatatcatgacctctatctttcgtaaaaatctaattggtaatgtacaacttcacaattaacacatagacataaaaaaagtccaaaccggatataatcatctaatgtttgatctatatatcgtttataatagtatgcattatctaatgtcggagtatttgatgtggtaaggtagtttatctcgtttacatgtccaaaccatccatcaccatctgctaaattcaagtttataatctatatctcatatgacttctttgatctggcatgaaaagaaaatgagaaaatgtttggaaatctaaattttactgagaaatagaactgaatttggcaattgggagaacacatagtaattcatgatgagtctgcttcatgaaatcaagctgaatactaaaagcactttattcaatcacccagatccaatcatttacttttcaatcaaccgccaaaaaggtcacatacaagtatacaattgcttcatatggcatgactacattattcatgaacgtcacgatacaaggaaaacgtctatcaccttgcggagcggatggccggtggggacaagggaggaagctgtcgatggtcttgacagcccacaccaaaaaggcaccgatggtgctgcataaatcaaaacattacatgttatctccacaatttacaataagtaataacatagctttcttagatacatatgctaaacttggaaacaacatagctgcataacatttttaaacttgtttgtacatgaaaaatgtcaatgcttgttctgtgcaattttcatattataccagtgcattttgaaatgcaagccatcacccaaaagactccatttcagtggcaaactgtcaatgactatacctcaatctatcacgtattaatctggtacttacatgacacacctaagaagacaaaattgaaggtgcgaagagatcagatcgtatacctcaaaatcaaaattttagtcctcaatttgccacgagcaggttatttactgaatttgcccacagccccacatagttcacactggatgcctgtttgaattagcatgctcagtcctagtccacttgtgctccttcatattcagttttatgtaaatttgtacacaccagtcagactcactttgaagcagccaaataaattaacatttcagctaatactgagaagtaaaatgaaaataaaaataacttcctatatgtggaatatggacaaaccctctattatctataactatacagattaaccatagagatgataagaatatgttctcctgatctataaaaaagatatcgtgattaactcataatcatataagatgactctggtgagtgatgtcatacatagaaaaacaaactcactctagggtgtcattcccctactttagaaaaaaatcattgtctccaaaaaaattgtgttagttaaatttatggtttttaacaaatcagcattgaacagtacaattaacagcaattggcatcggttgggcaaatagcaaaacggaaaaaacagcactgacaagttcaaattttatctccagctcttactcacaaaacatcaacggcctgcaacaagcagtcacataagctgaattagttcttgtttccctttctattttaaagttctttgttcaagggatttagtcacaacctcgaaaaatgctattttcatgctccatttgtttttattatatgatatgttggttggttcaaattgaactaacaataattccattactgttaattacaaagaagggagtatataagatataacagaaatgtcataacaaataattaattatcacagactcaatagtgaatctgcatatgtgataacactttgaggccaccaatagtgaatctgcatatgtgataacaatttgaggccaccaaagaatgtagaaccagatgcagactacaaactcgatttcaagtatcattgactgttagaaaccaccaatagtgaaatagaaccggatgcagactttattaattgaaattcagatgatatgaaacaaaaatattccagatgatgatatgagccatgcagacttatttatcctaagcagcaactaaggatacacaggcacagccaccagaaacaatttctattttgaaagctagatccacatatcttccttgaaatacccaatagaagagttggcttcattaggtgctaaaaattataaggtggcttgaaaagaaacacaatcaacagagatagattgaatttgttctctttgaagcaactgcaggcataaacaataatactctacaaagtttcattgggtctaaactactctttgcacgtcatatatatgcccaaaattttttagcaccatacaaggagttcataactcatgcctaaatctgacaaatttgtcaaacaacacaaagtcaaattataatgcagttgtctagaataatgggattaggtgatagcaagttgtctggaagcatatgggcccctatgctgcgtgcagaaagcatccgacccaacggtgcgatgcagaatgcggctgctcccatagtcattagtgtaacataatgatcaaaattagaattaatagcacaagcagcaactgtgaacattctgcccttacctaactgctcgcaaaaaggccatcttgcataaatgcagggagcttcctcagttgatccgacatcaaggcaagcaatggactcagcaccagcatatgtctagataaaatcattgcaggcacctgaaacagaacattaacttttcagcactaaattatataacctcaacatctcgatttttgcagcacatctgatagcagaaatttttgttgatgtcaatataatgaacatgctttgttgttcaaagggcataaaaaattttcagcgccaaatcctataagtgtttctgttgtcagcacgccgcttgacaggacaggacgccgccgccacgggagacgaccgccaggacaccgccgacgtgggggcatcagcacacaccgtcgcctgccgcctggggagggatgccgccggagatggggtccggctgatatgggcagcagcagcaagccgtgggagaaggggagagagacgaagaagacgaagaaaatcgtgggcgaaggagaatatcgctgcctccgcgtgcgacgggaagacgacggaggacgggctcgcccttaacgggcagtctcccgtcgatgtgggcggcacgacgagcggagggtggcgtagtggatggcagtgtggtggagagccgtagggtggcggcgaggacgacggcgcggtggagaggcagggagcgacggcgctcgcagaggagaccggtgcggtggagaggcgaggggcggcggcgcggtgtggggagattagggttgcgatttcgtgacgacgacaatttgtgagcgccggcagcaaatcgtgggcggcggcgcagaggagatcggcgaggcggcgctgatctggatgctggtgcaagcgcggcggtccgcggttctttcccgtcgatccgacggcggcgcaggtggagctgctgcggggtttgggattggggggcggcgcgacgcggggagagcgagggtgcggcgatgatggtgcgcggtgggagctgagggaggtatggttcgtcggatctgaagcggtggatgatttttgtccgttggatttgatgaatgaagcacgaaggatgtaaacatcagttggtgaattatagggtagatagattgtggtcttgtggagttgcactgtgaaacttgtgggtggctaatagtgttcttagtctaggtggcatggaaggaacactaaaggaaaaagtacaccgaaggtccctcaacttatcatcgagatacaaaatcgtccttgaaccacaaaaccggatacaatgtattcccaacttacaaaaccagtgcaaactagatcccttggcggttttgacccgattttgatcgacttagcagctgactcagcgtgggacccacgtagaccccacatgtcagtatgtccacgtcatcacccatctcttttccttcttctcttcgttccttctctctcttctctccctgcgacaatgacgggcgcagccttgcggcggcggcatgaccctgtggtgggccggcgagggataggcggcggcggcggtgctgctctgcgatggccggcgggcttgcacgccatcgacgctgtctctccctggtccccttttttttcttttattctttgctcggtttctctcccccgatgccgccgctttccatggcagcttgcgtggaggttcgtgcaggcgcggcctggcttatggcgcggcggctggatgtggccggatgcgaccggaggccaggacgacaccgcccgcagccatcaagcccctacccgccgcacatctctcccaccggtcgagctcgccgccgccgtctgcgccctgcatgtcgagctgctcatcgtcactgtctcaatgccgcgcgaacgacgactaccaggggctccgcggccgcgcgcacgatgatgatgtgggtctcctgctctaggaccgccgcggccgtgtggcgggtggtcctgacgagtaagaacatccgcgccggcgagcggccgctgttcccattccagtcgcccaagtacctgaccagcctgaccaggcggtggtggcacggcgcagcggtcggcgttccacactatctgccgcgtgcttcactacttgaagcgcttcctggtaatgaacccggagcagccggactcggctagaccggcggtggactacctcgacatggatgcgcagctgctggggaggttcccagagtgggaggggaacggtgtcgccgacgtgccattcgagatgtacgcgtacagggtgatggagagggacaagagcaacgcgtgtagggacaggagctctgactccggcagcgacgacaactcattgtgtggagatgacagcgtcagcggcgggtccagcacgacgacgacggtgacgaacgcgtcggcgtcggcgtcgagccggccaatacttgaccggagaggtagcacgaggtcgtcagcgccgcggcgcaaggtggccatcgccgccaccaaggcaggcaagtgtcgcagcggtattgttactcgtctaaagccttccaagattacagctagcgctccatgtccatgacgtgtgcatggccaccgcagaagtcgagatcgataggcactgtgaggccgccgtcgccacgcactcgaccgcctttgctccgcttcgccggccgccccgcactcgacgtcttgctccgttccgctggccgcagccgccgccttgcttccctgcccagagagccctagagagaagagtaagagagagatgaggaagggagagagaggaggatgacgtggatacgctgacatgtggggtccacgtgggtcccatgctgactcagtcgccatgtaggctaaaaccggggtcaaaaccgccgagggatattttatgaccggttttgattagttaagggatgcgggatatatggttttacggtttgaggacgattctgtatctcgatgacaagttgagagaccttgggtgtactttttccaacactaaattatggtgtcacactgggctgtcgtgtgggctagatttgggaaagcatatcgtatccaccaagaagaggaaacaaacggcggcgacggcgagatccgagctggagtaacagaaaggaaaaagaaaaaaaaatccacggccgtcacggcgcgtatcccgaagcggcgtatcccctcacctcacccgtcgcctcgtcgtcctcctcctacctcacctgccttccttgccactacccactactatccccacccgtgtcccgcgcgccacgccacgccacgcgcccacgcctcgcctcgcctcctccccccaccccccgaccaaccaccaccgcctgagccgccgccgccgccgcccgaggcgcgacggaattcccccccgttcaattggacgcgtcgcggtcgcgatccgccgatcgatcccgcagccactgctgccatgggcgagcccgtggtccccccgcgcgcccccgcggcccacgccgcggtcgcggcgccgaagccgccgggagatcggtgccggcggagggcgaggctagggcgccgccgcggccgccgcctgcagtgncggcgggtgcgggggcgggggcgagcgggggagggaggcgggtgttctccgtggagctacggcccggggagaccaccattgtgtcgtggaggaagatgctcaaggaggctgacctcggagctgccttgccgcccccgccgccggcggcggcggcacagccggcggtcgcccccctccctggaccatctggtgcggtagggtttcgtgctctcgttacatgtttttttgccgatttctgtcttccgtgcctattctgcgtgcaatttttcacctgatcaagcctgaaaaccgcgggggattttgtgtgggagttgggaggtctgattatgattcttcaattagctaaatacgattttcaattatctatcatggtgaggccaaatgcagagccgagcataagttcgcaacagagaaaccgagaagtgacagcaaaagttattgagatttaacttaaaggaaagcatccattagctgttgccgccgcgagcacctttgcaaattggagggtgaaaagaatatgctcctctgcttcttttctatagcatcaaaatatatcatttctcaatgccagattgcccctcaccatgtctgcggtcaccagctttaccttgatgttgggatttcccactaggtaactaggctgccccgatttagcatctgcgtgtcttctaacatctgcatttggtagtgtggtacatggatcagtttaatagtggaaattgcaacgtcaatcgctcattttttcagccttgatggataacagttactgtattatttattgatcaatggtgattatcatgtcattggggaagaaggtcaagttatgaagacttgtttctcaaaaacgataagatctcaagacttgctacttatgtgaccatatgtaagaactacaaatgccatgcaaactttgttaagcttttattctgttggtagaatcaatatagcaggtccgttttgatgacaaaccagaattatggaaggggtttacgcatacactagaagtatgtgcattgtcttgcaatgatgcaacaatgatatattaattcctcgaaattgtctggtaagatgattaatgtaaactggaatactatacaagcaagatgtgtcatttgtaggcaataattcctatattttgttggaacttgtatcagacattctgataggtggtggttgtgcttactcatttgcaggtggtcattacccttacccatttgttgaattaaatcagcctaacttgtggttgtcttcacatatgattgcacagatcaactagttttttttattgaaattgaaataatgtactgtatttgaaataatggccattccatcttttgaatcagacacatcctacagaaaatgactgcgcacaatcaaatcggttcaattcagttattgagaaaattgagcgcctttacatggtaagaaacatatggtgttactatcagagaggaaattcatttttactttccattatgcacacgaaaagtgcttacctctgtctacatccttttactatgccagggcaaaaatagtagtgatgaggaagacttggatgatgcgcctgatgatgatcagtatgacacagaagattcgtttattgatgatgatgaattggttagcttttcaatttaattgatataataatgctctaatgtattgttaataaaatgttctttttcattggctcatctgacctaaacagtgttaatactgacattgtagtgctttgagttaagcttgttactatttgttttgccatgcattctgcatatgtgctactatcctgttatatgtatcataaataacagccttgacttcttggctaccattccatatgccaaatttgaagaacagctgagaatggcatgctcttataatctttcttttttcattgagctatttttctagtgttaggaagaatgagggtttattatcttgaattcaatatggtacttcactcaagttgcaacaagaaaaactgctactttgtgcaaaaccagaatgatctatatggctggaagaacttaactaccgacactaatttatatgcaaaccaaatgtgagcttacatgcttcttgctgcatatatctagccttgtttagaacatctcaatgattctttttctgtatcattaccatttgacatgctgagaatgatagccagtgttctgatcactctgttgttttttatccacaggatgaatattttgaagttgacaattttgcaaccaagcacaatggttattttgtgaacaaaggaaaattggaacaaatgtaattttcctaaaaactctttaatttgcagctatggtgttgggcaagttatgcataaaataatcccaccaaatgattctagaaggcattgtgcggtgtcatgactagctattcagaatgatatcatgtgggatgttataacataataacagtaatctttgcatcagtgccaacatgcattacatatctgctgttataggatgacataaatcttgacatgcttccacccacttttgcagtgactttgattcagtacagactgttgaaccaaagaaacgaagacgaaaagactcatcaagttcttatattgagaataacaaggaattttctccaggctcttcctcatacatgggcacgcctttaagagactctaaaagaagcactctccaaacggggaagagtactagtaatggtcacaaatctggagctaatggaacatttgagtacccttattcagcataccgagacaaggatgctccaggacatcttggcctccaacagaaaataacttctaatggggcgaaccaagatttgtcaaagaacatgcaccacaaagagaaatataatgctggtcaattttctggtttgcatgcttccagtaacatctattcaacagaaacaatggtaagaatcaaggaaactggtattgtgacttgtgagcatggtgcaaaccatagttatcttttcatccccaaagtacatagcactaatttattcagcacaaaagcattacaacataagacatggaagtaaacagag

SEQ ID NO: 75333 - DNA, 3553 bp, Oryza sativa
ttatccaaattcaaacagttcagaccccccacccccaccccacccccccgggcgggaatagttcagattcttacctgatttaaaaacctacaagcttcagcctaaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaaccatgttcctgaaggtaaccgagactatatatataagcggccactacagttctcagaagtatccagcattttgggctgtcctgatgatctgaaagagagctgcacaaagaaaagagtagaaaacacaatgacttggtaagatgttcataaagttatgatgaaaaagatggaaactactgccaaggctgtaatgaagactgaaatagttgcaggatttttcatgcaaggagttctattttaccaacattagactgtctgttccatttgaatccttaactagggtaacatcaaaccttcctcttctattttccaaagtcttaaggagaagcatatatttttttgagaagtttataagcatataaggatttattgcctggcaacagattagtagctgatgtccatgggtgtggtagctgcagcagttaacaaccatatctggagtaaaccatgagactatttttggaattaatcagagcaggaatctagcttcttattctttgaaaaggatttgactaatctaagatcaaaacaggaaacacatagatactttcccacaaagtgataacatcctaaagcaaaactaatgatgtgtactacagctacccccatacacgactactgataatagtactagattagcactttcgcaatttagcacagtttagtcctggagagagcacagaagcaatacccataaaaacaagaactaagggtgaaaatagttaaaatctatttaggttggtaaaggcattctgagttatgaagagtatgagtgaagataaatagctcaaccattcaccacaaatatataaaaaaagaatgtaacttacatgaaccaacaaccacaaagacgaaaaatccaagcacaatgggtccaacaggataatcatttcctttcttgactgtctcaggaacagaacccctcttggtgacgttcttctcaaaccgtgccactttcctatctgagagacgccttgaggtagtctgtttcatcatcagcaaataatatcagaagatatcataaaagaacttgtttgaagaaaggaaagaaatatgcagtgtatttggacagaatcccaaggaaatgacattcatgatgccagtaaattcatacagaaactttcatctattcaggaaaaaaaatgttactcaagatgcaaagcacaatggtgccatcaccagctaactgatgcctgctaccaaatatttctgacaacatgttgatctgtccgacttgcatgttaagggagtaatttttacattaccccctagaaccagtaagcagggtttgaaagttgatcataactaaatccatcgaaattataaaatcaagcgtattgggtgagttatatgtttttgtgcctttattatatgtattagatgatactcaatggcacgtgataatgctgacaagaaaattagaaatgctttactatatcataaaaatagtaatatcctctgctcgatttggtggaccctgattccaaactactctctctgtcccataaaaaaaccaacctagtactggatgtcatcctagtactacgaatctggacatacctctatccagattcatcgtactagaatatgtcacatccagtcctagattcgtttttttcgggacagagccacagagggagtaatccctaatcttcacatcttatcctggaacacattttcgaatcaaagcataggagtcgaaaacaataaaaccatacattaaaatatatgctaaattgaagttacgcaggatcggaagcgttgtagtgtgctagacgacaaatgcaaaattgcatgggtcaattaatactcttcgtcgacatttcaaatgcgttataaagtaatctatatactaccaaatatgatggctagcccacgtaaatgcataaccaggttttctaggtctttgataggccaatccagaatatgcggttacatgaagtgatgtaatgcaagacaactagtgaatgttcgctctcggatcaggaaaatcaatctctgcgtcactgttattctaaacctgacattagttagtcagcaacaaaacttgataaacttgttaccagatcctctaaatcttgccaaaggataatattgaagcatagcctaaaaataaacatatcttttgttacgaaatgaacggtttaaactacaggtaggcacgatcatcatagaagtacactacactatctacatacaggagaaatatgaattcaaaagcaaacagatgtgcacagccacggatcttcctgcgaagattcagaagaagaggaacagaaacaagtaaaccagaaatcaacatttcgtcggttctatttcacaaaatcatcgccaggacaggggcggatccaacttgggacacccaaacttttcggggaacaaacaaactgttacttgtattaaggttaaggcactgaaattaagggaagagcttcttccagatctagaagagaagctagggttaacgaacgaacacaagcaaattccagaaccgatgggagagagagatgaatcagaaaaaggatgtgatgctcaccatgatcctctcccctgctctgctcgccagatggagatcgccgccactcccctgttcagccgcgactcgtcttggcggcgcaaggaggaggagacgagaggttttctttctgttacgccacaaagggaaggggaagacactcggagaaaaggggaaatttaactatttgccacttttaggtttaccaattatccaaatacccctcttatatttgcccttattttcttgcccctcttagcttgtagcttcttaattacttatttgccacttttgcccatgtggcatgccaacgtggcagcgcggtgcaaaattcgccgtgggacccactagtcagtagcacaactctccccttaccctctctctccgatcagccccgccgtccccttcattgccggtgaccctctctttcctggcaggtggcagcgaatcctctcggtggtagcggcggcggcgcgccggctcgcagtggacggcggagtgcggcgaggcggaggttggattcacggcgacgctcggttcctcctccggtgcactggctcgcggtggatgacgaagccctctttctccggtcagcctcccttctctccggtcaaccccgccgtccgggctgcaggaat

SEQ ID NO: 75334 - DNA, 5198 bp, Oryza sativa
ggacgctgccatcgaaacggatcgacgcaacacagcctccctcgacagggagccatgggaggaggagagggaggccccggaggagaagccgagcgccgtcgcgagttcaacttctgccttgccgcactccgccgcaaccacgacctccagtcgggaatgaaggagaggacgatggggctgaccggagagaggggaaagggagagttgtgtgactgacgagtgggtcccacggcgatttttgcactacgctgccatgttggcataccacataggcaaaagtggcaaatagttaaaagggcacaaccttagaagggcaagaaaataagggcaaatataagaagggaatttggatatttggcaaacctaaaagtggcaaatagttaaatttcccacagatatggcatatcttcacgtatgcggattgttctcgtgtacgccgaaggaatttatttcgaattatggaaaatatctctacgagtcaagtgatttccaaagtcctgcttggtggggataaagtttatgttatatcgtacaagatccgatgtctctgagttttacttggagatcaagatgatccacggtattaaggggcccaaggaggggtgcaaggcatcaaaattcatcaccaacacacccaccatagtttacgaagccagagtactcggagctaggtcaccgggagatctcgtcgggaacatcgactacgatctcgtcagtatcgtcagtttcgactactttctttgtaatctgtggttttccatcatcaatcccatataaactggagtagggctattacctgataaggggcctgaaccagtataatccttgtcttctatttgcttgatgtcatattacgtaaatccttgttccaacgtatcccaatacccaaatcatccggtctacgagtaccactcattgacagtggcacgccaggtaggggaacttggtgctcaaggttctacaaatatgacttcaagccatcccgacaacagtaccaacaccggcgtcaatcaaggagcctctacctcgacatcgctggtttggactcaagtcgggactattgtctttccggtctacaccgtcatgccgatctcgacaagcccaatcactattgggaacgagaacggcacggctatgacttcgagaaatgacgcttcgctgacaattcctcccacgcaagtggagaatggaacatcgacggccttagtacctggaaggaatcctcaagcggccgagttctgtcctctgaacaagagaccagagccgacaaggatacccatccagaaaccgaggtcttggtgtcccgtccataagacatccaagcatactctggaagattgcctcgtgatacttcacgcaaaggctgaactctacgcctgctggaaacgtgggattcaacgcacttcaccaacgggcaccacttattgcccgattcatagatcgagatcccacgatctcacaagttgcataatcttccttaggacattcaagtcgtcgcatcctccatcccacaaccacgagatcaatctcagtgcgttgtcgaggaacgagacgcagcgactttagatcggttcgtaggctttatcggtgtcaaccctagcgagccatccatgctgcacctactgaaagattacgagtcttcttcagactcaccacgagacgtgaacgtgatcaatggtgtcgagacaagtgcttccgcggccgcgagaacacctccacaacaactgcggaacctcgacgcaatattaagagagagcccctttgaccctgtcctaaaccccgatgtcgatcagtgggcggcacgactacgagagactgtgaccaacctcaacagcgcattcgtggatgcagcagtcgagcctccaccccaagatccaccgggagggaacggtgaaccagctaacgggaacgcggaagcgcaaaaccctactagggaaccaccggctcgagacccgactccatcgcgtcgtgaaaatcgtgaccttcatgaacatctagatgaccggcggagggacaggcgagattggaatgacaatgatcgtcatcagcatcgctctccctccagacgaggagagaacatcgctcacgtcaacaccgtcaccgttccctttcacgccgaggtgggaacgcggatcgaggaggccatcccaacggtgaccgagatcggcaggcccgtagcgaccaccaagacaatggagataacaattgagaacggaggcgaggcagcaacaacggacgagaacgtagctcccggtctcccgcctctaggcgagatcgaagacgtgaccaccgttcgagaagctgggctcctaaccctagtggaccaccgttcgagaagctgggctcctaaccctagtgatccctcgtcttcgtcttggtcatcttcttcatcggacaagcctcctcgacgacatcacaaccgcgggccacctttcgcccaaggaggcgtgtgcagagcgtttgcgcgcacattgcgagatgtgcgatggcccgaaaagttccggacaggggcgatcgagaagtatgacggaagcacagacatagaagaatttctgcaagtctactccacaattctctacgctgctagtgcatacgacaatgcgctggcaaactatttaccagacgcgttgaaagattccgctcgttcatgactggttcacctcccaccctactcaatctcttcatgggaagacttgtggtaacagtttgttgtcaacttccagggaacatacaagtgtcacgcgattgaggacgaccttcatgccctaactcaaaacccagatgaatcatagagggactatattcggcacttcaatgagtgcaggaatacgatccccgagatcactgacgcttctgtcatccgcacattcaagtcaggcgtccgagattgatacaccaaccaggaactggcaactcgaagaatcacatctgcttgcaaactatttgagatcattgacagatgcgctcatgcagatgacgccttgagatgaaaggaaggaaagagcagtgtaggtgaggagaagaagtcagccaacaaagacgcgccggaatcaagcaagaaaagaagtcgtaaaagtgggaagcgcaaaccctcgggagaggtcctcgccgctaagcaaacggacccacccaagcgctcgaacccccaaaacgacgactcgaagaagtaatggtgccctatacacaagactaacaatcactccatggaggattgttatgtcttcaaaaaggagctcgcgcgacaactagcactctagagagggaagcgagtacgtgttgtcgaaacggccgaagaggcggccactcccgactccaactccgcgttcccagagtacgacctccatgtcttgcacatattcggcggttctacatcgtacacctcaaaaagggagtacaaaaagatagaacacgaagtctgctccacgtcgcaggggcctaccgctaagatgagatggtcccaacacaagatcgagttctcggagacggaccacccgaagatcgcgaccacacctggtagatatctgatcgtgatcgaacccactattcggaatgtcaaggtagcacgggctctcatcgatggcagaagttccattaatctactcttcgccagcaccttagatgccatggggataccgcgaagcgagctgacgcccacagatcagcccttccatgaaatcactccagaatcatcatctaagccgctgggtaagattacattgcccgtcaccttcggacaagccgacaacttccgaacagagcagatcacctttaatgtcgcagagttcgataccacttacaataccatcattggaagaactgcactcgcgaagttcatggcagcatcccactacacttaccaagttctcaaaatgccaggaccaaaagggacaattactatccagggaaacgccaagttagcggtgcagtgcaacaagcggagcctcgacatggtcgagcatactcccaacccgcccgccacaattgagcaccccaagaaagtgagcaagcccaacaagaaaccgaagttagacggcgccatcaagattattccgttgtccaactccaaccccgacaagaccatcaagatcggggcaaagctggatgacaaataggaactcgcgttcatcaccttcctccgcaacaatgcaaacgtgttcgcttggcaactgtaacgccccgattttcgttcgggaataaaaatcaattaataatacattttctagaaattaaataaaatttaaatcaacttaatcaagtgaattattgagggaattaaaaatttcctttaaaaatcattggccgagaatattttgtaatattctttgtgccctaaaatactctccggatttttccgcaaattttcgaagctcaagaaataattttaaagtcacaaagatcatttaaccaattaaataaaaagaaaacaaataaaaatctccttccttcccttttgggcttggcccaagccttcccctcctctcccgcgggccgcgcgcctcctctctctctcggccggcccgcgccttgcgaaagtctgctttacgtcccccggtttccctcctctctctccatccggccgacaggtgggaccgtgggccccacctgtcagctcctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccggccgagccaccaccaccccccgtcggcgccccactttcccgccggttgccgcccctctcggccccgtttccgccgctccgaccctataaaaacgaacccggagcatcctctctcttttcccctcctcacccgagccagccgcgctctctctccccctccccacgccgctcccgcgcaccgccgctttccggcgagctccggccgcccgccaccgctgctccacccaccgccgcgccaatccgccaccaccgtcggcttcgcggcaccgtgccgcagcccggcctctactccatttcccctctccgcctccagaacaccgccgcctcgtgcaccaccacctaccgcctccggccgcctctagccgccatcctcaaccacctcaagccgcgccactgcctcggttagatccaccaccgcaagggcaagcccgg

SEQ ID NO: 75335 - DNA, 11135 bp, Oryza sativa
cccggccgccgccgccgccagccttgtgtgcgcgctggccaggccgcgccgcccggccgtccccagccgtccaatcggccttggccgatctaaaccgtcgggtgcgcggccgcgtggccgatcgccaccgtggactcggtccacggtgggccgtgccgctgacgtgtggggcctgccccctttgtggacgtggtccgcgcctcaccccttgctgacgtcagcgaggaccatttcctttgtaaaaataaataataattgcgcaataaatcgagtttaattctagaaattcatttaaatggcttaaaacttctaaaattcatacctaattcattcgaactccgaattgagccattcaacttgcaaaattcatctaaaattgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccattcttcagggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggtctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagtttaggtgggttggttgggcctgttcaacgtggtgtagcgttgatcagtggagatttaaggttactttaattactcaacagttttactgtgttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcatttttttttcgctgctgctgcttttgtttcggtgtgaggactaagtgcctcttctgtaagtattttacgcttattttacgtttggaactgtatattacttgtcgttttgtgtaccctggctggtcctggacagggatttaatacgcaaaatagtctggaaatttgggtgaaatttctgggcgtgacagcagccgtcagacatgtcgggagttcccagggaggcgattgagcacaaactgatggtgcaacccgacgccaagccagttaagcaaaaactatggagatttgcacctgatcgaacacaagtcatacgaattcgacaaacttctcaaaattggcttcatcaaagaagccctccatccagagtggctcgctaatccagtaatgatacatgaagccaacgggaagtggaggatgtgtgtcgacttcaccgacctcaataaggcatgccccaaggaccatttccctctccctcgaatagatcaactggtggattcaacagccggctgctagttcttaagctttctcgatgcttactccggctaccaccagatcaacatggcaaaagaggatgtggagaagacagcgttcgtcacgtccttcggtgtattctgctacaccaagatgccgtttggattaataagcgcaggcaacacatatcagtgcgggatccagggagcactaggtgatcagctcggacgaaacgccgaagcttacgtggacgacatcgtcgtcaaaaccaagacgggcgactcattgatcgacgacctaaggaaaacgttcgacaacctccgacgatatcaaacgaagctcaacccggagaagtgtacgttcagagtaccgttagggaaactactcggcttcctggtctccgggcggggaatcgaggccaaccctgagaagttcaaggcaatcgagaacatgaagtcgcccacaagactcaaggaggtccaacgattgacaggatgcatggcttcgttaagtcgtttcatccgcagggatgggagacgaggacaagctttcttcccctgctcaagagcaggacaaattcgagtggacccaaggagctgagagcgcgttgattgcgctcaaacgctacttgtcaaaccccccggactagttgccccacaaaataatgaagaattattcatttatattactgccacaccttattctatgagtacgtttatcgttgtagagagggaaagagtacaatacccagtgtctatgtcagcaaggccctccacgatgcaaaaactaaatatccacagatccaaaaactattctacgctgtgatcatgacatccagaaagctacaccacaacttccaagcccataaggtcatagtgatctcctcctcccctttgggagaagtcatcaggaataaagatgtcgtcggccgtattgctaaatgggtagtcaagctaagccattgaaatagggtggtccaaattgaaatgtaaagttagttgttctgtaaatgaaaagaatggttaaaggatgacataatatgaaaacttttaagaatacatagtacgaactgtaatttacttttttggtttagcacaattaaagatgagttgtctattacctggtactcttgtgatatactaagtcattagtacaattaaagatgagttgtccattactcaatagtcttgtgatatattaagtattgttgggtcagtgtacttggctattactaatagtctcatgatatgttgatgcatgaagatgcatacttctactaacacgagataattaattatggttatatagattcagctaaaaaaagataaaattaatgccatcaatttttctcaacaataaagcattcgactgtggtctccttttctcactgcatgatatacgattgtaggtattaccgtaattctttcatattatttttttctacatatacgttaatttggactaatattttttctcataattaaatatttaataaatcatttttcatatttctactataaaatgtgaagagggcattgtataatttgaaaattatattataagtgtatgtaatttaatgtgtaagatatgaacttatagtataagatttaactttttataaaaatgctgcatgatagtagataggtaatgaactaaacaaccataaaatatatagtgaatccattgtgtgttattgattttgtccttattctacaatatgtcactaggtttgtcaagttctaatatgccatcgcattttgcttaacttctataacataccatcgtcgtctagttagcttctgttagtattgtataattttatcataatgaccgaaatagccatgggacgaaaaatttcaaatatctcattgtaaacttccaaagtttgagatggatatcttctctgccttgtttataatattatattttggaatattctgtcaaattttggaatttctgtcccggggatatttcggtcattagaacaaaattatacagtactaacgaagtctaaatggacggcgacggtatattacagaggataagcaaaatacgatagcatattgtataacttaacaaactcagtgccatattatagaacagggacaaagtcagcggcacacagtggattctcttaaaaaataatctagtcaaaaaagtttctttattttattcaaaacaaaacattttttctaccaaacacgttaggagaacttcgaaagaagataagaaaaaaaaggaggtttagtcattagctcaaacacacgtggggaaaagctactcacatccatggtatggtatatactcacattaatcgataatatactaatattattaaaattattcttcgtcttaatacggtgtaaaactaaaactttaaccttatattcttctgttattccatcttcttctcgctttctcattcttatttatttttgataataatattgctacaatcaacactagtacttgcacatgaatactagcagctaactcatatgtgtgtgctccgtaatatatattatctatgtttttacatgagtaaacaacaattattatatttcttaatgatattgtaattatataaggtacctaactagttttctaagaactggaaagatatttttgttaaacataatctagaatgctataaagattaataatattgaacgatatataaccatataatttttttataaatgaattagagatcgactcttgttaagaatccaatgatcataatgcactatatatattgtttaagtgagttatgatattctatttaggatgtgtttgacaaatgggttatgagaggtgggattgagaaagggaaatggatgaatgattaggattaaatgaggtgtgatgaatggatagttaggatacaatactaccctttggagggtggaatattatttccctatcctatttgcaaacaaagccttactagttacatgtgtatgcattaaagtgggatctagagataaaaatcagacactgctcgcccaagaagcacgaatgcacgatataaataaaccctctaatcaccggatcaactaacacgaaaaatgatatatataaatcctctaatcaccagatcaactaacacgaaaaaacacggccctcactggcgtcgccgcgaattggggagatgacgaaatggtgtgaatgcgaagtggggtggtcgaaaccggtccgcctttatttgggttcatggagagagacccaagcaagcggcgagctcctctcgtgcttcccgtgtgctatctggctggctgcacagtggttcgtccgagcggtgagccggtgacgcgcttcggtgcttgcttctgagcttttgtgaatcgtgactttgtggctgatagataatgccataatggcacgccatggtagctttattgccattgctaacttcttgctttggctgctatgtaggcaaggcgtaaacaatttctgtaatgaagaatagtcaaaataatcaattgtgataaaatatcccgatgtaatttattatatgaaacattgtgaaaccctaacgattaaattgctattattatttacattcattttcgtggtgatttttggtgagggagattgaatgtgactatgttgaccatagggagagacgtaagcaagcttaaagcaaccagggcttttgcctacataatcacaattaggtccttttaaatcactattgaaagtttttttttgaaaaaaaagaacttaaaatctagtagttgagccctatgtgagttctaggttttggtaatttctgactccctctctgagcagcaataggttcttagtccgataacatgttttttagggtttgcatgggttagttaaaaatatatgtagactgatggatatactgccaagaaaggggagacaataaatgtaccttttttttattgttttcacaaatggcattagctttgttggatacttttattctctcgccggctcccgcgtcatgtaattgagtggtagaatccatcgttgtagtggtaagtagtcaggcataatctacttttggcatgaaatgtggttgtgagtattttacttactccatttcaaaatgactaaagttttaatattaggagaaaaagggaaataatctaaatacccctcattaaatgagaggtggttgggggtaaagcatgaagaaatttaaacgagggtggttggagaggaagatattactttcaaattacacttatttaagacaatttcaatgataaatttctaggccagaataatataatagccattaggttttgtgaggtgctatgtgtttctttttctaagtgaaaatataatattgcataaaaaggtacatcaaaggggaaaaaaggccaacgaaccaaactagcatggcatcattataatcaacaaagacacccaaattgcatacaaaagtacccataatcatcagctgcttcttatgttgacatcacagaaaacaaaatggataggatgtgcagatgcaatgcaccacactggcctacaccaaaagtctctagacatgcaaacactgatcaatggagtagtatcaacttagagcaggtataatagtaggtggtaagactttaaatattatatctgtgctgacatggaagggagaaaaggttaggaaacgcaaaggcgagcgcttcagttagcgctagctctagcacagcctccaacgcaaagtggtggggcccataagtgggagggcatggccagccaattggatggagctaagccgagtgatacgtaaagttagttgaataaaatattaaaagtaactatgactagcttaagtagtatttcttctttttatttacttttgctgaggtggattattttgcagcggctgcgctattaaccttgctcttattagtatgtcataatgaatggccacatgggtacatggcaccagtcaccctcttgtcaacagtccaaatgtccaatctctcgagtcttgagaacgacctttcactcggttcgtcatttttttttcactaacaccttgctcgttgaaaaatatacccttattaattccattattattagggagtactggagaaatctaagagattgttcaaataagcataacattaaacgctattccttctcaaggatactattaaatccccactaataaaaagatatttggccccttactcaaatcccatctaaacaatcactgaggtggcattaattaatgtgtagggttagatcaatggcaagatgaagggtgaggatagagaagcagagcaggattttgggttcggatttacccaaccctcttatccggttcgatcatgtgtttcttataagttatatgtaacatgtgtccataaactaatatatatcactcgagtgatttttaaagtaaaaaagtccatgaatataattataacgcctatattttttttacatggtcttcaataacatagtttgactagtattttatttcattctataatctcaacaaatataaaattagcatcacatgaaagtaattcaaaatatgaatctagtaatataacatgcataatacttagtatagatatagttaggccctgtttaaatcccaccccaaaatttttcaccatgtcacatcgaacgtttgaacacctgcatgaagtattaaataactgtcgacgttggatgtcgcgattccggtatttgcatagtatggggatcgttggtactaggatatacgcgagacttaggtaaaagagacggaggagaggatttttatacaggttcgggcccctgaattgtcaggtaatagccctacatcctgttggccgaaaccggtcgttgctcttattcaccataatcacaccagtacaatatttggggtagcctatctatctgttgtcgacttggcggtctgaagtgctgactcgtagtcgacaacagggtagtcttcctcctcgaatctgtgcccgacgaggtcagagatagcgctagattcctctctttggttcccgtaggtaccatattgggttttcccaggcttatctctgatgtcgatatctggcagtttgtcttggcgtatgtaggcttgtattggcctgtggctttgtggcgtctatgttgtctgtgtccctctcctcctaggcggtcttgtatttatacccataggtgtccccttgtccaagtagaactaggaaaatcagtatggatacaatccgagtagtccttgtcgttttcatatagaactctagttatctttccttatccggaactccccctatatccgaaggttgtttccgtataagacatggtatgtggtgggtcctgccgagatttagtcaactactattaggtatgtggtatccataaccctgacaataactaattacacatataggctaaaaaaataactaattacacatattgcgactaatttgcgagacgaattttttaaacctaattgattcatgatttgacaatgtagtgctatagtaaacatttgctaatgacggattaattaggcgtaataaattcgtttcgcagtttacatacggattctgtaatttgtttcattattatactacgtttaatatttcaaatgtgtgtccgtatattcaatgtgacacaccaaaattttacagccctaaatctaaataccctttagtatgattattactcaaaagctaccaagtttattttttaaaaaaaaacagggcgccctataattttgggcggcgggagtagtaaaagctatttttttttacactcaaaccagtccgtgtatgtgcgcgtagctcgcctgtctcaacgtaattaagtgaacgataaatcaaataaggcaaaatcttccaaggtcaaaatggaggaacccactatccccagattaccacgggccaaaattcggcccaacctgtgatgaagcggcccagcccaagtcggctaaacccctctcctcttctcgtgccctgcctgattccgctgcctccaccgctccacgtatccccgaaagattctcctcctcgtcctcatccatcccccaccgccgccgcggataaaaatccaaggaatcgaaggccccaacgtgtagtactacgcctacgcgccccctcccatggcgccgcctccgccgctcgccgcgctccgccccgcgccattccctctccctcgcctcctcccctgccccgcctccgccgccgcccgccgcggcgccgtcgccttctcgctgcagaccaacgtgcggctcctcaagcccaaccgccgctcccggcgatcccggtacccctactacgaccacgacgaggacgaggacgacgatgaggcggagttcgagtttgaggaaggggaggaggaggaggaagacggctacgagaccgatgtaagttccctcgtttggcagtagccgcttctagctttgctactgtcgtgagaggttgcctgagtggctgggtccttagctaaaattgcttgcgtactcaagctcgtgccatgggataagtgcaaggctgtgctatcacatgatatcatcatccaattgctgctcattatgtaattagagctccggaaggaatatcattcaactgctgctcattatgtaactagagctccggtattccttttgttttggagtacattagagatgtgataccattttattgcgtcaggctagagagtttcagaaattgaactaaccaacatctcattaggttgtaggatgtaatgttgtatgcacattgagttaaagaggcataagtttgtcaaaggaatcaacaaacattgtaggatgtaatgttgtatgcacattgagttaaaagaggcataagtttgtgaagagcgcactagtggtaaatcatcgttcctgtatttaatggtataacaccttaaccgctcatatgataaactgttttaaaagttttctgcctggctgccacagttaaacaattcttatttatatggtttatttgttccatgcatatttatgtgcttaaatactcaatggtatgctcttaaacttaggctagctgggtaacagtaggtagaggtgggcattagggtgagagactaatttgatttctgccttgggtaaaccatatccaacatacggggaccaatagaaacagcgaaactcgcttttctgctgattagtgaagacttaaaagagagagggagagagaatcagttatgtttcttctgccaccctgactatatgatctgttctgcattgagttttcaatatatagtatactgcatcactgggtgtttagtccacatgccaaaccaggcagaattgcagattattggattcaaaaggataaagttttgtgatgctaactttcattcatttctcatagaatgaaatatgagaaacttaccattggcaatattctacatttccagcattctaatatattctcttactcttttcaggatgatctatcaggtttggagtatcctggtgtactttattcaaacaatcctcgtgctccaatcaagaaaccaggtatgaaaggctgtgaaaatccctgatatccagtggttactttgtattaatactttattctccaggccgggaaaaaccagcgctgaaacaaaactgggaaggaagacaacctaaaacacgagacagatgtgacacttcaaaaaaagtcgatgctctgcatgccaagagtaaagctagcagatcaactggtcttgtggacatagataatgaagtagaggtagactactaaggttgattcagtgtgtccatgttcttgtttatgttcaatatttaacgtatgcaggataaatgattgatttattttcgcagttgaaaaatgaaagtatctctagaagcttgtttcagaaacttcaagaagaatatgactttgatgataaatggttaccactaatcgattacttgtgcacatttggactgaaggaatctcattttacaaacatgtatgagagacacatggcctgctttcaaatcag

SEQ ID NO: 75336 - DNA, 642 bp, Oryza sativa
tgaggatgcatctgaggatgatggtgtcaatgaatccgaggatgagtcaatggcatcagatgggatgcctgacatattcctattgcaacttatgacaaaaatgacccaccaatgatcgtaggcagcgtatatccaaacattaatgaatttagattggcaatagcacaacatgcaataaaaaaggagtttgaatataacatcatccgaagtgaaccagggcaatttactgcaagttgtgctgctaaaggctgcaaatggaggattcatgcatccgtggttgctgatggtgtcactatgatggtatgtttttaatttaaatcagcatgcattctttaagtatattgtcatatgcatggagcccatacttctatgagaaacatatggcagccatacaagaagttaaaccagaagcagtagcataccttaagaagtatcacaaaaggctatggagtaggagtcagttctgtacaatttgcaaggttgattatgtgacaaataaccttgcagaaagcttcaacaacttggtgaaagattggaaagcactacatttatatgacttcttggagaggattcggcggtggttgttggtgaaatgggataagaggcaaagaataggaaagaaattcgaaggctgcattctac

SEQ ID NO: 75337 - DNA, 9094 bp, Oryza sativa
acttccatgcatttcattttttttaaaaggatagtatcttttgttgcttttccaattctgggtcgtctattatctctgtctggaaatgatctttatttcttgaacattgaaaaaaaaatcataggatgttgtgatctaatcatccattgataaaggtagcctgtagattcattgagatatttaaacgagtgctagttaggtaacaagagatagacactctttttgtccagttctttatgcatcgttttcgtaggccttgggcaccagtacaaatattccactctttttatgtggtttcttgaactattcttatattctacaactaagtggattctagattcctgttggcatgctgaaatcttttttttttttttttttggaggggggggggtgttgcatctaaggatttgttcttgcctttgtttgtgttgacaggcatgggctttgttactctttagtaagcgtggtagaataaatatatgttgcatagtgatcctgtcaaatgaacatatattcaaaagacataccaagaggcaccggcaaaaagaatctccttgtgttgtatggtgacttggtgagttttaaagattttacttaccaaatgttttttggcacagagaaacatgaaagaaatggtgcaatcaggtttatgtgctaaacaagagaaggctgggaaattgcaacaagtgaaaatggaaatctatgaaatggtcaaagcacgtctagccaccaaacctaaggtgaaataattaccttgtcagtaaagtggtgtaatctgctttattttcagacacattgcgttttgttccagtcttcattcttatgaaaagctttggtagtaggaactcttatatctgtatgctttcagggtgctgaacataaggttgaatctatagatggctttcaggatcctgttactcatgatgacagaatggccttgagaggaaaatctgtcatggatgctgtattggaggacaggatctgcgacctgtatgatctgtatgttgaggtatagtcgtattatcatgtttacttcaatgataattgcaatgcatagccaattgcccaattgctgtgctgaaagaacgacatcagcaatagagacattttctctattttattttaccttttgtctatttttaagtgtatgttggtgaaaggatatttttttatttcccccttcaataaggaggccgctagagttggtttagaacaggagtgtcttggataaagtcttatcgttttgcttttttacttattttatatgtagtatcgcttggaagttcaaaaccatgtatttttacaaattgtgattatgcttactagcatgagtaatgcatgcttttcagggtatggatgaagataagggccctcagagtcgtaagttgtatctagaggtaccatcctgcctcttttaccacacctttttatttctgtgattgctaaaaaactcctctacatttatatgtgcctttagtctgattgagtgtttcaacttgaatcaatggattagaaaattccagccttccctttctgattcactacgcagtcacactccttagacagactgttgatcatgaactttattttccttaactcacttttatatttgtaaatttgtaatgccgacttgcttatgtatgttgggataaggggctaatttttgaccagcaaacgaattgcactggtatattgtgtcaaggatagcactttgttacttagtttaaagtgcctgtaagcaaagcaacataatttgagtttgtatgatcccttagcttgtttatatatccaactatccaagtttgctaaacagccttaagttccttaaatatttatttagctattcataattatcaaagtaaatgtataccctgttaatttctataatggatttgttttctttcagaaactttaaattttatcacccgagcatatgaatttggtattttggttgtgatcgttctctttgtgtaccgtactgtgctttcagtaaaagctgggtgaaagcctttcctctaaaattttttttgggtattttggtgatgttctgtttcaaagtgcattttttgtacaacttctccagttttcctagcgaatgtgattatacttgtccataacgctcatacaaattacaatatctttgtttctgcaccagcttgctaacttatggccacatggcgacatggataaagttggaattcgagatgccatttctagatctaaggagcgaaggaatttattatataggcagaggaaggtgaaagatcttctcttaaggcgtgaatgccattttagcttaaccatgtctttatttttaaccgtcataatcatatggagtgaaggaaaacaagtgtacaattcagtaatgtaaatttccaaattatcctattttatagtacctcattcaaaccaatcatgccattcaggtccgcaatgaccagaggatgaagaggagaaggctggctgctgctgccaagttgcgtgacagcgaccctgccgccccacaatctgcacagtccctgcaaaatatgacaagcacccataccatgtatcctgtggttaacaatggaaatagtcagagtagcagaagtgtcgacaaagttaatgaaatgagcgtcggtgcaggatcggatggcaacaggagttctaccagcatgaagaaacgaaaaatagactctgaagataggcaagttaacccaccgaaggctactgctgaacttcatcatcatggtattgaaatacagaagccggcaaagcgtgcagatgaggcaacaaaggtcagtaaccttccccagacgctgcttgccattccaagcagcgacagtcgccccagcagcagctaacgtcctgatcgtgctggcatagctttggagaacaaaataaatcatcggcaaaggtcgttgataaccaatatagtagaacacactagctaggtgattgctactgggatgctctcggagcctatttgttggcttctgagcaaccactaattcttgaagatcttgtttgatactaaaaataaggtgtatttataagaaccctctgtaacacaatgtctagccggtttcgtttttactgttgctgttatattctgcacttcactctgatagcctgcaacgtagataatttcatctttagattgccatttttcttcccctcttagactataaattgagaaaaacctagctctgtacaatctagatcgtcaatatatctcggaagcactttttaggtatggatatattcacagaataaagtgttgtgtgaatcattctgctgtcaaatctggtctcttgatttttctagaggcaagttatgcaatttatgtactacttccgttttttaatagacaccgttgactttttatcacatatttagacaatttatgtaattatattttctttttttagttgttttaaataagacgaatgatcaaacatgtgtttagaaaatcaacggcgtcgtctattaaaaaacgaagcgagtagtaacttttttgttagtgatatagcaatttttttccgttttataccccgtcctttctataaaaaacaactaagtacgaagtaccaattcgtagttggaatgtcctccatccgtctcatttttttatccaattttggtcgtttgtgttatttgaaattcttttatgattaatatttttattgttattagatgataaaacataaataatactttatgcgtggcttatgtttttattttttaaaaaaaaattaaataaaacggacgattaaagttggaaacagaaactcatggctgcgcttaaaatgagatagattgagtacgtaattcgcacggggcctttttcttggaataagttcatctgcggtcccttaactttacgtcgagttttgttgacgtcccttatctccaatattagaaatctccaccctaaactatacaaaaccgtacaatttcgatcccatggcagtatggatccttgatttcgctgatgtggcatcatagtcagaaaaaaagaaagtgcgtggggcccacatgtcgaagccctctcctcttttcttcccaagccggcgttggcacagcctctggcgctccctcggtgtagagcgccgcggccactggcgacttgcaatggagcatcagctttcggggaaattggggaggaggacagccatcgccgaagcgttcgtggccatacttcttctggggccattcccaacccaaccacaacgcggcaaagaggcagcctgtgggggaggcgaaggcatgagagggagggagaggaggccagcaagttcgggagggagggggaggcaattgttgagcccgtccgagctcacccagcctgcgtgcgccggaggtagacggcgaccaagaaaccatctcctcctttgccaattccccttctctcgctggtgatgccattcctagcatcgtcgaccacctgcggggcacagcggtggtggcggccgagaacgggggagctccctgtccatccactgtcttccactttgcctagctcgcgtcccgcctcgagccttcatagaggctgagacggacctcgacttcaggaggctcgttgatgaaggggaggaccacgatgaggacgtgctccagaagctcgtcccggacatccgctgtgatagctccccacgcccgtcatggcggtgcaagtgacagagttcttcggtcatcggtggaagctccggtggtggggacgttgcggttggggtggccgtgcaccacgccgcacctacagcagacagccgcggcttgtggcgattcttggagatgtggtctgccgccatgctcgcccccgctactaggcccgccgctgcgctcgcttgccgctgctccaccagctgttcgctctgcccgcagcccaccgccgctccgcccgccacccactgaccgctggcgtgctcgcctgccactggcctcccagtcccgccgactgcccgccggcttccctctttgaactctgaagaagagaagagatgaaagagaagaaaagagaagaaaaagagatgcgtggatcccactcttttcttatcacttatatgggtctcatatatattttttattttttattttgctgacttggatgccacgtcagcgaaaccagagatctatactgctatggacctaaattacacgattttgtataatttaggggtgaagatttatggacctagttagagattagggacctcaaagagactcgacgtagagtcgagggacagcttgtgaacttatttttttttttgctgcgcttggtgttctctcctctcgctaccatgttggcccacacatcacaagtcaacctcccttcctcggcccacttggcgagttgctccttcccgtgctccgccggccgtatagtcaaaaccaacgagtccccgacgccggcgagctccccggccgagcataagaggcggccatggcggcgggcaccgcatcgccaccgccggacgcggagcctcccgagtgcccggtgtgcctctcccccttcgacgccgcctccgccgcgccgcgggtcctcccgtgcggccactccctctgcggcccctgcatcgcctccctcccgccggcctccgcctccgcctccgcctccgccgcctcgctccgctgccctctctgctcccagtgcgtccctttctcccgcgctctcgggccctcctccctccccaaaaacctcgccctcatctccctcctcccctcgcccccaaacccctctcgttctcgcaccgccgccgcggcgccgccgcctcctcatgtcccgctccacgcggaccactcgcgtctcctctcccgcttccgccacgccgtcctcccggagtccgcttcgccgctccactcgcccgctcccgccgcgggcctcgccatcgggtccttcgcttccgacctcggcgccccgtggttctgcccgcgtggccaccccgtaagcctcctcccgatcgaaacccccgccgccgccgccaagcaggagtccccgttgtactaccggcccagccacgcggcgcgggtggccgccgcgatcgatgcgctgagcgccgcggcgagggatgaagtgatcgatttggtggccgtctcgtcgcggttggcgcggcgggtttgcagggtttacggcttctggatgggccccgaggcggctccgctgtggctgctctccgagcggcattcccgcggagtctcctgcttgttggaggagaggagccgacgagaggagacggtggctctgatcagaaatgtcggaatggaggtctgtgaagcgttcatgggattgcacggagaggggctggtactggggtgcatagggctaggatgcttctgcctcgatcgctttggacactgcctgctcgacctgaatcaggttttggccttgtgccacggggttcgggtaggggtttgctcatccaagtctaaggccttcatggctcctgaggtggcagaggtggtgcatgacaagttgcagataaaggatcatgatttcagtggcttgttagggcctagttcagatgcttggttgcttggttgtttattggtggcacttgtaactggggatgagcagcttgcagcaggatggagtactgaggggtcatacgatgattggaagaatgaagtgcttacgaaggttgatgcttcattggttggcacacatatggaaccatggtctgcaaccatagtgtcatgtttgaactatgatccagaaggccgtccagaaattgctgatgtctggaaatgtattaacggctcattgatgaattccgacattgaagctttgattcctaatgttgatcttgcagctcgaaagagttttatgtgtttgctccttggggagttgtcctcaatgtgctctaaccttggtgctgttgagtcagatgatacaatgcatctttctcaggatttggatgacaaacattcaactccagatgatgcaagcagtggtggtattataaacaacgaagaagttggtgcagctggaatggatgggccaaaatgtggactgtacaattcttcaactctgcttgctcaccgtgactgtattacgggattagccattggaggtataacatattggagtatttacaactttaattatttaaggcatatatagtgcaaaccagcaactaagttctacattgaaactattgatttggacaccattgctatctggatagttttaaaacgaaatattaatgtcatctacctagtgtttagatcctttgacaatttcatgttcaacattaatgtgtgttatgagatacatatgaacatgcaaaaaggagaagattttgaataactctgttttcgttttgtttcatttcattctagtttatcatttatcataggtttctcatgtcaaacttgtcaatgaaggtaacataaattataacttggaggtttttatgttaatttgatgttaagtaaatgttttgaaatcttgcaggtaaccgttagtttgcactagatttttgatttcattgttggcgtccttgctagagtatccgattctttcatctgtggtgttattctatggtcatgacacatcttattatgctagtggatatttttaatgttatgcacttaacaagaactgccactcaaggacttcccaataatagatcttcattgactgcaggaggctttttgtttagctcttcttacgacaagacaatcaatgtatggtcactgcaggtatcttctctcctcttctctttcttgtcagttctgttagtatcatttctatctcctctttagttttccgtggctcatttttctgacttctattggtccttgggttctttctacaggacttctctcataaacaaagtttgaagggccatgaacacaaaatcacagcaattgttgttgttgacaatgataatcagtcactttgtataagtggagacagtggtagtggaatatttgtctggtgtgttgatccttcactcagtaatgaaccattgaataagtggtatgaaagtaatgattggatttatcgaggtgttcactgtttggctgtttctggaactggttatctttacactggtagtagagacaaatctattaaggcttggtctctagaggtaaagatgctaatccaatttgctttattaattagcatacagggattataataatgttggtgtttggactaaaatttaacattagagtacagtttgccctggaagttgattccagaatgtttccctcctattatcttgataacaagtctgatttggtcattcatatggttaaggggttcatatccatttatcttaattttagcatgttatgtgaagttaattctctatccccctttttcaggattattcactacgctgcacaatgacaggtcacaaatcaactgtttcttgccttgcggttgcctgtggtattctttacagtggaagttgggatggttctattagatcatggtggctcactgatcacagcccgctgtctgtactggaagatggtacaccaggaagcattactcctgtgctgtcaatttcaacagaactcgattttgttgttgcatcatatgaaaatggctgtttgaaggtttccctatacctcaatcatgacttataatgtgaaatgtgtatattctggtcacgttgtgttataattttaattgcagtcaatgtggtttgtgcgtaagctaaatcatggcatttttatttttgtcaatcagatctggaaggatgatgtcctagtaaagtcagagaaacttcaaaacggtgctatatatgctgctaaattgaatgacaagtggctctatgctggtggatgggataaagttgtaaatattcaggtctgtttagttgctttgttcatatgaactataaaacataagcatgcattttctaaaacataagtgctctatatctaacatgtattgattaccttgcatttttcttgggttaattatgttaggagttattggaagatgattcagaggtggaaatcagagatgttgctacctttacttgtgattcaattataacttcaatactgtactgggatggaaggctgatagttggactttctaacagggagattaaggtatgtatacctctttttgtttgttgtctactttattagt

SEQ ID NO: 75338 - DNA, 26805 bp, Oryza sativa
atctagggagttaactttagtctctatatttaaataataattgagagtattaaatatagactacttacaaaactaattacataaatgaaagctaatttgcgagacaaaatttttaagcctaattaattcataattagagaatgtttactttagcatcacatacgctaatcatggattaattatgctcaatagatttgtcttgcgaattagtccaagattatagatgggttttattaatagtctacgtttaatatttataattagtgtccaaatatccaatgtgatagtgacttaaaagaagttttagtcccatctaaatagggtcttaagtaatacatatacacacgtaaaaccggcctgttcatcggagggcaatgccaaaacatagctgaaatgctgatcatagctcgctaacatgggacaagacaaacgggaaaaagaagaagccaaaaaggtcgcctctgctgctagttctactcatgttacttctaattgtgtgtactctatgtgtgctagggcccttgatttgaaataatcttaaaccatggccagagaatgtgcgcacgatcgatcacatgctaaagcagaaagcactgccttatctcaagattaaagctgcccaaataaacaacaaattaatcaaataaatgaaattcctagtagtactacaaaggtcaaaaaagggcacgatcgattagactgaattattgtggccgtgaaagcgaccaggggatcggagccaatgcatgcatccatccatgcacgcgtaggtaggtagcgatcggcgaaacgacgggaataatccggatcagagtgggattttcagcaattacctacttgttcctcaattcccttatctcatcggtacaggatgccatgatggccggactactgcttattgatttgcctctctgattaattgcttgtgtttactggaacagtgagtgcttttccactgtgggatgcgatgagattaggaggcatcactcgctgtctctgcagactgcagtggaacaattttgacagtagaaaaggtagtacagaacattgcaaccgtgcaagtcctggcagttaatttgcttaatctcgctactgttgctgcgcagtttggctgacgctgatcggtagatgctgcactgctgaaatggagagcgactccaattcatgaggaatttttgacgggtcaaagcactcaggctcttttgttcagaaagagtagtttttttcccagtcgatgcttatgctctctgcttcgcagcttcggtttctcatttggtacttgtttcgtagggttgatatcccagcccagcccatatccagagatgtcctggaaatttctaatcaattcccagcccatcctaggtctagacgcctagttaggaatgggctaattacggggctgtttagattgatgttattttaaaccataccattttttggtaaaattgatgaaaaaatgtctatgcttagtttgttaccaaatttagtaaatacataagaaatcatgctaaaattttgacaatattgtcatcttgcaataccaaaatttcaaaatttggtaagatttattttggctacaatctgtacgtgccctacagttccaatcacaattattatggcctaggatttggcccataaaaatatttttacatgcatgctcttaattttggaaaattctattttgcattccacgactctagtccaaggttaagacggcttattaagaaataaaattaatttattggtaaaatttttatatatgtacttttagtgacttaaaagccattgttgaaaatgaaactattgaaaatatctaaaaacattttaaaattaaatttgaaaattctaattttagctttggcttcggcttatttgaccaacggatgggcccctaatgatcttccctcaactataaaacatgatgtggaactccctcatctaccaatacggttcaatttacctctttcgcactggattcgtcctatgtggtgtgttgactgggtcaatccgagttaatttgatatttatgtctctcacgtggcattacgagcaaaaattaaaaacaaaatattcactgagtcatgtacacctacctctcaattcctctctccctactttccctctgacatcagctcttgggacgaagtggcgtcacgttgccaggtgaaggaacgaagaaagtcgggcttgagcccacggtgctttgggagatagatcgatgaggaatttttttcatttatatatttttttattaaaatatttacaaaaataattttttgttttgaaaatttacaaatctaatcccctgccgtcctttgggatcgcccttccaaagggcgacaagggacctaaatgcaaattttccagcacaacttttagctctatgattttacaatttaaaattatattatataaagtcagatgaaataaaactttatatcaaaattgtagagctcaaggagatctacaactttgtagttaacaactttttcatttaagatgttttagatatccaaatattcgttacaaaatataaaacatatttcaaaaaatctcagatctacatttcaaacgatattggatggagataaactttatataaaagttgtagatcttaatgagatttataactttgtagtttatcacttttccatttaaaatcatagagtatcgaataagcattattagtttttaagcaattaaaaccagtgaaaagggtttgaacacaaataaaaattttgcatttaggtcccttgccgctctttggaagggcgatttttaaaaatcgcccacccaaagagcggcaggcaattagatttgtaaatttttgaaacaaaaaattatttttgtaaatattttaataaaaattgtataaataaaaaaaaattcgatcgatgaggcgcctgaggacggcctactagaggtccccatgagcagtgctgaccttgccctcaatcttgcaatcgatggcctcgagctgcacctgcaacatgcggaaggtgtgggcaagagagatttcaatgtcggtgaacaaagggttgtagcctgcatgcgggcatggtcgactggcaccggtagggcagggtgcatccaatgccaagcaaggttggtcctcctatcgatgggaagagatgaaagagggttgacgacaaagagatcatttacatatgggtctcactataatttttattttcattcttgactgtaatggcacgtaagtgccacatccgattttttttaaagaaaaaatttcccgctgatggaaattgtcgtgtgagcatcatgtaggatgaaaccacagtcaaaattactcatgatggcaaactgcaccaacattgattattgagggaagcgttgtattgaggaaggaaattagactcgggctatagtagagggacacagtataaactttatatgtttattatcccctgaatttaacagaaccacattttggcccattatttgtttattcccagattgaataagtttgaaattcgtccctaaaccgaaataccatatatataacaggttgaatccaacacgaacagcgggccgtgcatgatgtcagagtagctggagaaggagagggagatgtttcggctagcggtgggcggtggagagaacggtgctgacatgatagagtaagaagggttggttgctgacatgtgggtcccactcactacatcacccaaaactagccactatatcatcaagggaccaaagttgacatggtgttatgagttgagaggtaggttatacccggtatttcggtttaggtttcagacacagcaataaattgagggacctaaactgaacttattccttcccagattaatacaacccatcaacgcatattacgatccttttctggctatgcacgcagaatgcatacatgagttattatatttgggcgtccatttatttggtacggaggaagactgataaattagcacagcccatttcagagatgaccaggaaacaggaataagttcgtccgaggttcctttaacttgtcaactgatccgattttcatctcaaccggaaaaccacatacaacaggtctctcaactgtcaaccagttcaatataggtcccaaggcagtttgaacggtggtttcagctgacataacgcctacgtggctaaggctgtgtttagttcccttcaaacttccaaaaattccgtcacatgaagtgtttgaacatatgcattgagcattaaatgtagataaaaaaaataattgtaaaatttgcatgtaaattgcgagacaaatcttttgagcctaattacaccatgatttgacaatgtaatgctacagtaaatatttactaatgacagattaattaggcttaataaatttgtctcgcagtttacaggcggaatctgtaatttgttttgttattagtttgtgtttaatactttaaatgtgtgtccgtataataaaaaaatttggcgcacgaacaaaacacggcctaattttactcggtgctcattatatgaacttattcggttattccccaggaatatcaactaaatttccagcccatttcgggtctcgttactcgttaggcatgggctaaatccaggtttatttccattggtaggccgtgatttggctcatgccaattaggaataagttcatctgagatcccttaacttgtcaacgaatccgattttcgttcctcaaccgaaaaaccagacacaacgggtcttattaaaaccggtgcagattaggtcacttggcggttttgagggcggttttcgttgatgtggcgcctacgtggctaatttgactcggtcttcatctgacgtggtattgacgtggcacttacgtggcaattcgatctaagaaaaacaatataccccgtgggacccacgtgtcagtttaacacgcattaataaaaaatgtgggggccgtgtgggccccacgtgtcactctatcactcttcttctcctctctgggactccgagcaagccggccgacgggtcacgccacgcacgacggcgtcgagcccgggggcggaccagggcgaggggacaagctcaacctcggcgacggccacgcggtcgaccctggccgggaaggaccccgtcacggcatcaccgagtgccgcggcgtcgagctccatcccgcgtgccgacgaacggcggcgcgaaggcgtccctaacgcggtcagtgtcactgaggcccaggttggtgctgatgcagccggcccgcaactcggcgagggagaccgcctgcgcgatgtacgtgtccagggactccctcgccgccggcgggatgtccgggaagtcggcggcgttgttcttggggcggtgctggacgaagtaggtggcctcccagtcctgatgagaccatcaaagttccatctatctctatcgatgcttctacatgtttgcataatagctcatctaggagtattgttcaggttggatctttcttttgtaccgtgcaacaacaaaagaaaggagaaggcctagctgcgagcagtacttttataggttaattaaggtaagtgttattagcggcatcgttaccattaatcacataattagattactttttatttgtttgtttgggcctgctcgagtaggactttggtcctgtattgcctgcgtgcaacataaaagcccaatgtggcctgtaatgagagttagtttttgcttttggtgaagtcgtctagggtttattcctgtggaactggaggatggcgatcccatcctgttgatttgccgctgccgccgtgaggtgtggagggagcacacgtccaggatacttctccagggagtgttgcttggagtcaggattggttccatcttctctgatcgtgtgtgttgccacacgggtggagttgcagatcgttgatccgtatcagtgctttaaaactactatctggtattgctgtttgttttgagagacaaaatcaattcactgcgacgctcatatacatactgccggttaatatcgttcttactgctttggtctgctcatttgtttaagttggaaaaataatctggttgggttattcagttgttggtaccgtgaaagagagggaaaatcagggcattcaccgccgggtgctcatcaagtcccagtcgacctgatcggcgagggcgtcgtagtcgtcgtccttgttcagctggaggttcttggcgaggtcggaggcgtagaacttgttctcgagatgctcgtcgtagtggcgagccccttgagatcaatcaccggaatctccatctctcccaaggctagctagctacttctacttgtacgtgtacaactgcctagtagtactgtactactgctgatgatgagccaacttatatgcaacaagaagatgatttgcttccgatgagcgagtggcatgcagctgggcagcgagaggcgaggaggccggcagcgagcgcacgcgaagagggaggaggtggggaggccgacgcgagcacacggggagagggaggcggcggcgcgggagcaggccggggcaccgagtccaccgagtccaccgccgctatgtagccccttctcccatgtcgcccgcgctgccgcgtcgccccttctcccgcatcgccgcgtcacctgtcgatggccgccggccaccggactgcattctctcccctctcctctctctcagacgcgacggagagggagcggcgcatggcggcactggcgggagaggataccgtcgaggtcgaagggccgcccggaggacggtggaaacgggggcaggggccacgatggtgagggcacgccggcctcgggccaccacgcctctgccggcgctgtgccgccgacgtcgccgtcgcaccccggcacggcgggagatgaagcgagggaagatggggagaggagagggggagagagatgaagagagggagatgggtgagaatgacatgtggggtctacgtgggcccctactattttttttattaatgcgtgcgaaactgacatgtgggtcctacggggtttattcttttagatcgaattgtcacgtaagcgccacgtcaatgccacgttaaaatgaagaccgagtcaaattagccacgtaggcgccacgtcagctaaaatcgccctcaaaaccgctgagggacctaatctgcaccagttttaatagttgagggactcgttgcgtctggatttttggttgagggacgaaaatcggattcgttgaaaagttaaagggaactctgatgaacttattcctgccaaaattactgcacacacatgaacttgcaaactagaaccaagatgggctggacaaaaagctcccagcgattaacacgcgcgattcggcccattatttatttattcctaaattaacacagtccacgcggtctcccgtctcccagacaaaaaaaaaaaaaacacacagatcacactattcggctacttgtcgtcttctgacccgaccggcttggcgacgagccggagagggatccgccgccgcacggtgaatcccgggtcgtcggacatgtcgagctccccgggcggcgggatctcccagtcgaagaggcggaccaggctggccagcgcgagctcgacggtggcgagcgcgaactgcatcccggggcacacgcgccgcccggcgccgaacgggacgagctggaagtggccgcccctcaggtccatcgcctccgcctcgccgccccccggcaagaacctctccgggcggaactcctccggcgagctccaggcgcccgcgtcgcggtggatggcccacgcgttgacgaacacgcgggtgcccccggcgacgtggtaccccagcacggtggcgtcgtcgtcggtgtcccgcgcgcactcgcgcgggacgagcagtggcaccggcgggtggagccggagcgtctccttcaccacggccttgaggtagggcgtggcggcggtggtcgcgccgccgccgcggcgcacctcgtcctgcagcttccgcatcgccgccgggttcttgacgagctccgacatggcccactccagcgtgatgaacgacgtgtccgtccccgccgcgaacatgtcctgcaagagcgacttgatgatgtccctcgtgagcttgaagctcccatcatggcgttggctctcctcctgcagcgcgagcagcacgtcgacgaagtcctcctccctgtgctcttcgccgccgccatcgtctccgccgcgtagcctcgcctcgtgctccgcgatcacctcctcgagcagctcgtcccaccgccggaggttcctgcacgccctcgcggcgaacccggagaggaacgcgtcggcccacgccagcgccgggaagtagtcgccgacgcagaacccgccgagcagcgtcgcgttctcctcgatgagctcccggaacagctcgctcctcccttcgtcctcccgggagagcctcccggacaccgcccggcagatcacggcgttggtgaacgcgtacagcgccttgctcacgtccaccgccgccgcggccgcctcggtcctgatggcgttgacgaggagcgcgacctcctgctccctcatggggccgtagcggtgggagcgggcggcgctgaggacgtgctcggagcagaggcggcgggcgtggcgccagtgctcgccgtagggcgcgaagacgaggtccttgaacccgtaggtgaggatctccgccgtgcggaagtagggccgcgtcgcgaacacgtggtcgtgctcgcgcatgaccgcggcggcggcggccggcgacgaggccacgagcgcggtgacatggccgaggcggaggcgcagcaggtgaggcgcgccggtggccgcggcgagcgcgcgcagggcgcggtgaggcagcgcgcccacctggtgcaggttgccgatgacgggcagtccccgaggagccggagcgagacgccgccgcgcgttcccgccggagcggagcacgccgccggtgaggtagaggaagccgaggaggaggaaggggaggaggaggagcacgggtgagagctcgatctccatggctgtcgctgcagatcttgcagagcgcgcactcgtttctttgattttttccgaacttaaactcaacatcgacgtgatgacagtagggccctgtttatttcacaaatataactttttcactatgtcatattaaatgtttgtacatatgtacagtgttaaatatagaaaaaaaattaattacacagattgcgtgtaattgcaagacgaatcttttaatcctaattgcgttatgatttgataatatggtgacatagtaaacatttgctaacgatggattaaataggattaataaattcgtcacgtagttttctggcggaatctgtttgttttgttattagtttatgtttaacactttaaatgtgtgtccgtatatctgatgtgacacgtcaaaaattttcgtttgcgaactaaacatggctctaagtgcccactcctcgtgcccaaaatatataaaggatttttacgagatgtgatacattttaaaactacgaacctgaatatatcacattattagtattaggatgtcacctccaactaaaatccaaaagttttgtcattgccgtcattttcttagtactagtagtaggtgtttgccttatcttatggagtactcctccgtatttatttggcttttggagattttgcgcagaggatttgacatgtactccgtatgtagtcgactccgtatgtagtcgtcattaggtcactgactcactggagatcgaccagttggctctccatctgttctgtaggcggctatgcgcctatgcctcataatttttgtggtcgtataatatgcagttgtatttgagttattcataagattttgtaaataaaatgttgtgtatctttacgcatccgtaagaccgcgtctcatttgatttagatattaagtatattattgctactccttctattttatattataagttatttttcttttttcctagtcaatctgtttttaagtttgatcaagcttacataatattccctccttccaaaagtttatgtcctattccattgtttggtcttttcaaaagtctaagttctatttgtagtcactatgtgccatattaatttttttatcagaacctaagaaatcattttagcacttattggttgcatgttcactagttttatcacatgaatgaattaactacaccttagttttggtaaaaagaaatataacttagacttttggaaggagtgagtaatatagtactagtattttactatttttaacataaaacaaacatattatcaaaatatactcaacattaaatttaatgaaaataatttaatattttagatattgctaaatttttctataaattagatcaaacttaactagaaaaaaagtcaagccacttataatataaaatagagggagtacttaaaaaaattatctacttgattatagagtaaattaaatatttttaaaaaataaatattacaaatagtttaaaataaatagtctaatgaatgcaatggaagaaaatattcaaaatattcatggaacgaacaatctatttcaataatgagaagagttggagttaagtgttcaattggtctcgtataattatgtgtataaatattagatttgaggataattaactaccgttttaattttatattaacaaattttattgcctttcgacagaatccaccacttgagttgcaaggaacacgtatgatggaaatgaattctaatatcacgaggagatgtcttcttattcttgtatgtcttccaaacagttataattgctttaaaaaattaacaatataaattaatgtgtgatatattattttaacatgcaagtttaaatttgatcttcacaagttctaaaaaaaacatattaaactcacaattatttttttaacttgtaaagttaaacttaaacttgtatatttacgtagtaatgtaccacatattaatttagattttttatgtttttataattatgtagatgatacgaaagaaacgtctcctcgaacgattaaaaggtttcatggttctgaaagagaaaacaaaagaagcagccagtaaagcgtagctgacttaagaaataaagtatacttctgctatattatcgtgttaagcaagacctgtaaacaaatttagtgtcagcatcaccttttaaggtctgtgacctgagtttttttcattttagcttcagaaggattaaagaatgatttggggcagactttatagggattgtttaaatcccaccccaaaactttacaccctatcacatcgaatatttagacatatgcatggtgtattaaaagacaaaccctgatttccgtatccaacgtttgaccgtccgtcttatttgataaaattatgaaaaaaattaaaaagataagtcatgtataaagtattaatcatgttttatcatctaacaacaatgaaaatactaattataaaaaaatttcatataagacagacagtcaaacgttggcacgggaacacacggtttgccttttttgggatggagggagtatagtctaaaagaataactaattatttagattgcgactactctgcgagacgaatcttttaaatctaatttgacaacgtggtgctaaagtaaaacatttgctaataatgaattaattaggcttaataaattcatctcgtgatttactgatggatattataattagtttttttagtacataaatacctctatatgacaccctcgtataataattaaggtgacacgctcaaattttacacccaatcaacaaacccataccggagggctggagccatggctgtcgactgtcgtcactcatgacgctgagtgcaggttcgtttcttcgatttttctggagctcagaggtgatggcagcaggtggcaagccattgccgtcgagtacatatattttccttagcttatctctttgtcctttggagtttttgcacagaggattgacaagtagatagtcgtccatgtcacttgagatcgggttgttgacttccaatagttttgtcggggcagtaccggctacaatcagtggtacacagagaacaaaatgcgcaggagtcgtgtcacatgttacagctgatcaggagtatgttgtttgcgcaggaataattattttccgttgctttcaaaaaaaaattcatggcttatgagctgtagagccatgctgatggcgtcattacgcagaagacaagcatcgctttattttatcgacaaatatactctattttttattctagagagattttagctttaagtgatgaatactagtagttacttcatccgtcccagaatataaagagttttagacttaaacacggttattaagaaaacagctagaagtgaataatggatggttgtgattggatgggtagtggaagtaggtgagaaaagtaaatggtggagggttgtgattagttgggaagagaatattggtggagaaattgttatatttcgagacaaatccttatagttaaaagttgttatattttgggacggatagactaataatagtaactctatcttaatatatagcaatatagtatcaaatgggatatatttttgtaatagaaacctgaaccgaacttatctatcaatattagtagtaacgagatatacctcatttgatattaggttgtttcatttttggtccatgagatggatgtttgatgggaaaagttttttatctactggggtagacagctgcacaccacacgataagtgattcgtgcgtacacccgaccacttcccggtatttcccaacttgcccgtattttgcccatttgttagcggaccatggaaatactttcatgcttgaggtcacgactatagtatttacatggcatgaagatcattgataccagggtatatgcgagattgagataaaaaagatagagacaatgatttttatacaggtttgggccccttcacaggaaggtaacgaccctactcctattggccgtagtctgtgtttttctttattcatctgaatcacactaagtacaatatttgagataacctatctagatgtcgttgacttggcggcatggatcaccaacacatagtcaacgacagggtagttttactcctcgagtacgaactcgtcgagattagagatggcgctagatctctcttgttggcctccgcaggcaccagattgagtctgtttaggcttatcactgatatcaatgtctggtggcgtgtgttggtgtctattctgacttgtgtgtgtgttccctctctccccctatgggtcttgtatttatacctatagatgttcccttgtacaagtagtattaagaagaccaatatagatacaatccgagtagtccttgtcgttttcatatagaactctactcgtacttccttatccggaactccttctatatatgaggtacgattccgtataagatttggtatatggtgggccccgctgagcttagccgattactattgggtacgtggtatccataaccatgacaaatacgactttatacgcggatcctacctcgtacaatcgcactggcgttcacgggggcatacttctccctcctcttctcctcactgacgcctctttccctatcacatcgccctccgtagtgcatcttcccatcctagactatgcatatcccttctttctataaagttaaggccaaaagctcaaacctcgtgcttccacgtcatcatcaaatagtgaaccgttggatgaatatattagattgcttctcagacgttggatggaatgcagcatagagcccaacccattagtcaccgggtgagtctcttcgcctcctcagtgccaaatatagcccacatgaacacattggcctatgtccacacacatatacatgtatccagcccgtcactccgtataaaagagctttatgctgaacgctctttcagttgacatgtgttacctaaattatctacaaatttttgatagggctgctaaaaagaatttctccaagaaagctatttgtttcttcttgatattatacttcttatctaacaaattgatgttaaccaagtcccacagcaacacgtggggcatcctctcgttgtatatactcttcccatccgttaggaatgctggcgttatagttggccaaatgggccgcccggcacagcacggcccaggccccgccgtgcctgggccgaggctagtcgggctagcacagcccgaccgacacgctgggccgtgccgtgccagcccatgtgctgcacacatggcccaggcacgacccaatacgactcgggccgtgccgggctggcccgaaggtacaacagtccattgtgcttgtccatagaataagtatatttttcatccctcaactctgtgggctgagttcatatggctagaaataagtctattttgtatttctcttctcattgggccttatcttatatggttatttaagtctatttttcatccctgtactttgtgtttgtccacagaataagtatatttttcatccctcaactctgtgggctgtgttcatatggctggaaataagtctattttgtatttctcttctctttgggccttaccttatatggttatttaagtctatttttcatccctatactttttttcttcaatcgtgccgtgccgggccagcccaccgtgccgaaggtgcagcccaggcatggcccgactgtcgggccaggccggcacgggcacgaccccagtcgggccgtgcttgggcctggccaaaacggcgtgtcttggcctggtccacgggcctcgggccatatggccatctatagctggcgtgctcttcgccaaccaggaacgaaggaaccacaacagcgcacaaacagtccaacgattggttagtgacgatttacccatttcaacattttgctcctctctttcaatatttttctcctttctagaagggttttttgttttaaagtggcatagtccagacaaatccgtttacctgaaatccatgtgtaacctcatctctcccactttttatctgtagccaattgagttagggaagaggagggtttcgtgggacgaacgttcacggcctagaactaccaggagcaagacgtgggtgccccccttgaagctgacgaagaggattgcgattcggtggttgatatcgcgctcgacaggggcgccttggaggccctagtgagagaagtaaaccatggtgttgatgaagatgaagatggagccaccagggttgctacaatgacaagctcagttaggcatgcagtcaagataatcacgaagtttgacgactacaaaagagacggcggctcgacgacgccgtgtgcgtattttgcgcttaggtccttgccgtcccccgcaatgcaatttgcgcccgacgaaaaaagcatttggctgggttttttttgcatctgggtctagatgcaaaaaaacaagccaaatgctttttttttcagctctattgataacagttaaagaattatttattggtaaaacttgttaataatgttttaaaaaatgtattgaggtcggttgttttgcaatttcatattttaagtaagagtttatggtgtaacttattcgacgtattagtgtatgaaattgatataggcctatcatagtttcggtcgtagaaacattatatacaattaaacaaggagaattatgtcatgtatagaaatagtagtagaatttgaacatgatacatctggttccattgcagttacatatataagattagattcaaactaggagggaggtagtgcaagagttgaacacaacgatgatgtagtaataggacaaggaagcatgacattacaaatttcaataaggtaagttgtccgataatagctaacccctacatgaggatccctctcctctctcaaactgcgctttagtaaccctgtattcctctgatagttcaagctgcaccacacggctaggtggagttagaacccttctggtgtctatccattctctgtattgacatctccttggtggttcctgtgaaaaacgaatagatgtgaagcgaacaaagttagtaaatgttgggagaaaataaggattcatgataatcaaaatattcttactatgaaatcgtcgtctagaatatttggacaaacaaaaaaaccttcgacccaaagtcgtaggcttcatggaacgaagaacctgacaatgatcatcgcatctacatcttggacgggcttcccatggagggagtgccgtagttagcacccgccagtcgcactgttgttcacgacgttgtcgttcgtaagccgcttttctctccaagtattgctcagtactttcggatgcgaaataccaacgtccttattgtaaacaagtggttaggtcgagaacgggattttctgtatcgacccactcgatgtatccgtaagccgtagcgtgggtctgacgaatagagtagtatgataaagaataaaacaattgcccatataaaatgaataagcatatgcagataataaaataccttacggtcatagttagggcacctaaaaaagtgtcttcctcgaatgtcaggattcatcgaagccattagttgccatcggtcaccgcaaaggcaaagaggccgttggcaccaaggtggtagcaggtatgcacaaggatcgctatgccaattcggatcctcaacgccccagcatctagccattgccaaaagctggtgggttttgtaatgaaaccagtgagaaagagagtattgaatctgaccgagttatgaaagattgtgaggcatcgctcgttatggcaacttataaaatcacagtgataaccttgacatgtctacatcgcaggccatggtgggtcagcctgattggcgccgaaagtaagattggacgtatgcgggccatggtgggtcagccattccgcagtcgtatcgcacgcgaataaaggaggctgcatcggtgtggcagaaagtactcatgcatgcaccgaaaggtatcatgctttcgtaaaaagtaacagcgaagtttagggatgcaaaacccgaatagcaacaacgtattcattctacaagcatacagtactagcatgtaaagtaaataaacaaagagaagtctgctctactggccctgccccgcgccgcgaccacgcttggtcctccgggcctgtgctcacacgtggtcctgggagtacgtgaagcgatccagtggcacaacacgggtagcacgagtatttggcggcggagtggagggcaactggtcctgcgtctacaccgactggtccgatgacgtcctctatcgagtgctggaagtcgaagtcgctgatgtcgaagtgcaaggtggaagcccacccgtactccgacgatgtcccggcatggtccagtggtggaccctgactcgacgtgccggctgcctgtgatgaagtcccggcatcctactagaattgcgcagagtgcgaggccgacacagttgcctgagacgctgaccttgcagcctgggagaagtgggcggcctgtgtcgtaccgaactgggcgaaacctatacatcgacaacaagacccttgtaagctaacacataaattgcatgtaaattgattgtcgatatagtgttgtttttttagtacctgtgggggcacaataggaggcatactcgtggaaggcggggtggtgaacggtgcacgaaaccctgaagcaatcggattaatcggttcacatatatgtgtggggcatgtaaaaataaaccttaaatatacttacctccgtggggagggggagttagcctaggaacgtgtgcagctggacgaggaccagtcggtcggggtggccgctgtggtgctgcgtctgcctgagcaacgtcgacaggacgacaggtggacgctcggagaaccgagcacaccgagtccagtattcgcgtgcacgtcgtcaggtgctcgtctacaagtactgcaatctccttggtgttacaataaattctaacagatctatcctaatcggcccgtaacggacgtttcctgggccatggtatagttgaaatatatgtttgttggacatttctgtcaacgaaataactagatcattctttcatgtaataaatgcccaaaatgtaatatcttgttatgtatgctaatgtaatggtactcaacaacatttaaaactacaaagactacagatctacgtagttacgtatatctaacaatacgcagttctacagtagtacaactaaaaccctagataatataatacatttattcaaacaaagttttaaaaaatacacactagttaattaaataatcacatatatgatctatgaatattacctgaaatcagagtctcaaatcggcagggcttcgccttttcttctcttctcctccccctctctttttttttctcagagtagaggtgaggagaactgaggagggtgtgcagggcggcaagccttttataggctaggaggcctgccaccctagcagagggcggcaaggggccgcctgcaaaatggcaggccccgggctggcttttttgcatggaggcccctagccgcccaggcagtgggcggcaagggtgttaggtgcaaaaaaaaaactcatctttttgtatagggcggccaagtcagcttgccgcggcggcagggtctatttttgtaattttttccgacgatagattatttctgtaaatattttaaaaaaataaaaatgaaaaaaattctctggacataatccgtggttatcaggctgtgggccatcgggccggtgctcttgagggccgaaacctcgccggcccagcgcgcggcaccaatcgcccgatgcgcagccgcacctgcccgcgtcgtacggtgtactgcccatctccgccatagcgtcgtacgtactacacgcgacggtcgcgtatatacatgtacgtcgtactcccccgaacgccaagagctaacccatagagagcaacatcgacataaactatcatcagctagctgcgacagcgagctagtagaagccatggacatgggcggcaatggcatggcgatgccgccgccgccggcgccggtgaagaaggcgcggtacatgcacatgaccttcttctggggcaagaacacggaggtgctcttcaccctgtggccgggcgccaggggcggcatgtacgcgctcgcgatcctcttcatgttcgcgctggccgtgctcctcgagttccgcggctaccgcgtgctggaggcgcgcctcgcccggcggcgcgcgccgcgggcggccgcggcgctgcgcacggccgtccacgccgtgcgcgtcggcgtcgcatacctcatcatgctcgcgctcatgtcgttcaacggcggggtgttcctcgcgatcgtggcggggcacgccgccggcttcctggcgttccgcgccggcctgtgcggcggcgggccggcgccgccgctggaggaggaccgcaagaacgaccccgtgtgctgctagtatggcttaagctgtctcgctcgtcatggtgttcacgtggccttttcgcttaatttgttgatgttttgtgtgtgtgcatataggtttcaggtgattgaaatctttgaaatttgggtcggatgatcgagtttgtttggttgttttgtttttctctcgtaaggtctacagatgtgacatgaaagttaatttcttgatgtcatcttggcttggaatctattactagtggtgtctgtcaaactgtaattgtatagcatatgtcactcatttgattgatgctgcctcccggctttagtttcaattgtctcagattggttattatagtgtacctgcaaaactgttcttcaatccaaactcgacttgtttgcatctggattcaagcattcctatgatacatgttcaatatagagtgctttctaggtagtgctactatttccttttctcgtttggaagattttcacatttatatggctgctctgaaattcacaactgttctatacaaagagttgagctggtcaaaattaaaatcttaaaacaaaacacacgagattgaaccgattagcatactccagaatttcaaaactgtttgatcaccgaataccctcttccgagtttcgtcgataatagcgactgcggtttgctattaatgtgagtatttctatttaaagagtaggatccacactcggttaccaacgaaaccgggcggaattcttgaaatttgttaaaacttgaattatagttttcattttaaaaatttgaccatttaccgagcggtttcttgattcgtactggtcgaataagactgataaccatgataatgaatagttaccgtcccacttgttaacccagccccgttgaaggtggtcctttattaacctttgtcggagctcactgtcaagtgtcaactttctgatgttttcttacattatccacggctgtattctacgataatgcactactaaacaacccaaataatgattttaccgtgcccactgaaagcagaattaatctatttcatggtgagtgcgtctctgaactcctggctatggattgtaaccctaattctgtgagttaataaagcttcctggttttcccaaaaaaaaaagaattaatctatttcatcatataattgtactactcaattgggctaaacacctcggtcacacgtcatgcgtgacaattttaaatcacccccatccattttgcagattggcaactaattggtaagttgtgcttcattgcttcagacttaaaatctgcccacttgtaaattcttaaatactgtgttgataatggaagcctccatagggaaagtttattttttctttcccatggtacaaaggattttcccccattgacatgctgcatccgacacgttgaatccacttctatcttctgcttctcgctctcttgcaattaggggtgaaaatggtacggaaatttccgagatttctaatttttgagatttccatatgttgtttctagtttgcactgatcgtttcagtcggtgtcggtaaccgtcggtcggaaatcgaaatggtaataacttttagaaatggtagcgaaaatgggatggatacaaccgttttgccggtaaccgtatttgtacgataacctccatcaaaattatgaaaaaattccgaaaattccctagcgggtcagccagcccaacccatcggaagcccatgagaggaggaaaccaggtaggtttgcagcccattataaaggggaagtgattagggaaaagcgttgttaaccctaagacgtgccatatggactttgttgaactttggtctcctcaacttattgatattgaaatattattgaactttgtttgtattattcgtcaaatttattatcatatcattaataatcatataacggtgttatgtggagtgtaatgatggaagactgaagttataaagtcctcttcatgcatagttaaatatgtgctatgccacactccgctcattctgacatgaacttttgacttctgaccaatatcggtggattccgttccgactacccgtttccgatattaccgatatcattactgtttcggatcccattttcgagaaaaaaactgaaaatgaaaatggcatacgtttttccgaccgttttcatcccttctcgcgaataccttccatagcttgtctaggtgggcgtgccttttcatgggcttcacgctctcaacgtggcttagctatatccagctggaaaatgtcaaagatttccttagttctaggcaaaccaaaaattcccggcttcaccgctgcgtcacgcggtcacggtatggcctgtttttacccatgcaatgcaatgttcaaacaaagaaaattactaattggcttcaagataaggccaacgaagcgtgcttttatttgtgatctcttatcagatgaacctctgatgtatacgggggttgagtgacttgtcttgtgaacgggatgttcttccaatttgagccatctcaaaaagaggcaaggtcagagagctgatcggctccacgcctcgacccgacgaccaatatctcaaaacatcgaggattgcaaggggcaacaatgactacagacagcatgcgctctttcaacctcttcttgtattatgagtgagctatttgcctattgtatttgaaagaatacaacagttccagaccaatgacctctatggctcacagcgatttacagttcagaacttgggattcttggccatcctggttatctcacccgaagatatgtataataactgatgtaatgacccccaaaattttgtacggatgtctgaaaaaattacagggggggccgagccgttacctttggatcctacagtcaacctatggagtgtgtatccaatgaaagaatggagattcttcccttcccacattgaggagctagcgttgctgctggagtataaaccttgaagcacggttgcaagcattagcaggttataatgtcgcacgaaacgattccgtggccctcggtgacctgagtggaatgccatcagcagcagatctgagaggaattccttcagcagcataaccatcctcctcggcgtgtttaggtagtcggataggtaaatttggtgggagacctgcgatggcaatgaataagaatttaccaatgggtgctatttcaagtcaacacaagatgggacgaaaggcagtcataccatccaccatatcctttgtcttgtgaagaagaaatgtcccagaaaggattgtaacaaaaccgcacatctccgtgacaatttgtgttggatcttgacgatcccagtcctgcatgcaatcagggttgcatcaacagatagttcagaagcattgtcaatggaacacaataaggggttgactgaaccatgatgcgccattctgatgatacagtttgccgatagaatttatagcattatcatgattcagaaattcattgtagtatgaaaggcctttcaatgttaatgttatgtttacatgtatactgacaggcctacatgtcctattcagattagagaacatttttagatatatgggccccatataagaggagtttgaacatcaatcaggatatttaagtgtaattgaatatcaaacagctacagtatcacattaaggcggcagttgatgcagcaaggaaacatgatgggtagtcatctaggaagatggaacaaaaagttcaatggccatggtcaaaaactgaatgccaaaggtcccaacatgtttttgaaaatagtccagaaggataagtcaagagttaatttgatatgccaaactgcgctatcgatacacaatgtataaaagattgatttccattcaagcagcaaattcattaaaaagaattaagtatacttctggtatattgacatattgccatattaaacaaaatcagtacaatagtttatagtgtcgccatcaccttttaagaaggcagctacatggtgtttgtattaaaattatgtcaacaaataaattaagcccaaaacctgttaccttgaacattatcacactggccaaaatggtcaaggatgtaaacatcgtataatatatgggcgaaaccactgcagtgttgaaagtgtcaagggcctgcaaaagtaaacagtcaaattcaaagtcgtatagagtagaagacaaatgtacaagacttccatatagaaaaacaaaatcagtctattcatcgtttatttttttctcttggcatgcccaaaattatcctacaacatagatattgatcataccttgttcagatagttcatctgtgttactatgcatgcaactacaaaaagtaagaacacccacatctgtggataaacaagctggttcatccctgaaaatgtcagcttcaatgctatcccaagagctttgacactcatgacctgccagagaaagaagtttacagaatgaattcatttacaccgtaaaccgactaagaaggatattgtgaaaacgtatcaagaattattaatgacatgcataccgataaggatcccacgagagaacagacaccaatatacaccatgatatgggtctgaccatattgtgggacaaaatggaatatgagcacaaaagctgctgcaagcacaatggctgcatatagtagaaatgctggaacataaaggtttaaatattagtacttgaaaaaccaatgtctaaatgagtcactattttctaatatttgttatattattatcttgtgtacatggtaggattatacctggttcagtagctagatcccatacttctgccacagactcaatttgacgctctggaggggcatgaagcacaatacttgtcgaacccacaacacaaagaatacacccgagtataccaaatatgtgtagcttctctctcagaataatgtgtgcaagaacagcactgtaagaagggatgccgatattatcagatttacaggaatatacacagaagaagatttacaggaatatgcacagaagaagattttaccataccacttcagtcatacaattctagtcttacctgataattatgctaagtgcaccaagtggagtgaccaagatagcaggagcaaaagcataagctgcgaagttggcgatttctccaacaatcactgacaaaaagcatagtacatcaattagcactatcaccacagatggaagaactttgtcaaccagtatattcatgcatgaagaaaccacttacttgctgtcattcctgcccaccacaatggttcaagcaagtaagagtagccaccaacacctgtagcaagtcaacaacataagcataattactgaaaaagctgaaacccatttggccagagggtagcaaaattccctatatggtacttccgtgactaaccaacatatcatgggagaccaattacacaacgcggattgatcatccatggaagtttaaagcacaaaaaggcaacaaatagagcaacagcaatcacatagtagttttttttttctgcttgcaaccatttctgcaatcataggctcctcctaccgtcaaagattttcatattctacagccttccatgtttgtgtaagcttgttcaaactgctaattttgacgcagaaaccatagataacgaatcgcaatgcagtcacattataaacaagaggggatattgcacatcgtgatatcaccactgcgccatgaactataacaattgctactattgtactattactctattaatcatcttgctggaacatcatcatcaactgagctagtcctacaagaacaactatttcttagtacccaaacaactacaggcttaaccgacagcccgatctccaatgcgcgtgcagcaccaaactccctaacaccacttggccaccgacaacacgatcaagatccaaatctcgcggggctcagatctacgctacagagctagcaccgcggcagcagcagcagcagcagcagaggagagcgtgggcatccctgcgattcgcttgggttgcgagctgagaaggggttaagcggaaggcggaggtggaggtgggtgagagtcacgtcacgcacctgcgcggacgccggaggcgccggccttcttgaggcccttcttcttgacgatgaagctggcgccgatgaagaggctggaggagagcgccagcaggaggcccttgacgttgtccgccgacatcccctccacccatctccccagcctcgccccgcccatgccgccgccgccgccgcccgtacgcctcccctactgcgccctcctcctccgccgcctcctccgccgccgtccactccggccgcgcatgcgagatctgcaaggcggagaggccgccccgtctcctccctcagcttgctctctgctggtggcctcgcctttctcgacccgtagcctgtagcactagcactagcacgcagtccactcctttgagagagagagaggcgcgcgcgcgccgacgacgacgacggcgacgtcgtcgggaaggtggcaagtactagtagtagtaaaccggaggaggacgaccgaatcgccgtgcgcgcgcgcgctctctcgcgtgtgcgggtccgcgtgcgcggtgcgccgctagaacgtgagagatcagatcagtcagtcagatcacggtggcgcgcggtgttttcgcggtgattttggaggtttttctgggtgtcgccatgccggtcggtggggggaggggagccgcgcggggccgcggctgcaacgtgagagatcagtcacacagatcacggtggcgcgcgcggggttctcacggtgattttggaggtttttcgcgtacgcggtaggtggggtgccggtcggtggagccgcgcggccgcgcgagcgggcgggcacggtaggcaggaggatcgtccccttcttttttacaggtggggtgtgcgtgtagcgtgcgagcgtgacgcgacgcgcgagcttgcttttggtaagaccaatgtgtgggttagaggataaccgcgcaccacagggataggtagttttggtgtgactactatactttctttagtggaatctttggtgtatcggatgttttgctgtgtggggttctgtttgatccgagtgtttctagtagcgttatggttttgctttctattagtgggacgctgatgatcctttgttatgtgtgactggacgaggattcaggccatatttgtttaggcttataagccaacttataaattaaaaaatctaaatctaaacaaacaagcagctttttcgtttggtttttttaagccataagccactctaacactattaagccaaaagctaggttagagaagcttttttggcttatgtgagacagatgcataactccaccattaaacttagaacattaaatccaccggcttataaatcatataagccaataagctgacttaaaagtctaagccaataagtctaagcccaaacaaagagggcctcagtttggttgtagcagtggcttgtggagatagaaatttgcttttgttccagcacttcaataccatatcggcatatcatatacttcctccgttttttaatagatgacaccgttgactttttctcacgtgtttgaccattcgtcttatt

SEQ ID NO: 75339 - DNA, 727 bp, Oryza sativa
tgcagcccgtacaaagctggcacgcattgcgcagcttggcccgaacaccggccagcttgcaaacacaactccggttatcatgaagggctgcgagcctgcgactgcgagcctttttccttggtgattgatttgtaaattacaatcgtttggaatctggtatgtgatcacaaaggaaatggttgcaagaggaaatatatttatggttcaacttcatggaaaccgaaggaaatggttgtttcatattggtatatgcttactctttggctagttaatgatttgtagtaatatatatggcgacaatgagaggaaaaaaaattgtaacagtgcatgtgatggacagatattgattagaagcagaggtgcgtactgatgacaacggttggtacaatttgtactgaccaaaagaagatgatatagtactagttaaattgcatgcaccaaggtcgtacagtactcaccgatcaagctgggtttcctccatgaacacgacgccgagaagtttgattttcaactaattagtgatcagtaagacagtaacctaaccaactaatgatcccaacaactatggcggtctaaccatgtataaggaattggttaactcgggaaaaaaggttttctttgggaaaaccccaaatttttttttccaaccgaaaccttgctagtaacaattagtagtaccagttgcttttccttttcgcagtgaatattcctgtcttacctactgatc

SEQ ID NO: 75340 - DNA, 1374 bp, Oryza sativa
atctaccgtcgcccgccagctggaggcctgcgccgggggctggctcggaagtcggaggcgcacttcgtcggcgagggggtgtgtagaaccaatcgctcttccagtcgtcccactttttgcggaggacgcagggaatgtagcggttcggcacctgcccccgcggctggaagtagcagccaccgactaccgtcggcggtgacaccggctgtacggtgaagaaccaccggaacagccggagagatgggcgcaccccgataaacatctcgcacaggtgcgcgaaaatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccaggcgtccctcgcccagcgcgaccacctcccggccggtggcagattccggcatgaatcggcgcggcagcccggcctgcctctcgctcacgatgcgggaaggcggcagcacgctaccctcgagcggtacggagccccgtgccatgacgccggcggaggaggagcttgagagcgagcgagtatggcaagggtagggcgcaggaaacggagagtcagagcacaagtggcgaaggcaaggggaagagtggtgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggcagatgtgcggtcgtggcgtttgagatggggcagatcgtgcgcgcgtttactgcgctcgccaaccgcgaaaaacgccatcatcatgtccccaggcgaaacaaaccggctcgtcccgattcgcgcgctgcttgagtaatgtagcggtcttgaagagcgcgctcattattgtcgatcggtttttcccttgccgatgcgcgcgatttgcgaccgttgggtttctgcccgcctgtggggaccggccccacctgtcaccgggcctaaggagtggcgtcacgcccgagcgcctccctcgaggggggcggtcgccctggcgtaacgccgggggctattgtcggtgacatggggccgggggtattgtgactagaggcttgggtagccgcgatcactcacgtggcccgacctcctcgggggggtcgggcccgacggtgacgtggccacccctccctctgtctccccgaggggtcgagccgctcccgtttcggccccaagggctggggcaccccgaccccccgtggtgttggcgccacgtgtgtgggttagg

SEQ ID NO: 75341 - DNA, 11845 bp, Oryza sativa
gtggtgctgctccgcgaaccgcgcgagcgcgtccgccacgcgcgggagcgcgcggaagtaggcggcgtgcgcagccgccagcgccgcgcgccgctccgccgccgcgcgcagcaggtcccgccgctccgggcagagcgcggccaccggcgacgcgtccgccgcgtccagccgcgagctcctgcaccccatccccggacaccaccctacgccctcgccgtcgacggcattgtcactcactccccgactggacgagagaaaaaaaaaatgggcgggagcgcggagcacgcaacgggacgaacaccaaagggtggcgacttggcgtggcaaaaacggcgcgcggcgcgcgacgccgaggcgaggcgagaggagcgtggcggggcgcggcgcgagcgtgacacgggcacgtggaggcgctgcgagagcgtaccactccacggtttagtactactactattattgaagcgaagcagcaaaccacactacacaaacccacactggcgctggatgcagtggcagtgggcattgcattgcacatcacgagcaatcaccggcacgatgtctcggggacagcagaggatgggccattgaatttgcacgtactgtacttcatgctcggtaatttttgggtgctgtaactggatcgtttgcgtttttaccagcttatggcgtattggtatgtgctggctagattcaccaaatcattttggttgaggttgctgtcactccactgtttgacgtatcgtaaaaaccgtatagttaccgtgagacatatgatggttttaaaaactgtgaagattattgttcgtgataaccacacggtttctgtaaatcctggcgctggcaggatgtcacttgcatcgcagcatcatgtacagtaggcgtaaaatatggggactgtagcaaatctggggcagtaatcagtaaatcacacctctgaatgctcataaattcattcgcttatcaagtctttgagtgccttttctgggactcctgccgcggcgatatttgagcagcagtagctgctgtaaaattctgggtgctctggttgaagttgaacacggcgctctgctcactgttccagatagtactagcgctccgtcaccactgatactactacactgaatgcaattatcggaatcatgatgcagtagtactgatgagccacagatcaaagataaccctgcaccggatgtgatccatatcgtctaattaatcttcagatttcgcatttaaaaccctcctcatcctgtagaagttcgtaacagcaagttttagagtggaggcacctctaatttaaatgataacatctaatttttaataattaaaaggtaacaagtactcctcccattgtcccgatttgttgtcttatatatagagttatagggccggttcactttgatgccaaaaaaaacttaccaaattggcattgccaaaattttggcatagttaccaaaattttggtaacttgccaaaattttagcaggatttcttatatagttatcaaaatttgacagcaaactaaatgtagccactttttgtaactttaccaaaatttggtaaggttggaaattgcatcaaagtgaacaggcccatagtccgtcatagtcccatctactctcttcatcctaaaaaaaccagtttgaatctggacatacactgtgtccatattatagatcaggattagattttttttggacggagcaggtatgttggttttattttttgaacggagggagtataacatattaaatctaatacacaaacttttatattagttcactcttacacatcttttattttgtagagactgccccttatataaggacagactcattttttttccttaacttccctcctctattatcatctaattttatgtgataaatttagagacaacatatagaggtttataggtttatagtacttgctctaataaccccctggtgatcgtcagagattgtctctcctcactctacacactcacgcgcacggagattgcaacagcacatcgaatcgcccattagattaatcgaatggatcacatggctgcagcctaattaaagaggatcggagcgcatcgaggactgaatgctcccatccacggtgcactactgtttctagattctgacggcaccggattactgtagctttgctcgtagtatactagtactagcaagaaacggcagaaatgcttccgatgcctcacagactttttcctcttcttcttcctgctgctaatcccaaaggagacgcacatgccagccacgccgatcactcatggctctcctacccctcggccccctgctctgctactccgaaaaagggcagagaaaaacaacacatggcacaccagaggggagggatcgggataacgtttccaaatcgataattcgatgcgagcttgcgatctgtagggggaaaaaagaaaagaaaagaaaaacctcccagctgatgcgtgtgggattcagatctgaagaatggcgacagcaagaagaaacctggccctgacagtctgactgcagatgagtgagagcagtataatagcagtctataagcccgctataaatatattttaataagataatagagaagagagaagagtagcgggctacagatatgtagtcagctgcagcacggactccaaaacatgatgtgcgtatgacaggtgggaccagatattaatagtatagcaagcaactattgtatgaattggctattagattggttatagatgaattagagttagtagtaggctgtactgttagaacttgctctgatgaccatcagctaaaagctcggtttggaaacgtgtgttttggtttaccactgttgctagtaggcctcttacataattaataactgtgctgtttagagcacaaagttacgggggttagggataagattaaggagcccgagacatacagaacggagagtagtagtggcagcagtgcagcactctcctacccgtagctatactatagaaaaatggcttggaaaacaacggaggcatgtgacctgagacgaaagcgaggactttttgtcttcaccaccgtgatgtgcagcccatctctctcgtctcctcggagcacgtttgtttatgagtcgttctcgcaaagacgagagagctccgtacgtaccagtggcttgccatgctgctgctgcagctgcatgccacagtgaccaactcgccatgggcgacgacgacaagggcgcaccaatttccgaggcttggggggtgggggcgagtggcaaaaggctgtggcgcgacgatgagatcccaaggacagggacaggtcaaagctggctttgacggatcgggccggtacgtggtgacactgacagtgtgagggggtggggggccccacgtcaagtgccattatttgtggtttttttgtactcgtacgatacgatcgcgctcggtccttcgctgtcgcgtcacgttcgtactgtaggagtacgtactacgccgtgtgcctgggcgacgtttgctgccgatccatgtaccggccggagtactgcgggcaacaggcgctgtttgcgtcgtgcgtttcgggtactactagtagtagtagtacgttaaaattggtaggagtacacgtacgaacagtgcaggcacggggctggacactgtctgtcacgtagtactacgtgcgcagacgcagaaagaaacggagagtgcgggtgcacggaacgcgtaggtaggcgcggggaatcgataacggtggccatggccggccatggcaacgggggtggatgctttcgcagcagcggaggctgatgcgacgacgtacgcgcgccgtatgtgcagcctcgggccacaggttgcctgcgcgttgtgcgactgtgcgccccgtggtttttcccgtcgccgctgtgcagcagcccgtgcatacccaagttcctgaactctcggaaacaaaaaattttcaaatactaaaactttcaaattacaaatcataaaaatctcaatcctaaaatcaaaaattttcatctaaatattcaaatgctcttctcctttagcctcaatcgttgttgcttcatctctcgagacaccaccgcatggccgcatatcccgcatagctagggttgaggagctatggctaggagagagaagaggcatcgcacggctagagaggaagatggggagggaaggagaccaaccggaacagagatggtgatgaggatgatgacaaggacaacaacggtgacacggtgatgtagtgggtcgatggataatgatggagacgttctcgctctaccaacgccaagaaagagggagcgaatagagaactaaaagaagaggaatcagtcaacttattcttttcattgggctaggcgtgggcccaatgcaatgcaatggtattaagatgaatacccaaaaatatttgataaaataaaatatgtttatatagtatgtgatgtatatgtgtatgaaaaaacaaaaggataccatatatattcaacaaagagagaccatatatctattatctatttctattatacctactgtttaaaaaataagaggtgtatccatcgtacgtaaaaaaaacgggcgaaaaaaccaaaagaaaaagaaaaaaaaggcgaaaataagatgtttcctttgtccgttaaaataaaaaaagtagcgaaaaaaacccaaaataaaaaaagttcgatccccctgtaattttcgttcgtttttttccctttttcccgttttattttcttttcgcgtttcttatttttttcagcgtttttccctttttttttcttttccttttttcgttttattttctttttgccgttttttcccttactttttttctttgactgtttttccggttcctttcttttatcgcttttttttgcggtttttccatcgggccaaactctaccgccgccgccacgttgatttgcctccctatatatttcatcctccaattcattgcaaaaaaaaaaccaattccccgctactctcacatcattttccccttgaattcctctttcaattcggctttaattcaccggattgaatctccatttaatcctcgtcattttttatcccgagttttacagattgcttcgattttgattaaaaaaacagaaaaaggaggttgagtggatcaaaatccctcaacaatttttggagatggagaaacattcgaccaaatttgatggagaggatcggctccgttattgtacgggcactagactatgcaagaacaattttggagatggagtaagattcgaccggatttgatggagaggatcggctccgtcatcgtacggacacgggactatgcgagctcgagcggattaccggatatgggaggagctcgagcggattaccggatttgatggcaggatcggcttcgtaatggtacaggcatgagactgtttgagctaggcctacagctccactcgtgggctgagccgaagagaggtagatcgagcagagagaggtagcggactgtgctaggactggagctgaaaaggaaggaaggaataagcatctggtctaaaaccaagaaagtatcgggtccaaaactaagggagaataatgtataggataaaaaacgtttttacctgttgcaacgcacgggtattttttctagttcaaaatataatacataagtagcttttaactgtatttttttactccatcacactttaaatacacaacctgctttgtgcagatcgttcagaaaaaagaaaaacacgacctaacgatcctagggctgccccttgccccctgctcccagcaatatgggtcttatgggccgaaccgtgcgtcggcaacgaagctagcgcgtctgtgtgaaataggaataagttcatccgaggtcccttaacttgtcaacgaatccgattttcgtccttcaaccggaaaaccagatacaacgggtccctcaactatcaaaaccagtgcagatgagatccctcggtggttttgagggtggttttggctgacgtggcgcctacgtggcaaatttgacttggtcttcatctgatatggcattgacgtggcgcatacgtgtcaatttgatccggaaaaaataataaacttcgtgggacccacatgtcagtctcatacataaatcaataaaagaatggtggggcccacgtgggccccacaagtccctctcggctcttgtttctcttcctcttcgctctccctcgtcctcgcggggagcggcggcaggagcatgccggcggatggagcggaggggcattggggagccggcaccaggccgcggaccggtggaggttgccggaggaggaagagggcatatgaggaggtccgccggcgagcgcaacagctacactccgtcagccgttccgcccgcgatgccaaaccggacggtgccgcccctcctcgctcggtacccacacacactgcctccctcctcgcccggccgcctccgccgacgtcctcgatggtcacatccgggtcgaagccgcgcgtcgcctctcttcgctgggccgtcgagcaccgcttccctcctcgctgggcccccgagcaccgcctccctcctcgccgggccaccgcgcgtcgcctccctcgccaggccgccgcgcgtcgcctctcctcgcccggcccccgcgcgccgcctccctccttgtcgggccgccgcgcgccgcctccctcctcgcccggccgccgagtgccgcctccctcctcgtcaggctgccgcgtgtcgcctccctcgcccggccgccgcgcaccgcctctcctcgccgggccgccgagcgccgcctccctcctcgccgggacgccgagcgccgcctccttcctcacccggccgccgcgcgcggcctctcctcgccgggccaccgagcgccgcctccctcctcgccgagccgccgcgcgccgcctccctcctcgtgagccgccgcgcgtcgcctccctcgcccggccgccgcgcgccgccatccctcacccggacactgcccggccgccgcgagctgccatccctcacccagacactgcccgccgcctcggggatgggagaagggggagagaggaggaagaagaggggctctagttgaagagagggagatggctgagaactgacatgtggggcccaggtgggccccaccattttttattaatttatgtgtgactgacatgtgggtcccacgaagtttattatttttccggatcaaattgccacgtattcgccacatcagatgaagaccaagttaaatttgccacgtaggcgccacgtcagccaaaaccaccctcaaaaccaccgagggatctcatctgcactggttttgatagtttaggaccccgttgcatctggttttttggttgaaggatgaaaatcggatttgttgacaagttaagggacctcagatgaaattattcctgtgaaatatgattcccgcatacgagtacgagatacgatctcatcctttggtaaatgatcttcttgtgagatgtttaagatcatcagatttttttttgtttccttagatcaaagagaagatcacgatcacggcgggcagtgacaacaaacgactaggcccacgttagcccatctggcacagcacagcccatacgacgaccacacatcaaaaggaaaaagtacaccgaaggtccctcaatttgtcatcgagttacaaaatcgtcctccaaccgcaaaaccagatatccgacgtcccttaactaatcaaaaccggttacaataggtcttccagtgattttgacccggttttatcctacatggcggctgaatcagcatgagacccacgtgggacccatatatcagcctgccacgtcatctctctctcccatcttcctcctcctctcactctcttactcttctcttctcttctcatgttctctgggcaagccggggaggaggccgccagggtgaggccgctggggaggagcacgtggggagagcgaaggaggagcttggagagggctggctgtctcctcgtccgacgcgaggcgccgcggtggcggcaagcgatggagggcggtgggcggcaggagtggagctgggcggcggcggcggctggcgggagagggcggccgccatggcctgccgcagaggtggcccgccacccacggatgaagccgagtcgtggctcctcagggtggcgacgtctcgcgctgtcgcgcaaggtcggcggtaaaatagctatattcagtaatgcttgctcatcatacgattctactgaatatggtttcaaattgaacagcatgaaggcagcaaatctcctatgcttcaaccccttgtcgttgctgaatcttgttatttcaccatgctactcattagctaaatagctagttcctgtgagctgttgtttgtcaaggttggcatggtgcacagtagctactagctagttctagacgattttaatttcttgacggggaatattacaggtggtgtttgaatttcatgaagataaagataaagtgtttcacgtaaaacgaggtggtaataacgtgtgattaattgagttttaattgttacaaacttaaaaaatatattaatataatattttagagcaactttcatatagaaagttttcgcgcgaaacataccgtttagcagtttaaaaagcgtgccacgagtattcaaaatttcatccaactattatggttgtgtttagttcagcgcaatggattttggttgaaattggagatgatgtgactgaaaagttatgtgtgtatgacaggttgatgtgatggaaaatgactgaagtttggatccaaactttagatctaaacacagcctatatgatgaagaagccgagaacagatcagattatagtagcagtatggaacagtagttgtgagatatccaccttcccttcctccttttgactgaagtagcaagggactatcagattatgttaaaaagtgtgtcacgagtatctaaaatttcatccaattattattggagaaacgaacacagcctatgatgaagaagccgataacagatcgaattatagtagcagtatggaacagtagttatgagatatccaccttcccttcctccttttgactgaagttcaagggactatcagattatgttaagatgaaactacttactccctccgtaaaaaaaaagagacaaaccctggtttccgtgtccaacgtttgacagtctgtcttatttgaaaaaattatgaaaaaaataaaaagacaagtcacgcataaaatattaatcatgttttatcatctaacaacaataaaaatatgaattataaaaaaatttcatataagacggacagtcaaagttgggcatggaaacccagagtttgcctttttttgggacggagggagtacatatatgtttttttttttgaaaatgtagttaaaactacctgcttcctcttttttagttgacactgttgatttttgacttgcgtttaacaatttgtcttatccttttctttaaatgcataagatataaatcataattaaaatatttttagtaataaaataacttacatcaaaatatgataattatgcaaaaatattaataagataaatagtcaaatgtgtatccaacatcaatattatcgtggtatatgtatatcataagtacgttgtctgttcacgtgatactctaccagactatcacagagacgtataacagataacatgcaaggaaaattaataatcgtgctacaggctacagtatatactgagcactgaacagtgagcatgccttcatatattatcaggacgatatacatcgttatcagaaaagatggccatgccaactgtttctgaataaatctccgttatccattcaaaaggggcaactgaaaactccagcgagttgatattaatattgcgaatatacagtgaatcgcgcacgtgcagttagctagaagatggagcaatgagtcgatgtccacttgccataaattaaaacatctctcttcgtcacatatatgaaccataaaccaaccggcgaacaattcaaaccatcaagttctgctttgtacttctgttagtttttgttgggtcaaaaggctttcttctgcaaaaaggaaaaacgaaagaaacgtatatactacaaattcctgatcttgttgtcatggtgatgtggactagaaaaaaaaataataacaggataggctcgaatgatcgaggagtgaaatgaagatgtcaaactcaaacgatgagatcgatcgcttcatcatcaggccgtataaaaattggacactcggcctggcgttacgttgaatttatgccagcattggcagcttcaagttgaagcgatatacagtgcttaatttcacaagcaaatgatggccaatgaatgtcgctgtgacgagttaattccggcaaataattatagagatttcgttaggtacttctacagcgagtactaatttgagttcgatcgccacagcattgggaagaagagaaagcaactgcagctgcaaagagagaaataattaatagccgtacttcttaagcttcattcagctggcattcaagcatgacacgtgaagtacttgttcatccacggaaaattttgttcatgtgaggagagaatttcgggagaaggcgtttggaaaatgttgcttgcataatttgacaaagactttcttccggagaccctttttttttattacgacatgtttgcttccttgtatcatgcctccattctcttcagaccgtgtggtctcttgagatggtttcctctcctactgccaatttcgcacgcgaaagaacaaagtacaatctccgtttgaaaaggtaaaaagcaattacaaagaacaaatggaaattcccatttgaaaaggtaaaaggaaaaaggaacaaatcaaagtctctatatgaaaggtaattaggtaaaccatgtttctgttggaacttgaaaacggaattcgcaatttcgatctaattaggcatgttcactgtaagataggaatactagtaaccacaactcactttatcctaaaataaaatataagacataactaccactaacataaaaccaaaaaatgattgctatcactttatcatttagataatcttaataaataatatgtatttaccttattttttcacgaaagagatattgagggtggaggattttttttaaaaaaaaatgttatggaaggaggaattgttacttaattgcatgtatatgtgcgtgacttacattataaaacattgaaaaagatagttgcattgtatagtttgaaatggaagggtacttattaaattttattatccttaaaggaatattccctcattggattcttcttccttcgtcatctttcgtcctaattaggttgttatattttgataggaatgaagtaccttctattttattaatttcaaattttaggcaacgaaatctgaacgaagttgtgtgacccaaactgtcgacgtttgatgtcgcgattccggtatttgcatagtatggggatcgttggtactaggatatatgcgagattgtagtaaaaaagatggggacgaggatttttatacaggttcgggcctctgaattgtcaggtaataaccatacttctattggctgaagccagtcgttgctcttattcaccatgatcacaccagtataatatttggggtagcctatctaactgttgtcgacttggcggtctgaagtgctgactcgcagtcgacaacagggtagcattcctcctcgaatccgcatccggcgaaattaaagacagcgctatgtctctcctgacagtatccgtagacatcttaggggactagccatgcttatctctgaagtcgatatccggcgtcttgtcttggcgcatgttagcttgtatgttgatcttgtgttttgatctattgttgcgtcccccctctcctcctagggggcattgtatttatacccatagatgt

SEQ ID NO: 75342 - DNA, 1763 bp, Oryza sativa
aggtcttgaagggcatggagaagtattttgggcttagtgttcccttgagttggaaaccagcacccccaatgatgcatggtttgatcttatttggctagggcttgaggaagaagatgcggcggaacaaggcgaaatgaggcctaatgcccagaaaagcttcgcaggcatgaataaaattggcaatatgcactatggagtttggattcagatgatgcaagctaatcccgtagaaattcagaatgccccggaaaaatcttgaggttggaagagaaaatccgccatagaagaaatgagcaaataccatgatttcgtgtgtatcgggggtcaggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtttgatttagtttgagatacggctggaaagggatggggaatcggagcgatggatgcggggagaaatttcgtgaagtttttgagggtggatttgagcggattgatgaaccctagtttgcccggcgcagttttgcactgtagcaggaaatggggaaaatggcgagagtctcggcggggaagacgaagagacgtttttcacttcggtattattagggtatcgggagtactaatgggcctgggcctgtatagtatttcagcccaatactataatcagcgtggcctgttgtgatccctagggacttaggcactttttgctttggtaatttatgttcacaatggtgtggcctaatgctgttaaaatcctttttaacgcgatttaataattctttggaattattatgatgcacataaaaaggtgcccgacagaaaggtgttataccattttttgtaagctttattaggctggaaaagctgattgggttgatttgagatgactggtttattaatagtcattcttttagcatgttatatgcttattttggttatggtaagggtcacagcctaggctattagactcattaattaccatgattttctatcatgtttggtgggtcattctatgagatttttactcggattcctatcaaacatgtctatttttggacctttgagtgtttatcgctcggcccttcttgtattttttgtccttgatatgttcaagttgagcagcagtcagctgggtatcgtactaagtaccatgcatgcttcgctataaaactactcggttcttgactatatgtttagtttttcaactaatcacatagtcgggggctacacctaattaggtgcatctactcgatgcaccatgttttattttcgcccttcacagtttttgatttctagtactcggcaagctggagcaagttgaattgaagcactcggactactgttttttgtttcgagaaggttatttcgtcaactgcgaaggtctcgggggctactgtggagattatggataccccatatctgcatgacagttatactttagtcgaatatacggtaccaaatatagatggaatatctttatgaggactcgggttggattctaaacttgtatgtcaaggaaatacccgggatcctagtcggttacgattgtattttatctataatcccatattccgttaggatatggactgtattttgtaaagcggactccttcccctatataaggagggtccatgtgcctctcgggcgcgattcttttttccaatttataca

SEQ ID NO: 75343 - DNA, 1055 bp, Oryza sativa
cctcccggggccgaacctgatacggtgaagtcgtcccccttcggcatatgctcttcgccttgcgtccttcgcccaggaggcctctagcttggctgcgattccctgcctctcgccatccttgctccatagtcttcgccatgggggggttcgccttgactaaccctgacgtctcgggctttaatccccattggtcgcatgctttcggcaggtttggtcgaagggtctcatgccatatcgccaacatttggttctttgcaagttttggtactaccaacaatttggtataatatcacattgatttagctataaattggcttcaatccaaacaatatcaaagcactattaaagttgccaaatgaattcgtagggcacattttggtagcaaaccaaaatggccgctagatttcaaaaaatattttattaccggaccatctattagaattattatcatctcagtcaccatcttttttcatgaaaacaaacattgagctatgtattagatattagtcagaacagctaactgtatgcccaactacttacaaattagttattcttgtttagtaaaattactccacctataatcgaagggtcatttcatataatgcttgtcaattgatgaatcatgagcatagtattagaatatttcctgcctaccatgcttcaatgctacaaaactttgaaatgccattacgtgattcttagattttgtatctcctcactcttacggtcttcgtgcaacaggagtcatataggtagtgttggaacttagaaacactggaaactgaaatggattaagcaaaatgccgactttgtctggctgaatcaaggaatggaatggaaaccctttccatcgtttggttcgaataagtgatcatccatgcaatgaacatataaacaagcaattcaccacataaatacgaaaggcaagacaacaattcagacaaaaaatcacaagaactagatctgatgtgtacgttggcactcggcagattactgatttccaaggtgggacataccagatttctatcacgctgttatttgttaccatgtatttg

SEQ ID NO: 75344 - DNA, 3998 bp, Oryza sativa
caattgttcacctatgtctccagttccaggacccaatagcaggaatcgaggcctcgagaggataatccgcgaaaagccatggggaaaaggctccaaaatcgcggagcaatcgaaatgaaagccgaaaatctagggaataatcggagaccaagaggctccctcggaaaaacagcccaagaaagaaaccgagttccagacttgcataggtaaatcaaagcttagccagctcctccaattcatcccccacacaaggaatgaatccatcctcgcggaaaaatattcagcaaaacaaaaaggggaaaatcccctccaaaaaaaaaaaagaccagaacaatcaactcacccagtccaaagcacgcggcgcgaggagccgaggacccttctccctatctctccttcccggaccctgcggggcggagacgccggcccagcttcgggcctcccgaccccctcctaaacgcgcgcggaggcgggaggcggagggggagggcggctcgatcgggggggggtggacgcggcgagggccgagaggaggaaggcgagcgaagctgtttgggtgggcgtggcgtggcgtggcgcccgcgcggaggtggacgcggctcgcgaggcgcgagtgcccggcggatgggggcgaaatctttttttccgctcgtcctggggcgtggcgcgggatgtggatagagacgacgacgacgcggcctcgcgggcagctttgggctggggcggcacgggacggcagaggcggaggtgttttttttttttcttttcttttaactcgtgtgtagtgaatgtgatcgtatcgtatcacgccaacgcgacctcgtctcgtgctatcgagagggcagcgcacgtgacatcgggagtgtagcgcgccctcgtggcggagcaaacaacgacggaaacgttctagagtactccttcgtcttatattattattagtcattttgattttttttcttaattgaatttgtttatattttatcaagtttatgataaattgtagtactttctcagtcatataaagatggttgttttgcaatttataagatgtcccaaaaagtttgtcatgttagtttttcaaggtcattagtacttctaaagaattattctggtccacccatttgaattgagtgcaagtaaacaattcattgtttttctcaagcattcagaggacaacgataaatcaagggcaatttggtaatttatgattgtgggctaatttgtatcaaaatctttaagcaaaatttgctacaggacaccgaaagattgcgacctttattgtgggacactcgaagatcgtgtatttgctcgtggacactaaaaaaagtggtaattagctactagacactcctcccattattttattatttacggtcaaaatgaagagagaaactttggttaaagataagtttgcccatggtcccacttgtcaatctctctttctctattcttcttcttcctctttctcggttcatctttttctcgttgcgccaccgccgagctgccgagctccgccacggctgagccgtcgtgtgtcgtcgccgttccgtgagcactccctctccagcctcctcgctgccctcccctccagcaccgcgcacgtcggctgcctcagcctcacccaccggcacactcctccgcgtcgtcaggaaacaccggcaggtccaccactggcgccgtggggtgcaccgcgcggggcgcggtgggcacgtacgcggcgtatagccaagcgggagcgtgggggtagacacgccgccgtcgtggagtgcgtcgcgccgggcacgccgcctcctactgccgccagcagcgcggtgggcgtgtatgtagcatatagccaggcgcgagggcggggcaggatcgcagccacggcgggagcacgacacctccggctgcgccccaacggcccgcgccggccgttgcaggaagcgaggacggcggggaggagaggcggggacggggtgagctggcagacggaggtggccgtcggtggtgaaccccggcgatgcgccgctgccgccgccccaccgtggtcgagccatcccggcttaggccagccgcggtcgcgaggaagaatggggaaaagaaaaggagagagaggaagaacagtacgtgtctaggggcattttggtacttacacagctctttatctctccattttgaccggaaataataaaataatgggaggagtgtccagcaactaattaccacttttttacactgtccacgagcaaatacacgatcttcgggtgtctcacagcaaaggccgcaatctttcggtgtcctatagaaaattttgccaaatctttacaacgtcaatctttgtgggatagaggaagtgatatttgtaacacaatacaaacatatattatcaaaaaatatatccaataccaaacttagtgaaactaatttagtggtttagacattactaatttttttattaaatttgattaaacttttttaaaaaaccatatcgtaccatcgaaggtggcctcgtgcgaagcaaaggacggaaatgatatagagtaacataaatagtggtaccgttagaccattcacactatagcggtatggcatttggacttaaccatctatgcgggagactctcctccacgtacgcaattttccttccccaatgaagacgctcggatccctgtgaagaaagggtggctttgtcttaacgcatggtaaaagcgagaggagacagaaaggcgtacgatgggaaagaatgtcgaggggaaaaggtgatgactagcgagggggataggcgatggccagagtgaggagaggcaaatctacaacaaacttaccaggaggatccacgccatcgctaccatcatcggcctcgaagctcactggcaggagctgcctccgatccatctcgtcacgatacttgttgggatgatctactcgctactgggcccccctatctgatcgtcgtcggaccacactgccttcctagccgttctcccgtcggatcaacgtccagcactaccagatcgaggagaaatgaggttgcatagcttccgtcgatggcgaccttggtgaggaagacgaggtcacacagctcctatcgacaaggcggaggaggtggattggcggtgaaggcacatggttgacgctcatcaccacctcgccggcgcttgagtcattcgatggtggtgagcgagaagaggaggcggctgtgcacaagaagagagaggaggggaacagacggcaaaacaaaggagggggtggcaacggcgacctgatctgttcggcgaccttggcaacgatgatgtgaggtggccagaaaagggacatgagcaagattcagccagaaaagtgaccggaggaagaaggggatcatgatggaagagagagagggggggggaaatagaggagagggtggcacgtggccacgtgggttcaccagtaggttgagggcacatatatagacttttttttttgttgatatagggtttagattgtaaagttttaattaatttgctaacaaaaataatataaggactaacacgataaaagttaggtgctgaatctaaaaaatattatagagtagcctacattatggagatagtatttatatttatatatcatatatagttggaaccaaaagtttgacatgcatataaccccttttttttagagtaaagggcagaagctctgctaatttcatttcaaaagaaaagagatagtgtttttacaagcatgtaggttacaaaggatcccagaatcccccaaatagcctttggatctttcgcatgctttgatatcaaccattcatgtgtcatgtgcatttaaatcccacttagtgtagatgtagttattactataaatctaaatatctattaaaaccatacatatcgcctagataaattataagcattagatttctctcatgttagatacaagtatttctaaatttttctactgcaacgtgcgggataaccacttgtttttaagatggttttatccatgtactacctccgtttcacaatgta

SEQ ID NO: 75345 - DNA, 780 bp, Oryza sativa
ttcctgcagcccacatatgagatacaaaatacgcaggtttactaactggaaagtttgatagcatcaataaagagtgtggaaacagatcgcagagagcattaatcccagttcagtgtacatattaactataaaaaatatgtagtttataataatataattcaagtatattgatgttgtcacggtgctctggcaaggcaccgtaagcccacagagccagggtggcatccaggtcaggccatagcaatgctacggaaataaaatataaaaaggaaaggagtagcgcaacacataaacagataaactcagctccctccctctagctctcatcctagatgaggaccccaggcaagtgccacccatcaccaggacggcatatgacacagcaacaatgtgacaacattggcatattgtctttcagattcatcgctctcagtagaaaatattatatggtaagaatcagtcacctagcatattccatacatttcctccatattatattacaacaggaagtggtttcataataagtttatgaagcaaaacaactgaaaaatagttcctacacaataaactttccaagaatatgtacactccaaagagaaattaatgtcattctttacaacaagaatcatgcatcatggagtagaatcacatcaatttattaaaacactattaagagctgcatgaatttcttaccagtgcatcagaattttgatcccttgtgccctttccaatagcatcagctaatcttgtcgtcaactgataaacaaataaaaaaccatt

SEQ ID NO: 75346 - DNA, 1187 bp, Oryza sativa
gtggtgtttggttggagggactaaagtggggctaaactttagtccctctcacaaaaacataagtccctaccatagggacttaatacttttgtgagagggactaaatttagtccctagttcccaaacaccccctaaaactaaagagtacatgttatttctattttcaaatgcatatactatttaacacaaaatcctactaaaattcacgattaatacaatctacttagtcaacaatcagttcattgtaaccacctacacgtgcatttgcacgggctgttattattatgttgtaaacataaaaattctagctatgtatcaaatatattgattgttgtttgaaacagagcagcaaagaataaaaagaaatctagaaaaataataagttgagtcgaagatgtgaacaactaatatttacatgaatgacactctcagccaatgcggaattgcagatgttacatgggggtacggttttcaagacaatcaaaccaactcccactctcatccaatgcggatgttatatctgtcaaaacctctccatgacaagcagacccaactactatctcggattctcggatcccatgtgggagccacatggatcaaaacaactatcaacaggtgaagagacgaggtttacctaattttgaaagttcggacatgggttttacccagtttggagttgagggacaaaaattaaaccatgcaaagtgtagagtgattggagatgttaatcatcaaattgttgcttcggcgggaagcttcaacatgccagtagtggtggctggtgaggtatagctctacagaacaacaagagggcttcgggctaacgtggtccctatggcagtacaagacaattaaggtaggcttcaatgacagttgatgagtgctgccggcttattggattaatgtgatggattagagctcccgttgatgcttcgagctcaggtgactgattttgatcgcctgacccaccatacaaataaggtcctggaggagattcagagattcatgtctgcccagaacatgagctaggggtggatctaacatgggacattggggttcagttgaacccccaaactttttgggagcaaacagactgttcttagaattaaggttaatgcaaatttctagaagagaagctatggtaacacaaattcgagaaagcgtgggtaaagagggatgagaaagag

SEQ ID NO: 75347 - DNA, 1190 bp, Oryza sativa
cttacattgtgaaacggaggaagtacactagtacagatccttccatctgtgacggcccataacaagactggaatttgcgggccgtcacaaggaagtaatctcaatcggaccgaagtttcgcccgattgagatatggtcgcacagccatagtatatcggcataaaactaaagcccgtcacggatgacactaatctgtgacggctatagtttaggcccgattgacatgagggttccatatctcaatcgggccctaaaagaagcccgtcacagatgagggtcatctgtgacgggctccaactagaggcccgattgagataagtttagtgcccgtcacagatgacactcttttatgacggccttttattaaggctcgatagagattacttgtatgcccgtcacggttgattgttttagggtcgttacagatatttgttgcacagtataaataccccccaccacctagtgtaactgtatcccactgttcactattttggtgggaggctgtagggggcgattttttgtcctttttccaaggaaaacagaaattaaattcctgtaggtgatcaaaatggatcaatcaagtgagtaatattaatcattaattgagcaatttcatcacgtcttacttttgcaatactgatattataatatgtgcctctaatttgttttttttattttgtagcaattgatcaaagttggatgtatgccaaaaatttgaaacgtcattatatggagtacagaaagggcgtaataaattttatgaacgccgcggaggaggatcggataagaagaaacagtgattacatgtgttgtccatgtgcagattgcaagaatgagaatatgtttgatagaggagaggacgtacacggtcatctgatacaacgaggattcatggagggctatacatgttgggtgaagcatggagagcaagaatcaggaagtggagcagcagcagacagaagtggtgcgcataatcaggaagatgaagatgagcatgacatgtttataccttctccattggacggtgaaatggttgatgtggatcacgatctgctgcaagacatgttacgtgacgttgaggacccagcccagaatgagagagatggaatgaagttcagcaggttggtaagtgattccgagacgcctctgtacgctggatgcaaagcaaaacacacaaagttgtcagttac

SEQ ID NO: 75348 - DNA, 2814 bp, Oryza sativa
tattatattcttcatttatttcctttaatttattttcgtaatattttatctcactttcttgatctaatttttccataaactctgaaacactatgtcttctattatctattatatttctatcagatgcttctgtttctaagtcatctgtggttctgggtttgtaatttataaatctaatgctggtatttcctttactattttgataacttatataattttcaggctgactcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttataggcatcattagatctggggctatatatgttatcaacatattctcattcatgtcaccttctaaaaatcctaatgctgctttatctattgtgtcccaccttttatctaacaaagttattaaaactttagctcctattttctttcttgtcatacctttgattcctattatatacataccttggtgaatatatttataccctgagtactttaatccattttcaaattccttggctacaatttttaactaactggctttgttaaaacgcttaactctacttctctagatattctgtataacccattattattctcaaaaaatcccatgcaatatattagttgaggtcttattgccttcagagtatctgtttgatatctttcgagctgtttgtctacttatgcaatatcttcaagctcatctatgtcttcttttttaccttttggtttatcaatacaacttaaagatttatcgtctctgcttgctattcttctaaacaaactcctagataggtccatttttatgaattaatagcttgagacgaggtaattatgcctgttgaagccaaaactatctcttttcctttactagaatttattatttctaataattctttgatataatcactgttttgtaatatcttattctgccttatcttataatcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgccaactatggtcttcaatgtgatttaatctacaccttatactcagattatctttggtagtaattatctttccaatattagcttctgaatttgatttctctatgatgactggctctgataccacacttatgcttcggacaaaaaacactgttcaaaaacactatttatatacatatatatataaatatacatatacatatatatatatatacatatatatatacatatatatacatatatatatacatatatatacatatatatatacatatatatatatatatatacatatatatatatatatatatatatatatatattactcggaaattaacggacatgttttttctttgatgtaataaccattgcattttcttcgtcggccaccgtcttccgaaaacacattttgccattctggtagatgtttgcacgccggagatggggagatgtgaagtaatgatttattcttttcatatcatttgattcattgttaaatatactttcatgtacgcatatagccgatttttttaatctaaacacatgcagcccttttattacgtatttgagcacaccatatttataattccatttctaagcatgtacatgtacaggaccacgtcaatccctcgatctaatgcctaacaaaataaatgtaccttttgcaaccttgtttctagcgataacgtccacaagttagaagcctggtaatgtaaactcatttatttgtaaactagtagcaatttcttaggtctattagcttgctatattcagtttatacttaaaaaatgtgtaacaatgatttgtaaaatcaaaataacatattttgaaccatacttaataaatatgtcaaacattaatacaaagtaacaaaactcaattcaatggcctattaatttgttagacattatgttatggaacaacacttggacattatgttatggagcaatgtctgcacttgagcatctcgtctatggattgaaatatgggtttggcgtgcttatatttggaattaaactgatgcatgtgcttacatgtaaaaaatcgggcacatatagttttatatatttcacaaaattttttaaataagacgaacggtcaagcacgtactataaagtcaacggtgtcaaacattttaaaacggaagggagtattatatataagcaattagggaatatagctttactagtaagcgaaacaattcactttgggcctacttgactgtgatgttgttgacttggaacttaattggaagtccttattaacgagagacaaagttacacgtgggctcagacgtgctgtggataaatcgcgccggggagtgtgtgctgtgattagatggagagcggggcggaggaaggcgagaaaggggatcacgttccgggccacacgtgggctcgtaatcccgttctgggccgacaactccaggcccaacacgtttgacggccgcgaaagcatcgaatttttttatttatacatttttt

SEQ ID NO: 75349 - DNA, 1909 bp, Oryza sativa
acaaaatataccaactttatatacgtatatatagaaagtttgttttgcatacgtgtatacaaactttgcatacgtgtatacaaactttggatacgtatatatacaaactttctatccgtatcttttttatacatgtatacaaacattgcatacgtgtatacaaactttgcatacatacatattaaaaaaccgaaaaaactgaaaaaaaatacggatagaaaaaaaacgtgcgaaaaaaaaccgtggaaaaaacataacaaacaaaaaaggaacgggcgggaaaaaaggaaaccgaaaaaaaagaaaccgtgtgaaaaaaaaaccgcggaaaaaaaaacagaacaaacaaaaaaagaggaacgtgcgggaaaaaagaaaaccaaaaaaaaaaggaaaaccgcgccgccgcccgcgcccatctccacgtgccacgtgtccagtcgcgcgggagaggaggcgcgcgactgatcgcctattagtgttctcgtctaaacaccccctaattagtaattttgcctagcactcaatccacccggattgcttgcacaccccattcccaccctacgcaaaaggttgaaacctaaaaaatataagtactaatcgcattctccaaatgaagccccatgggactagaacactctgatgcagagagtccttcactcaccgatagcacattcctcttcctcatcatcaagcaccgctgtgacccttcactttctacttccttcatcccaagccggtgagtcccaatgaccacgtgcttagtggttgtactcatgaatagggttgaccgcgccaccatgctatcgtggtaggcctatatcgacgagcatccaccatcactttctctatctcgagctcctggcttactcaattctttcgatctcctttcctcatagctcccgcttggatgacagtttcatgactggcgactgtcagtcaccagtcatcatcgtaccgtatgggttaggccgtgttgtgctattcctaggccatgttgtgctggctcgctcatgcacttgtcgtgttgatacaccaagccaggtagcagcccaagcacggtgtggctggatcggtcgtgccagcaaaacccatagccaaacggatcatgttgttcctgagttgtctaaatgtgtgtccagacagacacagaaagacacaacccatttgacaacccttatagggggatttaagcaaatttctagctattcttatgtttcttttgatgagatcaattacgacacctcagtcgcacctaattaatttgattggtgtcgaattaaagggaacctttcaaaaaaatttaaagatgttctcttccataatagctgacggagcgtgggggctcctcaccagaagaccgcgcaggcccccctttgccggttcggccgggggcgctatgtgaggttcttcgccctcgatctgaggaatgtcagcgagaaggagcgcacaagacacgggcgacgtagacaggttcgggccgctgagaagcgtaataccctactcctgtgttctggtggatctgtgtgtgaagagagccaatacagagagctccagagcgagagagagttcagcctctttctccttcctcttttttttctcccctctttcctaggcctgggcctcctttttatctggtccggggtcaccacaagggcctcccgctacctaagaaaggaaacatgctttttacaatgagggctaatctacagccggaaatgacctctgacaagcagtacacacgcctcctgctccgctcgtcagctctcccggtggacgcccgtttcaaccttcattcaatggccagcgactttcttgccatgcttgcgctgaagcctggaatggatctgaccgggactgacataccaactccaggagtcagcacgccagctccggctagagacgagag

SEQ ID NO: 75350 - DNA, 3672 bp, Oryza sativa
ctgcagcccactatggaattgttggatcagtgtggaattggattcacacctccccctctattcaaaatcctcaaaatggatttaggttgggctcggggtgcatggttttgatagtagcacctcggccatataaggaccggtcttcgggcctctgttgcaaagcactaccgtacttccacatgtttagtgggtaaggcttagtttgtggctcagtctggttataaacaaaagtacacggatggagatggacgaagtcgggggtcgatggacatctctagggcaaatgaaggctacacgagctgcggctcggtagtcgagatgtcatggcacagggccggtgtcctgctgctaggggctcagtcctgcctacctgtcccggaggttccggccgtaggtggggttgggtctgtactcttgtctatggctaggatgggttggaaactatgtcacgtcttccgtccgtataccgtggtggtatgtggcacgtgtgatgaaccctgagttcctctcgacactcaaggctgttgttggcccgatctttcggtgagttgtgatatctacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatggaccccacctgggccggggtcccaaatgaagttacaagcccataggcccattataggtgatgcaacaccttgttcctgtgattctggccacacgagatagaattcagagaagaggctggatccgttaaaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaacgtggttacatgtgaggaagatgtgtcttgtgggtaaagatgtacacatctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcagtctgaatcatcgtaggccttgggttaaggcaggttcgtgtgggttcacggccttgattaataatattgtatagctctaggatcgtatttacaaaatagctttgagcaactaagtgtcttttaatgctgtttgctgcaaaccctaaccctttatattataacccccttgtactcccttggatttatcctgcacttgtgagtgtgtcttgttgagtacggtggttgtactcagtcttgctcaattttttcccaaacccagaagaggagcccctggataatgaaggctttggtgtctagctcgtgcctgccgtcaagcgcctgtggtcgtcgccctagtcttccgctgtttttcgtttgtctttttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttctggtcgtgacattttgtaacgaacaataataaatatgggaattgatttagtatgagcgagcgcgtcggttacagaattaaacaccgtggttgatgatcccgaacattactctcgcgctcgcacatactctctcgttttgtaacggacaataataaatacgggaattgatttcgtatgagcgagcgcatcggttacagaatttaacaccacggttgatgatcccgaacattactctcgcgctcgcatgtagttcgtctcttgcacttatgttcattgtggagattatggataccccatatctgcatgacagttatactttagtcggatatacggcaccaaatatagatggaatatctttatgagaactcgggttggtttttaacttgtatgtcaagaaaatatccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccaccccttttattattgccgaaatcttgtttcaacagttggcgtgccaggtaggggtagcgtcaagttctcgccgactaagtgcgatgggctttgtttctggcatcgacgacttcgccttccctctcgggcaggcgttccggttcggcagcctcaacttcatcaccaacgacttcggcaagatctctctccttgactcggattcaaaccagtcggggagagaccaggtccccgtgccattcggtattccgaactcggcctactctaagatcatctctcccgagtcggcttcaaaccacttggacgagatccaatccgcttttccgcgaccagatcaagacgacgggtcctatccctcaatcctgatgaaacttcctgatgatttggccgctgtcttcacagtcaagacatctcccactcgaagatctaggcgagctccggcttcggccccgatccgatctagatccagggaggttggcgttatactccaacctcttgggacagtctcgacgtatgagatttttactcggattcctatcaaacatgtctattttggacctttgagtatttatcactcaacccttcttgtattttttgtccttgatatgttcaagttgagaagcagtcggctgggtatcttactaagtaccatgcgtgcttcgctataaaaccactcggttcttgactatatgtttagttttttaactaatcacatagtcgggggctacacctaattaggtgcatcgctcgatgcaccatgttttattttcgcccttcgcagtctttgattttagcactcggcaagctggagcaagttgaattgaagcactcggattactgttttttgttttgagaaggctattactgtcaattgcgaaggtctcggggactactgtggagatgatggataccccatatctacatgacagttataatttagtcggatatatggtaccaaatatagacagaatatgggctgcaggaa

SEQ ID NO: 75351 - DNA, 584 bp, Oryza sativa
ggggtgtataggagtatagttgcagagctgccgacgggtgacgggacttctagaaaataaaaaatgaattccaacgatagttatgttcaatttttagaatcccaatgacaataaagagtaggcggcggacgggccgtagaggagcatagtggcatagtttgacaagacttctaaaaattataaaaaaataaaacccaacaagacaataaactctataaactacaaggttcaatttttgaagtttcggaacttctaaaaagtaaaaaaaacaatgatagtcatattcgattttaaaatctcaatgacaataaagaagggaggcagcgggcgagccgtagagaagaacaatggcaaagtcactgacggtttggcgggacttctagaaagtaaaaaatgaacccaaacgataattatgttcgaattttaaaatctcaatgacaataaagagaagagacagtagacgggtcatagaggagtataatggcaacgtttgacgggacgtctagaaattataaaaatgaaactcaatgtgaaaataaactctaaaacctataagatccaatgtttgaagtttctaaggagaa

SEQ ID NO: 75352 - DNA, 699 bp, Oryza sativa
taccaagtgaatgaaaaggaggaaacctactctccttattttaggaagaatgaagtcctgcaaacaatgttgtgcgcccttagtaggaaagaagaattttaattattctcgacaaatattttctgttctgtgaagcaaacttacaaagtgtacatgatttcggagtaggtccaaaaatttgaacatgctttcgaagattcaaataaggtacaagtcttgtttgcttggatggatgaactggcaccttaatagttctaagctgttctttcatagcgttcatctagttaaatcaagccgttgaatatataagcaagatttacgtctttcgtcagaatgtaagacccttcaatatgttcccagcaacacacagtcaagcttttagttatacgcaatcaattttcgttggtccttgccatcaattagcaatagctaagttggttttggctcttattttgcattcatacaaattggcatccttaaagctgcaaatcaaatccaaagttctactggaaatatgctttgcgtaaactgttatagatcttggcactttaagtgtctgtatgtttttcaaaatggtgtgctctgttcctgctagtgatgtgcgacccaatgaagttatggttgtttagtaaaaaaagtagtagtgcttttccttaggaatagttgagaaggggatcatatagagtcgacctgcaggca

SEQ ID NO: 75353 - DNA, 5874 bp, Oryza sativa
tttttttgggatggagagagtacttgatttgatatacctggctcaactcaatcgtgctggatataattttttcccgggcaagttaccttatatttataacgcagtaactattaaaaacacagctatgcataggaaatctactagttagatattttctttcctgcttaatgaagtggcagacctctgcttctttaaaaaaacattttcttttacagaaatatatataaagatcgaaaagtggcatttcaagtcaccaacatactgatgcattgtttgtttggttcattgattagtgaaggcttgcagctgtgcagctgtgcgtgcagggccgacgacgagggtatgcgaagtgagggatcgaacagggtcgctaaaaattaggagccgcaaattttttatattttgatctatgccaacgtgtttcaatttatttaaaattctctcgctctatttttacaaaattttactctttcttatttgttgattttgttagaacaagcttatttttttcagctacaataagtgttcgatggcaatcacgaccaattcaaagagccgatgatatggacgtgtcttctgtgcattaaagattccattcttttttcttaacaaagataaatcactacatcatgatataatatttttctaatatttatcttaaaaatcttccgctacttgtttcttacgtatttttatggacctcaaattatgtttcaccggggccttaaatttctatatacggtcctgtgtactgtgcgtgcaatgctttcagctttcgtgccggtcagacaaacatgaccagggtgtatactggtagtcagacatgaacagttgttactctctccgtcccataatatatcaatctaatatctgatgcgacatttcatagtacaataaatctatataccctcctgtttagattcgttgtactataaaatattctatcaccctcctgttcagattcgttgtactataaaatattctatccggtactagattgctatattatgggatggagaaagtatattggattacagccccaagcggtaacaacagtaggctgtctaaatcgcggcatttcctttcagcaaaaacagggtactacttattatctcggagagacggagacttgaccatcactatcggatcaatgagctctgacgtgctcatgcagcacacaccacagaaaatgcaacagccaaacaacacatgtggccaattctcacacataacgataacatcccaatcacaactttatgataaacgaaagcttccattccatccagttcacggcaaagagattacccggtcagtcaaagatagcagctgcctcctgccgctatccgcactgacctctggagtccacacatccaggcttgcagtgatccgaatgccacagcaaagaagagaagaaatcaggaatggattaagtagcattttttttcagcaaccattcagtagcactttctaaaatacaacctttatcggttgtaaatcataaataaatagtgtaaaataaaatatatcactgtttacagttaatatttccagcttcagcattttaccacctacctacaagagctagctactagctagctgatttggcatcaaaacatgcataagttcactcatcctcctctaagatttcagttagcccagaggagaattggtaagaatccatcataggtgacatggactcatcatcacagaagaatggtcttggaggcatctgcaggccaacaacgccaccttcaagcatctctatgacctcgctcatcgtcggccgatcgtgagacttcatctggatgcaatgtagcccgattatgcacagcttcctctcaagctcatgcatgttagcaacagtagcagcagatatctcaccaacacccacctgttgctctattagccggtcatacacccacgacgggtagtaggcctgacttgagttccctgcatgcatgtctgagttccttcttcctccagccatctccagcagcagcattccaaagctatagacatcggatttgcttgatataacgccaaagctccgagatatcatttcaggagcaatataacctattgttccccttaaggcgttgagcggcacaaaactgttgtcccttgggtacagtttggcgaggccgaaatcagcaacctttggaacaaagttgtcatcaagaaggatgttgtgtggcttgatgtcaaagtgcagtatctgcatatcgcaaccttgatgaagatagttgatccccctagcaatacccaaagctatctcattgagtttgtcccatgagaaacttctcttggatgagaaaatgtacttgtctagagatcctcgtggcatgtactcctacacaagtgccctcctcagttcctctgaacaaaaaccaacaagacgaactccattcacgtggtggatcctaccaatggtggagacctcactgatggactcttcaccgttgcagttggcattttccagcaccttgacagccacattaacataacctgggagaacacctttgtataccgagccgtagcctccttggccaagcttctcaccgaagtgacctgtaattgcagtgaggtcagtgtaggcatacctcgttggtccaagcatcagttgcatacgaagaaacttgtcgactgcatcaattgttatcttatttctccaatacttgtgggcaaggaagatgaatactgctaatggggccaatacgaatctgcacagtactgcataagagcaatttaccataaaacaattatggattaacctagcaagaatgtagtaagacaatacactctgcgtctacaatgaggtataatgtaatgactctaaattaccagcagtccacttcaaaatcagtagggctgtgtgaccaccatgtacgtgtagatgaggttattatgtgatctatctccaagcaggaagcacgaccagaaatagaagtcaatgatagcaatattcgcaatcctttccttgctccctgtacctgtctggctacaagaccatggggtaaagaaatgagtaagacatggctaatcgtatttgagggcttgtttggattggattacagccatcgttaaccttagcaaaatattatgtgggagagtgaaactacattatttgacagattaactcaccggattgacagtgccaggcattctttgaagttccacccactaactgtgaaaggaaatcgaacggcaaatccagtcatcattagctttacaacatcctgatagcttacattctgcagcgccgacgtgctgttcaacttgctgccacccaaaggagtcgtggccaggtacccacaggaaggctcaaggttctgaatataagcagattgttggccagtaaacacgtaaacgaaggatctgctggtgctcaggcaagcgacgggcatgtacatccaactgctgttccttatttcctgcgaacaattgacaaagctagcccaggtaacccctactggaggtgccaattcaatgatgtggtgtgacttggcctggagcctgggatcacgaagaagggggttccagcgaggaagaaggcaactgctacgtgaatccaagaagctggcatcgacgacccacaaggtagaatcaccatagttgatgtcacttacagagtatgtctccttgtcgatctgaattgtagccttgtcgtctgcacaagttagctcgtaggattgaacaccgcactccggcgggtcacctcgccggcggaacgggaacgacacgtcactgagatggccgcatgtgaacggagggcagtcatggcgccgatgatgccgccggccacctgcagcatctggaacgagaaccccaagcacacacaagacataaattactcgcatgacagtagagcaatgcagagcaccatgaatcgcaattgccaggttcaaagaaaagcgcacaggtcagaacaagatggacgaacgacatggttgatattgcaagcgcttccgtgttccagttgaataagcaaaaagaaaaaaaaataatatccgaatacctgagcaatgacgtgtttagctaatcagggctgcctgcccttgactgtgatgctgttgactgagagtctgagacagattcgttcgtttaggatagcttaacagacatgtccatatattctcccttcatcatcacttccgaatacctgaacaagttttgctgcacctcgttggtctgggaagtgggactgaatggtactcttctgtcttcttctgtctcatcaacagcatctcagtcaagatcaggcaatgcagccgctggaagttacaccgaaagcgtgcaattacctgccaccaaacctttaaaaaaagattatcaccagtctctcctttaccaccataaagcttcaccatgtcaacttcacgagttgatttcaacatcaccaaaagaaaaaaaaaagtctcatgtactagctttagatgttatcaaggttattggaatagtagccggaataaatcggtagtgtaaaatcaagggcatgggggagccaaaaatgataaggaataccttttgaagaaatagaacacgtcaaaagtttcattggctctgctcagagcctcagacatcatagcaagcacagcatcaatcgtcaccgagaaaacaggtgaccaaatatttctaaagcacagccctctcatcatccacctccatctcatctccattgaactgcatggacttcaccaaccttcttatcacggtgctcctcctactctctcctctcaaatacgaatccgatgttgccacagcaagtgatgatgaagacttcttcaagacttgttcatcccagcggtgcagcaagcatggaccagagatcaggtacccgttccgtctttcgacacaacctccatcatgcggtgcacctggtatgcaattatcatgctctggacaagacaccatcctggatcaccctgttcttggttcctgcaaagtgaccatgatatattacaggcatgttatcatgaacgccattccacttgtagattccttacctcactgcccacttcagaagctcgtgtcagtaaatcaatcaactgctgtgtacaaacctcatacgtcggaagttgcaagtgtagtaggttgttcaagagattccatagacacaaaccaatatggtatagttggcccaacctcttgccccagcctcgctaacaacgcaagccagttctggtatttggcatatccctatacatacatgtctattcttccattgggctgcacaattgtttccaaagacatcccaatgccctacagttacgataaaaatggtccaaactttgacatctcaatcttcccgaaacagcaaaaagagtcatcagcactggtgagactgtattcacttggtacacaagtaacgttactagtatttgccaacaatgtgaacgtgaaggtcggcgttgtggctttagctctcaaaggaatcaagcattctgccagcatcatagtatgtctctttctcaagtataaattcagtttcattatgatgacttgttttagtttgaattttcacttctctatctattacatctcttatttctcgagtattcagttttcaaactatccaggatatttttcacaaatagtcaaactatctagcaaactgtgaatcagccaaaggctagcttggatgaacattttggttctaggttcacaactgcaatttttctcaaagaaaatttcatcaagagatgataatgtctgatcattatgaaaatcaatatttttttttgtaaaattctcatagaaaaggttataagcaatggcagcacattttagcagatagcaatgatctaaagagcaagctttatttgtattactctagacattggtattaacttagaacactaaattggattcatatgg

SEQ ID NO: 75354 - DNA, 2939 bp, Oryza sativa
taaagatagcgatctttagtcccggattcgtagtcccggttagataaccgggactaaaagggggttatgaaccgggagtacagagggtttctccaaaagtgtacaaatgtaatctacttatgttgttttcttatgtgacaagtttaatcaaccctaatgtgaatacagaggtataacatgacaaaaagtattttgtgcaaaacaacttgtatagttttcttatgtgacaggtttaaacatgtaacgtgatgttgaatgttacatgaagatattatgattttactccacacttgctagctactccctccatccaaaatgtaacttttgtaggaattcaaccaatcacaatcattcttatttaattcatcgacatacttttttttctcaactaatcaaaatatttcatcattcaatctcacatacttaattactttatgtaaaaacctctcgaaatgctttaaaaaattggaacaaaggtagtagttagtccctctacgaaaaggaaaaaaaatcttctaactacaatcgaacacatgagttaaacccgtaggttgattttttttttcccaggagcacacgctgcagtactcctaagtggcaaggatttttatttttcaagaaactttacatgagtgatgtgatgaatcatagtttttgcaatgtctccaataatgtttacttttcagttgtgcactgcacagattacactgtgttcattctgtcagacaaacgatgaaacaaacctgtagtaggtctgtacgatcagtcccaatagaaactcgacacgctcgttctctccttttcctttccagaggacgtcgacatgttcagtggatagaacaccgaactctgccacaacgtatactatccaccagtttgcaactgtaggacaagactacaggaaaaaatggtgaataatcacaagaacacccgatgctagacaaacacatattccgctcgaagtatatgttgtcttggatatgtttgaagaaaactttataagctttaaccatttttctgaatatttagattggatgtatgtttaaagcttacaatttatctaacttgagaagtacttttacaatatatagttttgtggggggtttgcaaatattttacaatagaaattactagtcagagttgcatcttggaaccctgatggaagtagatgatggtggccttagaaaagatatacttttaggccccaaaaattccatatggaatttagaaaaacagtttaatatatgtagaaagatagaaaatttccctattcctaaggccttattggttgtctggaacacataaatctattaacttattaaaggaatagaaaaagaaacctccacgttcgctctcacggcctagaaattctcatattaatcagagaaaaagaaaaacagagtccatatagaaatacaatttagaaatagctgaaattcgaaattaaaaataaggaatattggaagaggagactagagtccatatagaaatacaattaagaaataatagaaattcggaattaaaaataaggaatattagaagtagagtatagagtccatatagaaatttaaaactaactaaaattcggaataaacataataatattaaaagtagagtttagagttcgtataaaaatacaatttacaaataactaaaatttgaaattaaaaaaaagcatgggaagaagagtctaaagtcaatataggaatacaatttagaagtaattgaaattcaaaattaaaaattaaagaatattgaaagatgagtttagagtccacatagaaatacaattagaaataattaaaattcagaattaaaaataaataatattggaagaagagccttgagtctatatagaaatacaatttacagataacgaaaatacggaattaaagaaaaagaaatattgaaagactagtctagagtccatataggaatataatttacaaataactaaaatttgatattaaaaataattaataactaacacgtatataaatacaatatgaatattgcacattagtagtttcgtaaagttagtacaaaatttaaaattatgttgtcattttgatatatttgaataatacattgagaaaacatatattctattatatgagagaaaatataatgatgctagccgcgcaatctgcgtaggtcaccatgctagtttatatttaaaataaatttcagaaaactacaaaatttagcacctactttattacaaagctacatatttgagacggagcaccacaaaactacagattttataatcatttaccacaaaattatagattttgtgccaatttagtcacagaactacaatatttagaactccagcaaaacaatgatactaactactaaggacttaaagtctaaaatatgcagttatgtgatactccacataaaaactataattttatgataaaattgatgttaaaacgttagttttgtgatacattaccttaaatctattaaatctatagtgttgtgataatttgacctaagtatatgtagttttacgatatttactcttgtatttaaatcaccttgagaaaaaaaagaaaaataggtttgaattggaaaatttgccggtttctcattatttcaaaatctgtttggtcaagaccaccccaggacccaggaaatattgatatgctagtggactggtcatcatctctctctgtggaaagctctgttgtagctctactgtttatattcgaggatagggacggaggataatggaggatgtgattccattcttaaggttggcatgcctacaactcactgatccaagaaaaaaatctatgtcattagccatggtccgtggaatcgtggatacctttagttccggacacagcgctagctcctactagatctctgtcttcgctttggaatcaggcacacttgtgtctgcccatctgaaagcctgctagaaatgt

SEQ ID NO: 75355 - DNA, 2405 bp, Oryza sativa
gtgttcaatccctaacacgctcacaatttcttcttaaaaaatggttggagggacatctctccctccaaatctcctatttttttagaccttttggtggtaagaccatagtcctgattgttagaaagttgcacccatcgagtaatcaagaatgtaccagtataatttacagcattaacaagttcccacagtgttaacagggtagaaaccagaacatatccatcttacacaacgttggtacgaaagttgtgcacatgcatatttccagcgatgctctgtaagattattgaatcaggtaatttcttcctcctaggcactatagataaaaacgtcttacttctatggttaagacaagaagcctccttatcctatttctatatgacaatgccaaataaacaagccatctaacaatcaggaactaattgtttctaggaaaaattataggtgtttctctcaatttatttcatccataaatcatgtcataactaataatctttcttcatatgtccaggtccgcgtgtcacaatcattgcaggtaagcaactaatttttttcttcattcttcctgaactgctcattctgtagaatcattgccttttctccaagtgcaactagctaaatttctctctttttttactcagcaacatcatctgtgggcacatttatagttctttcattaattgtggccactgcactctacatctccttgaagtcaaggtacaatgaagagatacatttgaaagtcgaaatgtttctgaagacatatggcacatcaaaacccacaaggtacacattctccgaagttaagaagatagcgaggcgattcaaggacaaattgggccatggtgcatttggaactgtatataaaggtgagctaccgaatggagttcctgtggctgttaagatgctagaaaactctgtaggagagggacaagagttcatcaatgaagtcgcaaccattgggcgaattcatcatgcaaacattgtccgcctcctaggcttttgctctgaaggaacacgacgggctttaatatatgaactcatgcccaatgaatcattggagaaatatatattcccacatggttctaatatttcaagagaactcctagtaccagacaaaatgctagatattgcattaggcatagcccgaggaatggagtacctgcaccaagggtgcaatcagcgcattctccattttgacatcaagcctcacaacatactgttggactacagcttcaatccaaagatttcagactttgggcttgccaagctatgtgcaagagatcaaagcattgtcacattgactgcagcaagaggcacaatgggctatattgcaccagaactatattctcggaattttggagcaatttcatataagtcggatgtctacagctttggcatgctggtgttagaaatggtgagtgggaggaggaacacagacccaaccgtcgagagccaaaatgagttctactttcctgagtggatatatgagagagttatcaatgggcaggacctggtgcttaccatggagacaacacaaggagagaaagaaatggtgagacagctagcaattgtagccctatggtgcattcagtggaacccaaaagaccggccctcaatgacaaaggtggtaaacatgttgacggggaggttgcagaatctgcaggtgccccctaagccctttatatcgtctcaaaatcaacttgtgatttagatcatgagaccgcatcgccatggtttggactttggagaccagcaaagcaatggagcttggccagcatttcctataaaatggcatcaccatggttttgtgcctgagtgacagataatccacatatcataaaatagttcttagtgagctgaagcatgcacatatagtgtttaattattaaactaaactgcgcaaccaggtatatgatatatcaccatgtactcatgtaattctgatatccagcaaacatatgccaatggattttatttgcaatataataatagttgatgacaactaaattaccttattccatcgttgctgctagtccacaaatcatccttgctgaacgccacaataaagttgtggtatttgctctccattcccttcaacacaagagatcgatcccgcagcgtgtcatatttactcccagtgctgcattttcttttcaagagtaaaaaaaaaagtgctgcatcatccagaagaggaaaaaaaattaaaaataacaagggaagaaagctaagcaaagggattattaccaatgcagcgaggctcaggatggaaattgactaataatgtgggaaacggaggtggtgtgagggacttgagaagacgataccattgaagacatcgggcttatagattcgaccggatcttgacacggtagcaataacagatggcgtcatggcggcggtatggg

SEQ ID NO: 75356 - DNA, 7961 bp, Oryza sativa
atgtaacggaaaagttgaaagtttgtatataggaaagttttgatgtgatagaaaagttgaaaatttgaagaaaaagtttgaaactaaactcgaccctagtaaaatcaaatgtcatatttctattattaaaatgtatcacatccgatattaagtttagttttatgggatggaaggagaactaactgtgtgctagactgctaacaatacaaatgtcgttgtcacgggcggggaacaagagggatccagttctttggtaaaatcatttataaccgatcactgctctttccgtcgtagagaaaatcaatatgatgataatgataaatctgaacatagcctatatccagatttatatccagctttatagatagaaattggttttttctttacaaagcataacaataacataatactaggcacacatttacacaacctcgaaaaaatatgactgatcaatataaaacatagtaataacatagtaatacaaggcacataagagagtgtgttaaaaaataggtacacttgtacacaaccatgaaaaaacatttgactgatcaatactacataaagcatagtgataacatagtaatacaaggcacataagagatggtgttaaaaaaaaggcacaaaaaagatggttagtaaccatcaaacggtcatccaatcacagaacgcagggtgaaaagtagcagtactagtagtaaaagaccacaaaagtagttttttgggggcaaggatattgacccagatgatagcaacagcaaagacatctttcccatgtcaacctcaccgtcgcaatctcaccttatcttttccgaaacaatctcgcattcgagccacaggtctctcagttaagataacagcaactacttactgcccatgttaccttcatacagtttgaaaggaacaggaccagcaaaggtcaggttccaaatgaccagcagatttttccctctataacaacaataagcccttttaataattctagacagaagaaggcagaggaggagaggagaggaagcacggatgtatttacaagtctgcatcttacattgttctaggtttctctctaccaatacaggcaggtggctgaaagaatgatgctagccagagcacaaaacccaaggttattgcaaaaagaaaacctcacaggattgtgcggccgttggtctttctcttggcctcctcccatggcgcctgtgcagaccccatgtccagctctcctccaaccatcaatgccgggaggccaccatttgcagtggagccacccatggtccctccaatgccaagcccaaggaagtccagagtggcaggcttgggaccgtacagtgccgatggtcccatcatcaagtccggcaaccctgaattcccagtgtcataggtgagaccaaggccaagaccgccaggtagcatcggcccaggctccatttccatttgctggttgctcctatggtgccactgttgtacactgttatcggtgaacattcgatgtggcagcttggctggcggtggcggctgtgggacgttatccatgaaccttccttgaggcggatgaggatgcggatgtggatgtggatgtggatgagatgttgttggtgtgttaccagtagtgaacctcccttgggatagcttggatgggggagacgatgaggtggaggcggcgagcccaaactccttcaggaaagatgagcttgattgcgaagcaccaacctcagcagccttctgcaggagagcggttgcggacatgtgcggtgctggaggtggagcaaaggagcaggggtcacttgcatttgtctgtgggaagagagaagacggcgcaccaattgcaaggcagaggaatgtgggatcgacgccgatgagatcgcggagggatctgctttggggagtgctgctcgttgtgaccgacgcaaacagaccagcgaacgtgctcgtcgtcgtagctggagcgatagcattggtaacgctgcttcccgtgccgcagctggtgctgctgccatctgtgccaatggcctccgagggcgagggaaggaaacaaggcagcatcggagtgtcattatccagcaggtttgagtcctccagttcagcatctttgtatcgatccacttcctgaaagcaaacctcctcatctcgctcatcttccacctctatcttggcaatcactgctggcttagcaaccacctcttgctctgcaaatagatacaccagaataggatggaacatgttactcctcattgttcagctaaccgatcaaatgaccaaaccgaatcgggaaagaaacaaagacacatgcattgctttcttgttacagtagtaagattgactaaatgagctccaatttgccataaatctcgtctagtctatctatgggcaatatgacaaacaaacaacaaaaatgtgaaagaagcataccatccacatttggtaccactgccaccaccggctgaggatgctcctgcagtatcggaggcggcggcggcggtgatggagcgcactgctgcggcacctccgccaccgcctggctgggctgcggctcatcgacctcggccacaggtgaatcctcattctcctccagctccttctccttctccttctccttcacctcctcctccttatccttatccttatccacattctcctcggcctccaaatcaggcgggcgaggcgacggcggcgcaggcacggcgagcaccctgcccgtctcctccacgagcgcgccgcagaaggcgcgatgcgtcacgaagctgtccctcctgaacccgaccaatgaaaatcaaggcaagcaagaatggaaattctttgttgcccccaagggaccatggggatttggggtcgagggtagcaagctatacctggtgaagagggtgccgcagtcgcagcggtactcgcgggtgccgcaggtcttggtgtgcgccttgaggtcggcctgaacggcgtagcgcttgccgcagcgctggcatgtccagcgcttctcgccgtgcttgcggcagaagtgcttcttgatgccggtgaggtcgccgagggcgcgggtggggttgtggtgcacgcagccgggctccgggcagacgtacacccggcggcgcggcggcgccgcaccggggccgcgctgccgcagccgccacggcaggttgtggccgcggcggtgcagctgcaggttctggtctcgctggaaccccttcccgcacacctcgcacacgaacctgttcgtcgccagcagcgtccccggcgacagcgcgatcacctccgcgtccggatctgcccccgcgcacaccacccatcaaaccacgcctcgaagtagtagaaagcatagcacccaccaccgaaaccccaaaggaaaaaagcaaccccgcgagcgcgcgctctcacctggcgttccggggagattcctcttcttcttgaccaccggcgccgcccccgcccccgccggagccggctccaccgccggcccgggctccccctccgtccccgtcggattgggtggcatctcctctcgatctgccgccgccacagctccacccccctcacccgcagctcccccctccccctccccctccccaagaactgcgctactgcgcggcggcgggcggtggacggggcgaagaggaagggaagggaagggaaggaaaaaaaaaacttttttttctttctctctctctctctctctctcgcagtctccctttgcttctctcttctctctctaattttcgcttgcctttctattgggggagttgcggtgggagtcagagaggcatcgggatgatgaggcggaaggcccgcgccactgtgggtcacactccccccctctcgctcgctcgctggtgccaatccggcacgttgccctttccgctgcggggtggtggtgggtgggcgggctaccgtccgatcccgccccgcgattcgtgcccacgtgccacgcccttttttacaccacaccacacgccgtgtggttttcacgtacaaaaactgcgtggcgagtggacaacacacgggcagggggcacaggcacggagcggcggtgggattggattgtggattttgcatccccccggtgttgataaggccgggccgcggggggggaaaaaaaggcggcagcggcggctggcccaggccaacgcagcgcaaacgcctccgatcgggcgagcgagcgatcgatcggcgtcgccgttatccagccagccacgccacggtgcacgcgttgcgttgctatactggttttgtatagtacagggaagggaacagcgtgagctctctctctcgtgcgaagtcggcgagctgatttgctgggactgggactgggagatgagttgacacgggtggagagaaagcgatcttttttttactgtttgttgacgtgtcgtcggtgttgtggttggggatggggggttggatcgtcgtggggttcttttttttcttcttctgctgctgctgctgctgccccggtttggttttggttccgtcagaacggggtttactttgggtgtgtgctgtggagaacacgtcgctggtgaggtaagagagcggcgtggggtcgcatgtagacccgcgtcttatattgtgctggatctatcagcgcgtacggaaagagagcgcagtaagcaacgacgattgccagctgggatgtggacatggattggggtggtgcttatggtgaccatctctctttctttttcttttttttagtttttttatagctttttctagttggagatctagaggtttttcgtcctcattttttttaagtatataatcgtgtttttgtcctaagatgtgtttttttaatgaggtaggctggttacggtgacaaacacacattaaaagtctaccatcatattattacaggagttcgtatcaagtggattttttatataaaaaataaaaacagaagtttccaaattgttctctctatgtcctttgcatgtatttttgcgaatggatggattggtttgttcttttgggatgaagggagtaggcccgaacaaacacctaaaaaccgttaaaaaccttttccacgtggcctttgttgagttgtgatctaaattcatttgcacttaatgaaggccaacttctgccgtagcggagcgaaggctgatcatcatcccttttagggttccaccattatatacctcttgtaagccgtcgtgcggcgacgtaacctcacctcagatatagtgaagatattttgctggctggcgcccgtggttttttctctcctgttttgggagggttttccatattaaacctcgtgtcttttgtgattgatctattgttttttatcgtttgttcgcatatcgtttcctaacagcctttgctaagtgagtaacttcaattatgatgaatggaagttgccaaattttgatctcttcgcgtctcttttcaaatcatcgtgtctttttgcaaagtaatgcatgtctcttagcttatgacagaataactacatcactagaagccatttctatgtgacaattaacaaagcggatagttttacttgtgatctcctacaagaagtggaatttaccaaattttcgcctctcaccttctccaatgccatatctttataactcatcttgtccttttgtgagttgatgtgtgtcgcttattatgacagagcaattacaaattgtttacttgccctttcatagatagcatctcctcgaatcaacgtaagttaccaatctttcatcttttcatgccctttttcaaatcaccgtgtcatttggcaaagcgatgtgtgtctcctgagccctaatagaatacatgctactatccaaaaatgtttatacatttttttatcatataaactaataaaaagagtaaaattttctgtctctctctctaccttctgtaccacgttctattctattatttttcataaaaattattattatttatatttcttatataccactaaaccattttttcttgcttttctatgacacccaggtcttccaatgcatcacgacctaggtactactctcttcgcccctaaatataagggattttggtacgtgggttaagaggtgaatgggctcatatgttaatggtagtaaccggtgttctagtgactgcatcggatcggatagttccttatcctttgctaggctttcttattactactcgaggatcagctagagcgctgctatgagccatgttggtcaagttcgagtaccattcatatatctggagagaaggagcaaaagtttttgctattcattttgcagttcacttaaatcatgggtcaagtagaaggtggactaacaacagtgccatataaggtcaaaaaatgatatctcagtgctatataagtcaatgcatgttttcaatggcatataaagaaatttaacaattttaaattctattcaaggaattttctctaataaaaaaaacaaaataccacctctctagggaagaaatccagagcccttgtctataataaggtccacctttccaatggactaccaaatcccgaccctggcagtacaacgtttttttaccaaattttgatgaaactccacttgtgtttactgtggtaaatttgaatttctcaaataccataaaattgttcaaattttctttcctcccgtgttgaaaccttgaaattttgtggttttttaaacgatctgtatacactataaagggtgctcaagacacaatgctctcggggagcaggtcatggagaactggataccgaaagacggacaaacagtacatgcaagaaaaaatggatttattaagatcacaattcaatttattaatttgacttttgttgtccttgtaatattttcttgcccaatcggcctctaagagcatccgcaattgtaaagtaaggtgctctctataaaacatgtatatctcagtaataggctagattaatagtaaaccacatcaatagtatgtctacgtgggtatctatagctctctaatgcattgtctcgtttttctctatagactatctccaggttagtagatagatttgttctctttcttcatttaatctctttcaagtaggaaaatatgctgacatggatctcttgtagagagtctatagataaccattgtgggtgctctaacgtaaaggatttccaggcatgctttttataactagacatgtaagtaagtaccaaaatcggagacacttctaatgaacaggggggtgatgatgcggtaaaaaggttacacacttccatcttggtttgcatactttcatggttggatggtcggttctagctctcacactcctaaacagtgtgcacgtaccccgttgtgcctgtggtcctctccacggagatatcttctgttcctcgtgtgggggtgctgggtgttgccattagccaacttgccacgaggataaaaaggtagcaatagccaatggggattatagggtgaaaagtcccaatctgcacgtttggaatgctaaaaatccatggcaagtacttaactaaagttgcatctcagtagccaccaaggcagctgtgcattgagggtagctgtattattaattgaaaaaaaaggaaagtaggagtatttttttagctcaggggagtgtattaaaaaaatcagctccggaacaaaaggggaaggataaatgctaccgccaagcagaaggagacaaatggagcatatgcagcatttcaatcattcagtgggaggcgatcattgtgccccttgagtcattttcaggcaacgaaaaacataagcaacattctggccatagctaccggcacctgtagatcatactagtacaggtttagcgagagaagcgttgcacttgcacatgcccggaatcatttcagtgtcatggatatctccaaatccttctgctcgtacctcattcaggagaggtacttgttggctcaccaactctggttccattattccattacatcataatcatatacacaacctggttccgttcaccatcgaccataaatcttcatttttattaattagatccatgtatcattatgaat

SEQ ID NO: 75357 - DNA, 7908 bp, Oryza sativa
tatttatagtagtatttcatacaccgaaaaaagagtttaagcgtagtaaatatcaattgttggatccatgaatatggaataataacagccattatttatgaacgctaattgctagctagatccatcattgtcatcacagcctagctactggctaattcagctattccatcgtcctcttctgagattgcagtaagctcggaggagtgaaagtaagaatccatgacttgtggaggtggcatgccattgccaatgccatccccatcgcagaaaaatggtctcagaggcacttgcaacgcatccacatccccttcgagcatctctattgcctcgctcatcgtcgggcgatcgtgtgatttcatctgaatgcaccacagcccaacaaggcatagcttcctctccagctcatgcatgtcagcaacattggatatctcatcaacttgttgatctgctatcagttggtcatacacccatgctgggtagtatgccctgcttgcatttgagtttgcatttggatctgcattccttctacctccagccatctcaagcaacaacattccaaagctataaacatcggatttgtcggatataacgccaaagctccgggataccatctcaggagccatataacctactgttccccgtaaagccctatctgacacaaagctcttctcccttgggtacagttttgcgaggccgaaatcagcaacctttgaaacaaagttatcatcaaaaaggatgttgcccggcttgatatcaaagtggaaaatctggattttccaacccctgatgcaggtaggttgatcccttctaccaatgcctagagcaatctcattgagcttgtcccaagagaagcttctctcggatgagaagatatacttgtttagagatcctctaggcatgtattcgtaaaccaatgcccttctcatttcttcggagcagaaccccacaagacgcaccacgttgatgtgatggatcctgcctatggtggcaacttcactgatgaagtcttctccattgcaattggagttgccatccaacatcttgatggcgacatgaacatcacccgggagaaacacacccttgtacacagacccatatcctccttggccttgcgagtaagaaaaatcatcacggccaacggtgcgaacacaaacctgcatagcactgcatacgaaaaggctaatgaattttgcaatgcaatatgtggtgtgaccagcttgatagtgtatactgtagaattgagtggaatgcaaaagttaattaattaccagcaatccacttgacaagacacaaggtgtatagtatgaagagcttatggtaaagagaatgatcaacgccgcggatcatgtcgctaatggaaagacgcatgtcgatgtaatactctctggataagcctatcatgcatccccagaaacggaggtcaatagaaaggatgtcaatgatccggtctttgatgcctactctgggtaatggattgtcatggctatcagctaagctgcaagatcatttattggaaagagttaattaaacgggattggaggagaagagctaaacaaaatcggcccttttcagatgataaagtaaaggtttcgagattataaggaattagagcctcactccggtgctttctacttatagtagaaaataatccgagccgttgatcgtatataatcatagggttgagatctaattctactaccaccactcttagtggtagtagaaacgtggaggggtatatttgtccatagataataattcatgtaagggtattatcgtaaattattattcagtaactctaaaccttcgccattctcaagcgcctgaccccatccatcgtcgacttcgtcgcttgtccatctccctctccgcctccatcatctccagcgcgatcgacatctcctccccctccagcgaccaagggtggcccttctcctcttcgccaagccgctgaaggtccttgcccacggcggacgactagtcctgccatgtagctttgaccaagacagaggagatcgcggggcaattggacggcggacgaagttcgacgggttccggcgaacggcggcgaggtaggaggaatgggcaactgggaatgaacgagtgtagtatggggatgtggtggacggctcggattggccaagaaatgagctatggcagccggcgacgtgcggtggcggagctcgagtgaggcggtggcatttggtcgccgccggtgaccgtacgagcggctaagggacttgggaatgaggtgtttggatgctacatgaatagggactgtgcatcacttcacaagctgccgcggagctaatgcaaatgcttttgcataaacacgacagtataccagggagtttgcagcaaagagtgaatcaagatgttctaagcccccattagtagacattgtcctatgactgaaaaaaaaatcaatttagtggcaattgagggcttagctacccccatatgagcacaagaaaggaatcatgtagcgatgattcagagcgccagaatatgacagaatgcagttagatgtttcgatggtatgaaatataaaacaaatcctgaattacagctctgactgaaatgcaatttacatatgggcaaaactctgatagtgaaaaatctcatttaagcagtttatcagattttttcagtctcactctttcaggagcaaaacaacttgtttactgatccaggagcaggatgacatatttcagttcaaattgcctggactcatctcaccccatcacagttgcacacaaaaaaaatgcacaacacactgacatggtcaacacattgacattactagtagtccatcactattcaccttttcttttttacttaaaccattactgaacaatgaatatattgggacagtcacaagatccaataaacatcagtatctcaaagctcgtcaattagtcaatgaagtattcgacacaccatacaactgaatattacaagcagaatgaactgggcaggccttcttgttgtcacggagccacttcgcgatgttgcaatcctcgtggaagtcatgcccgcaggagagcgtgcggacagtcgccggccaccatcctgagctagcagatcgggcatgccgcatgcatcgttcagcgtccgatccagtgtcctgacgccgccgcgagcacggatgtgctgaaacctctgagcattgcggtctatcaggttcgccggcgacgccttccacggcagcacgcagcgagcgacactgttgcatattctgcatctcatgccgtgctcgcggtcgaggaggtgctcgccgatgcaagccacaagactcgggcacgcacggagggggaccggggatacggcgccggaatgtatcgcatctgcctcccaagtggccgcagcccacacaatcggagcaacacggaatggagatcactacccgccggcggaatggattgaatcctccaaagtgggcgctgccaagaatctcaggtcttgcgcaggggctccggcggaatcggacgcgcgcggaaggccactcgcagcggacagaaggccacgacggcgaaccaggatgccggcgtggaatataggagaggaggagaaacggatagacaggtgagaggtgggaggaggggacgcctgagggtttcgctgcaccgcgccacggcatgccgggaggagtagcgataagcaacgtgcgtcgggcgagatgcagtgcttttcgtcggacctgatgcgatcaagctaagaccgaccgagacagagaaaatagatcctgccaaaattgcccctaatatatattaggagattactaatctaccctttaaaatgaacggtcgagattaattctacttgtagtataatactccaagtagaaagcatcggagcattgctcaaggaattaaggcgctcacctaacagacttgttgaggcattttttgatgagaccaaaccaattaagccaaggtgttggaaatttgacggcaaatccacccctcatggattttacaacctctgcataactagtgtattcgggcagattaacggagttccagccaccgccgataggagtcatggccaagtatccacaagaaggttcgatgtcttcgacagatggtactaaagaaccaaaaaatgggagcatataataaacgaaggacaaagccgtggtcaggcaatccacgggatggtacacgtacaggtatttgctactactgttcgtaattagttcctgcgaacaattgacaaagccaacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagttgatgctactcacatagtatttccctgtgttgatccgaatggtggccttgccatcatcgctgctgcagtctagctcgtacgaccggaagccgcacctgcgactgcgagggtcgcctcgccggcgaaaaggatacgatacgttttggagatggccgcaggagaaaggttggcactgatgccgtcgtccttggacacggacgacgtgatgatcagcatccgctaccacaagtgcgagcacatacaggacggttgacaaagcagctgcttccattgcatttgcataccctgtatatactaatatagtgtaggctaccaagctagctacttgttgctcgctcggccggctcctacttataagtactacgacgtacgctacccggccagggttttcaatttcgaaattcaattttatgccggaggttaccgaaattaccaaaatttcggaaatttctgaccgaaattatttgaaaatttgactgaatttgaataaaatttgaccaaattcacataaaaatgtaaaaaactgaaaatttcgggcgagatttaagcatgccggtgagggcaaaatttctgaccgaaatttcgaaccgaaatttcaaatcctgacgctaccaaggaggggaaaagagaaaattgagtatccgtaaaacgagcttagcatggtttttaattggatattaattgagtatacgtaaaaatagaaattagcgcataattaattgttttaaatttagaaaatagattaacatggtttttaaaaagcaacttttaggtatatatatattttaaaaaaatactccctccatctattttgatagttatatttcatcttggcaggatacataattctacttatcatccatttaaacatgctactagtcattcctcgtaaacaatcgattctttaatatttacatttctcgatgcccatgtagctaattttgtatggaagaatagagagtcgtgcattaaatccgagaaagtcattaagagaatatgttgttggattgaaatatgcctatcaaaaataaatttttcagatttgaaaacatgactatcaaaagtagatggagggagtacaactgttagtagtatgtaaacatgcacatgaaaaaatgagtagttttttcattctttcagctcggccgaacctttgaagttcgaatttatattaggtagatcttatgctataggtcgtatccattacattctacctccatcccaaaatattgctatctagcatgagatttgacctatgtccagattcgttgtctaggatgggtcaaatctcatcctatgtagcaatattttgggacggagtaagtatttgttatttatattaagttgaccttacgcaaccatcgaactcatttgatgaaagaaaaggcagtaaattaagcaccgaactggacggcctcgtccagtccagatcaagtggccagagacaaaactctcggctcgcagtgctgaagcagtaactaaacaggctactcggtagtagaatatactacctttccatttttcttatgatgttgatttttcgtataatgtttgattatttgttttattaaaaaatagtatagatatgtaaaagtttgatgataaaatccagtcataaaaaaataaataatacttagtatatattttttactgaattgaatgcccaaacgttacgtcaaaaactaatggcgtccgctgtaaaaaataaacatacatgcgtgttgcaaacttctgactgtagtactgtacgacaacaaagctcaacttttgactgtacttgtatgacaacaaagctcgcgcgtgaattagcatttctgcgtgcaccaggcctaatttccacacgggaattaacctttactaaccggtttctatgttaatcgctcatgagattgggcatgagtcatgagtggactggagcaagtctacgatgctccaggtcagtcctggccggcaagattttccaaagtacccactccgtttcattttttttagataatggacccactccgtttcatagtttttgacttcttttactggttaaactctaatcaaatttataggaaaatacgataatatttttaatacaaaataaatatattattaaactatattaaatattagttgtaatgaaactaatttggtgttttagaatttagatattgctaaatttttctttaaatttaatcaaacttagaaatgtttgactagaaaaaaaaaagtcaaattgacttataatatgaaaaaaatgacttgtaacatgaaacacggggagaacatacagcgcattgttgcttacaatgaagcgcacagttgcaatatcctgatcccacatatatatatccacacctccacttcatgtacatatatggaatacctacagagtacagactacagttatctcttttttttttcaagggaacatactacagttatcacacacacaattgcttttgcacctagagtcagagatcaatatgagtagcaaattcctcgccatatatctcctgcttgctttcctcagccatggcacctgcagctacatggccaccacagcttcaggctgggatgaccacgacttcttcaggcattgtccaccgtcccggtgcagcaaggatggaccagagatccgtttccctcaccggcttgaatcagcaatacatcatcagcatgccgcgcttcatgcgcgaggctagcatgctctggccaagacaccatcctacatcacccaattctggggccttgcaaggtcacctccatagattacaaggaggccgtcatcaacatcatccatctccttccgtttccatgccctctccagaagctcatggtcgacagtttaccgcctgatgactaccatggctgtaacttatacaggaggattcctgcaaaaatagtaagctgctcaaaagagtttacaccaagtggtacctctccagttccgtacgaacttgaccatctccagaatgctgccgaaaatatcttcggcccaatatcctgccttagcggcacaggacagtacttctcatatttggtgcatgctcagctatacatgtatttgcttccattggattgcaggatcgtctccagaggctccattccaattcctggctcagactcctgcagtggcccaacgttcaaggaaaaagcagaaaaattcatcaactttgctgagacgactgtcagttgggggtcctttcaagatggagttctcgacaactgcatggcgtgtgaacgtcaaaagcaactctgtgcattcagctcacgaaggaatcaaacattctgcacaagccacggcaatcatcatggtactaactatcctaactgcacaaacatgatcgtaccacccagctttgttcctgaactagttttctactcttactatgattcaagcattcagccatacagtactagtgcaccgctctcaatacatatgctcaaaactatttttgcaggctagtagcctactactagaaatcatttagggaactaactagcttcatcaaacatttttgcacaattgccata

SEQ ID NO: 75358 - DNA, 11365 bp, Oryza sativa
tatataaaatcggatccttgccactttgcaagcatccgacgcatttgaatcatgttatgctgccgtattttcgtatgaaccgaactacccgtgccccgatccccactattatgggaccgcatgtcactcaccctcaaccataaccttatcggagtacatgcaaatgtaagaggaaaagctacagttacaaaactgtaccgaaatacccctcgtcagttttggttggaccagagaaatccgaacaacagcaatccaaatgcccgtgaagattagactagactgcagactccgtggccgaccagagtatatcgtttgctcagtgagatcagactatcaacaagtgtccgtgcagccaccattgcaagccatcctcgcccctgatctcctaagatcagctggagattggaaacgggaagatacgtgcactgtaatctcccaagattgcattccgaaagaagccattgctccagtggctgttaagctgctaatggtcaatgacttgtagtatacctgaattacacaagcataggctatccattacgctatcagctggtcaatggtaacagagtttttttttaattaagaaaaggcaaaaggagtgtctcggataatcggatgaaaatttcggattaacgtctgcgcgaaggaagcatgttgtgattcttgacctgaaaagactagaccaataatcactataaacatgtaatagcatcgcgtatgtcggctaggcctgattggttgtttttcttgaagcttctgaggtatatgaatggaggtgtcgaagatctttcggaattactacgggattcatgacaaagaccttccacttgtgctgtaagcggcctccttttccggatggcaacctgtgataaattccttaaggataacatataatagctagatcctgaaatagccatggtgacatccacatcaggcgataaagctaccagattctgaagggacagggcaccataatgtcccttctgaaataaggatcgacaccgtgcgagacgaataaaatacagttcgtgtgctgcagtcacacgctggcagcatcataggtataccgtagaatggagtgttaacaggtgagcgtgaaaacggagctttgatgggttcaacgataagtatttgctgctagcaactcccagtacatgagaaatcatatgtacaacaacaggatggatgctacagtgaaacaccagaagttgatagctctgccctaagacctgcaagtgcggtatacctcaccacgcatcacatcaattggtccatggtcaagtgcataacgatctgggccaagatacacgcctgtcttctcaaggagagctaaaccttcctccctgccgtaccttgacgaataaagcttcaggtattcgatgtcctgcgttagaacatcagtaaggaacaactgtgagcagagtcaaccgtgaacaaattgctcgctgatggagtttcagtttttgtactatccacagccgagaactgtggttctggtaaccaaaattaaactataagactgaaagtttcatttggtatattcaatgaaatttcctgctaaattcagtgaaattggcacactctaatggcctgtttgggagagcttaaaattctgataagtagctggttggtaaccaccttttgagaatatggaaaaactaggtttttcagcttctgtcttctagttctttttctggattctacaactacatattctcagaatctgtaccaaaagcttgactgtttgggggaacttctgattctggaagaagctgcagtagctagaaactcccccaaacaggccctaagcactggtttgttcaaaagaaaaggtctcattcatgcaatattccaaatgtcattggcttcatagtttataatatggtgtactgtgaacaatcaaaggcaaaggtgggatttaaatgacagcttaagtgattcagccatgaagcctctttcagaataagtactttgcacttaatttcaatctgaatagttctaacttagcaaacatatactagcattgtggacgaattcatctttcatatagaggctggatttacttccattacttttaaaaaaaacatatactagcattttgacagaggcaaagcattccaaaaaacctcacctgcatgccactgagaatgcgctctagcctagtggacgcaaccggttcatgtgatgaagaaaacacttcaccaggatagaacagaaccccatcgccaggaggaagaccacgtcggaaacaaatctgcagtcacgccaagtaagacaatcagatgagcgtgatgcaaattgtagaggccgatctatcaagttgaattttactgtagtattcaatgtaatacaccttcatagacattggtatcacattgtattaaatggttcccgatgccacatcatacctcagcacttggaatcatagccttctcgtagcagttggtaccccaataaaggaatcctgttccaccttccttccacactctccacatcactgccctgtgctgggttccacgcatcccaagatgccagtttggttgaggatcagaaggccccatacacacatatgtccaccattcctagataagattgaaattacttcagctcatcaagatagaaaaacagtaaactataaagggctccataagtccatatgcatgcacaacagtaaacggatggcgcaccagagaacagtactgtttacatagagagcccacttttataaggcgcgggtgctattcaagattcaaacatttgtaactttttgcccacacctggtctcattatatgtaggtgtatggaaatggtagcactggatttatatttgataatatttcttgtgattttcccattttgggtagttatgacaatatatttaacggaaataataatctgagttcaattttaaagatagtgtcaagtcaaattgtgccttagaaaaagacattaaaggagagagtaacaggaaaacaggcacaacatttcataagattaccgattacgaaaccctatgtgttcttatccaactaatttttttttaattctgactaatattaatcttagaccaaaataccaacagattcaaatcaccattattcagaaaataaatgctctaagccatgagctcttccaagcacggcaacatccacgctataacctaaagcacaaattcaatgcaagtacagatgttgtagaaagaaaatgaatgttgtccatactatttaaaagaacataatttgctcttacttcaccaagatcaggtcgtagttcagcaacaatatccttcaccaagtcctctctcgtgccaagaacccattcactgtataaaaagaacactagatcaattggatatactacatctgattttgaacagtgtatgaaaatgattttatgcaccaagctaccaatacttctactggcctccatgtcgcatatccaatatccacacagtgccaaacatttccaacatgtatcagagttgtgaattccatcaaattgccaatgtcgtatcatcataatgtcagtgccttgtgagaatggaaaaaattctttcagaccggcattgataattgtatctatcttgtttatgttacaaattaggagtagtttctaatatctgaacctagctctgaatttatttgacaagataatgtaagacgtagaaaacacggtaaaaaacttaaaagttttgaaccttatgttttttttgttgtagaataaagcattacagtccatcattttagcatcagtattgagcagctatcggagtgagtccacaaatgggtaccccttgacccactagttcaactaaaaatccttttttttttctttcttgctagtgaaaaggtgcaattttagttaaactagtgcaagtcaatgggtacccgtggattagcccactcccattcctagtatagatctatgctgttgtatcagtttttttggaaaaattataagcgtagcatgctatgtcagtgtgaaacatgtgtacatattgtaaacagggatatggacaccgtatgcccacactatttcagctgtttagaacaaataagaaataccagcaggagtgcaaaccttgtgcaaaatatctgcgtatgtggacgtagaacatttggaactttcacaaaggcctcaaatgtagaaggagccagttcagaaccacttgggcctacatgagccatttgcatttaaaaataagatatatgcttaaaagaaactcaagacttgccaagtgtgatcagcttctgtaggtacataaatgttatcctgacttgaagaaaaagtaggaccaaacagggtgatagaagatctatgcatcgtaagcaggtaatccatatggtcattccatacaggatataaaaaacaccatacctaatggctaaacaataaaggaagttattttatgatacaccaatgaccaatctaaatatatgctaattacaaattcaagtagggaaggatgttgtttaacacgcaccatcactaagggagattagatggtcttactcaccacagtaataagttgtcaaaatacgcacatcaaatgcatatgaacgcaactcattagaagatgctgcccccatgcagattacatcatactgttccatattcagtggctgagaaaaataaaaataactgttagatcataaggtagctcttctttaatactgaaatgaacagtataaattgatgttggagcgtggcccaaagagtacccacgggttggtccgtgcctatccctatgttctatggagcacacatgtagctattttggttatttcaggtgtcatgctttattgagcagtgcataaactggttggtctcatcattaccacgctcacaatcatgtatctacaaaatttttgcatgtgaaagatgcagttacggttatacttgctggtttccaattttatgtgtgtgtttacgatataagaatatactggacatgggatgttcaatgtactccgtatcactttattgttcgtggtatgttacatcaggacgcattatattacaacagaagttacccttatccgattaagagaatagatctaaacatcagtaagaattaaccatatttttctattcaacaatcaacatagatgtataattaaacctgataatctaagactgctattattcataggaataatgtaggtccaactgcatatagctattagctaggcaggccataatggaacctacaaattgatatggcatcataaagaacactacaactaaggagaaacttgcattttgtgttgtagagacgtgtaactgagcaatgacacacctcatcccacaaatagaagtaagatttcgaccaatgagcctctgatttcaagatttcaacctctcttcgcagggaatttttcgcagcatcagtgctgttgtgaataaaaaaaatgagccaaaaacatatatagcaaattggtataaaacttggcagaaatttgagcaataccttgataggataggtgcatatggtacagcatatgctgctagtcttggatcagagtaatattctttcgcctttggatggtcagctataataataataaacaagtgagaaaaaaatcacactccatagcagcagattgttttaccaacaaagatggaagtgttaccaggccaagggcatgtgtatgctagaatgcgcatgctatctccccatctgcagaaaaatggactgattctgtattggaggagccacctgaagtgatgatcgagtgcatcataccaacctttggtcccatgctccaagcaaaaccgatcttcaatcacagtttcagatatctgagtatagtcaatgatgaacaaatccataaaagtacagtgaaaatgcaaattaatgatgactacaacgcaaggacagcatagacaattcagtcacaaattcccaactgtagatctacaaagtatgtgctgcacaccagaaacaagcatattgaatccttattatatcttaaattatccaaacataacagaatgaaagagaatagtgccaggatacgccaaaaacagcaggtaaagaaggtgtcagtgggagagtaaaatcccaaacagtgaggctcaacttcaaacgaactgccacattgttcataatatcttcatccatcatatctcctaatccattattctcttggcagtcctggaatgatggaagagctaacatcctcctcagtgtggttgaagcagatgtaagtctttgtacctaaaagttgtagaaaggaatattgatataaaaatgcaacatagcatgtccgagaaaatatagcatcagaataaaataccatttcctctgatgacgagtagtctctgggttcagtgatgtcaatgcaatttcttaattctttgtaaagctggtacctttcagattttgtcaaggattctcctctggacctgccaccatagttaaaagataaatgccagtcaaacgcagatgaacatatgggtagaaataaaagaaaaatatcacatggacagttgtgaccacctccaagcatcaaagtggacactggacatgcattctgaatatcgatgtttgtaacttaagctgtcttgtttcaggatgagtgtataagataaaatgattgtttcataaccccaaccacttctaaattttgcaaactatttaaagttatataagaagattacactagtttgctcacactagactctgaatttagcagctcaagacatacagtaacagtgtaacatggaaagttcaatgacttgggcaaataaaggagtctcagatttcaagacacaataggaaatataaatataaagcctctgattattacatagttttcatgggaaacatgcatacaaaacattggttttaactctgtatacaatagtgcatattacttcgaatatatgccgtgcttttactttattatatcaaccagagatacagaaagcatgcaatatggacactggtgtcaataatagaatctgatgtttctttttcatgcccaaataatactaaatactaatcagattatacaatcacttgtgacagaggcactgaaccaacttaaagcatgcaagcagcatagtcaagcttactctgcttctgccctcacagcactaataaatatttcaccctcatatagacccggctgttgtccgcaaggaacatttagtgagacccatattgcacttgtctctctgtacaaacaacagtaaattagctatcacgaaaaagagaaaatgttgctgtgcatgaatcatagttgcctaaatcacagaggcaataccctggaagcaggtttatttgtgaattgagtggatcaattggcacaagagcatctggtacacctaacataggcaccacacgtcgcaaggttacagattgaccaaccactaacctggtacagcactgtcataatcatccaatgtagaagtgtacaaatgaaggtatctctcaaagaatggatgcaagatttaaataaacaaacctgtctccagcggaagagcaaagatcagtgcactgaacctgcacagatcccgcaataccagaagtggcccatgatacctttggacgtaaagcaatttgaaaactttccctttcatttcttgctgccaaaaggttaacctaaaagaaagtaacttttaaatatttttggaatgaactgtggtcgaaaaatatgataaaatcatgtacacatcagcctataatgagtaaatgctggaagagaaaaaaacactgcatatctgatggaacagagaagtggtatggccttaaaatattctgcatattgaagtgtcaaagcaagagagttcttgcacttctagcagtgctaataaatgcaagtataacttacatgttccagaggtcgaggtgcttcttgttggctaacatttgctgtgctcggcatagaccagacatgcaaaagatctgctgagtgtatctttgtaggatcaatagcaccattacctaaactcgacgcctgtaatcctccatctacccatccataactagtccctcctccagctacaccttccacaggtggtacagaactgttctgcgtcttatctgctgcggtcagaggaaggaaaaggattaagtcactggaacttaagctccaaagatttatctctgatgcatgtaagtcaaaaactcaaaatcctaataaataaataaaatatctctctggaacataaaaaaatatgtatattaattgttatcgaccagcaattctaaagatgtagagggcttttccaagccatgtgatgtgatggattcacaacagtcctggttcttctagcctgaccgatttcttattttgcaactgtcttcctattatgcattttctcatacctaatccatcatcccgtgtgtatgtagatatgacttccaggcagacgcaatcactgcagaaactaccagaaaagtctcttcacttagctcagaactgaaactagagatgggctcaatcaattccatccatgggtgagcttgagcatctccatccaagttgtggtcactctaccgtttaacaacacagaacggccagaccaaaaaaaatctcagaaccctatccgattgccaaatgacagtctcgggttccaccgatgaccgattaaccccctacaagcaaatggcgagcagactggccacattggccccgagaaccgcacaacgcgagctcaactggagctcccgggcacctatacccccacctgcccccctacacaacccgagggagagcagcgctcccgctcagcacgggctcactcggcagcacgcgccagcagctcaagcggagaaaatgggcagaggatgatccgggcgggaggatccaattccacccccgggttggggggcgatcgggccgctgttccggacggcaatccagttcgatcgggcggggggggagagcagcgaggcgagcacgcacctgcggcggcggagttgggttggccggattccatggccacggcggcgcgggagggggagcgatcgatcgatcggggggagggcagcgacgacggcgaggggagcagcgctggagtggtagtgggagaggagaggagaggagaggatgatgaggcggaggcgagagagagagagagagagagagggagaggcggtttctgtgcgtggcccaagtcccgagaccccctcaccagtcaccacctcgcctcgcgcgcgggggccgcaccggtgaaaggcgaggcgaaggcgatcgagttggggaccccgaccccggaccccgaccccgacccgggcggccggtcgtcgcacgcacgccgcaggatcaaggtgatcaacctggcgcgcgcgcgcgtgttgtgcggccgtgtggtcgttgcctcgttgcaccgtggcatcgtggcaacgagggaaatgttaataggagaaaagaaatcgcggaggcgcggacgtgttcgcctctccagaaaactcatttcggttcgagtgtttggtttggttcagagttctttggatttgacattcgtgctggagacctggagtataaacattgcaagtatagtgtgcagttagaagatcatagtcgacacgcggctgctgcatcgcacggacacacggctgaacacctgttgtgaccttgtgaacaaacgtagccttactgcagtttgtcaggaacgttatcttgttcggctcaatcagaccattttgtttagtgcttagtacctagggcacctttttaacggaccacacaatctcatgagtaacgaaagacattagcaaaacgcatagcagccacccagaccacacactcctactctgttgtgagtagtgacacaaagatatactattagcgaacgactgctccaggccaggaaacgacaagatacattcagttctgaaatcttagctacagcactaacacagttcactgcagccacagagcaatgtttgtcagggtaactcatcttatgcataccactattcatctagaagagcaatgagtaccaataatgaaccttaaaaccaactcagctgtacgtaatactgtcgaggagtgaccctctctagcgagagatcgtgaggcctcctccctttgtgagttcggccgggggaaaaaacgcgatgatcaagagcgtacctccacctatgacctaactactgatcgctcgcaagtccgtgtggaagacaagggattacaagggttcgggcgctggaaagcgtaacacccttctcctgtgcgtgggattatgatgagttcttacaaggggtcttgagctcttggggaaatctagctgttctttctctagcgctcaagctattgagagtcgtccctttttcacagtgagcgagatcatccttttatagttcaaagggataccacatgcaccgtttatacctacccctccacgggaggggggcccacatgaccctggtcatatcactatcctttgcttcaactggaagcaatgtggttgcctcgcttcaggtggggcccagcgccgtcccccgcctgacacgggggacatccccgtcattcctcattcattgtatggagactttggcggctcaccatgcgcagggagcgctcctggcagtgtaccaatgggacggggcatacctgcccccactccacctgacacaggacggaacgtgggggcactgccacccatccaatcgcctgtgaccagtcacagaccggtcaagctcgattgatatgggtcaatcaggcagcgccgcccgcccgcccacgccgcattaaatgcagcgtggaacgattgggacgccgcgcattgaaaacgctgagcggcgctcctgctccgccgctcccctggccgagcgagggcctcggggcagcgcatgctgagggcctaaggagcgtgacatggcaccccgaggccccctggccacctcagcgttacctgatcgcccctcgagggaccgggggaaagccaggccgcgcggccacgtggccagatgggaaggtgacttccctctactgtgcgtacccccggtcctatatcaccgacaaatactctatccgtttcaaaatatttgacaccgttgactttttagcacatgtttgaccgttcgtcttattaaaaaaatttgtgaaatatgtaaaactatatgtgcatataaaagtatatttaacaataaatcaaatgatatgaaaataataaataatgacttaaattttttgaataagacgaatggtcaaacatgtacttaaaaagtcaacggtgtcaaatattttgaaatagagtgagtatcgtctaagactgcatggcattatctcctccttcacctggcacttcattgaacatgtactggctctgatactccatcaagtactgcgccgatctcttcacgtccaggcagagctggtagaccctgcttatatcctccatttccacg

SEQ ID NO: 75359 - DNA, 9374 bp, Oryza sativa
ggattgcatacctcagggccgtctccactccaatctttgtgagcaataccttggcatatgcagtaaacatttccacatcttcttcatcgcacctgatgtctaggaccttcgggatatcatcctcggtgtaaggctgtgtcgtgatgattaggagccgattaaggaagtcaggtggtatcccatgtagtgattggtagtttatcccacgtatggatgtgatccctcggttggttgcaatgactagaattggagtcacgtcattttccaatgcacggtttagaaaggagaagcattcgatatctgcatgtggacttcatcaacaaagagaacaccagggacaatctcagccttcccttcctccctccactcagcaacttttgtatcaatctgctcccgagcctctgcacgaatttcaccagtgtcaccagtgaaaagtgcaagaaaaccctgtgtcctggacagcaataacaaaaaacaaaaatgagtttgcgcaaacatagctcacttaaattttttctatggtagttagaaaaccacatctgaaagccaataatcttcgtctagtgaccaaaaaactaccaagccagttataagtaagattttttggtgattacgaaatggaatgttcaaaaagattcaccaaagaatactatttaaaacacatctgatagttgtttggttgataagatacttacagagacagagagagagagagagagagagagagagagagcacatcacaatcacgatcagttcatgtcaaactggttgaaacatattcatgtaccatcttggaacatggttcatttatgtgcacataataattgctaagttgtaccaaagtaccaataggcttgactaattttcatcaaattatacccttagcaacatcgtgcaggtccttttttcacaagagttacaagaggaggctgctctccatcattatttttctatgggccaaaagaaaaattagatcttccgttcaaaaaaaaaatctccgttcaaaaaaaaagggaaaaattagatccgatttggacggctgaattgtatttcagctccaagcccaacaagatcatatatgccatccagtagaccatcttttcttagtattagctaactgagtagatgtggcagttagtagggacaaactgatccagctagggctgtccaaatccagtttagccattttttgtcaacctgcctttgacatgtctgcaggtgaatgaatgagatggctaggtgtgatgcagttgctggaacactatggttagctatgatttggccagttttgctgatgcaggaatgctcaccccttttgatctagttctagcgccattcaataggatctgggtggggctgagaatgggtcaggggttgtacagtacaacgcagggactggcagctaggcaagattaaccaatttcaaatttattatttgattctcatcactgcatatacacatgacacataaattattttccattcaggctcggaagcaaaatacaagattacaagacagttcttaatttggatttttgagcgacaagttgacaagtgatcctttattcctttgttcagatagtaagttctagcaaacgttagaacagatttttcaagactgacaaaaaaaaaactttggtggctaagctaccacaatggtaattagcaattaaacatacaagcaagcacacagcacatatgtccagggtagctgaaagtcaatgtgaaataccagggctgatagaatttgaaatacttgagttgattgtttcagttgtatctatttttcagttgagtaatatgtgacaccaaagctcacagagtttcaccctttaatctctagtcctctactatgtcaaaactcaaaatggttcaatacttccttgtcaggtatgaaatattgctttattttatgagatatctactctagttatggaggaatttttggcaagggaatgtgaatttaccggctattgatgacatcaatttcatgtaaggttgacacaatgcacgacctcctcgcacttctggagctcgccctcagggcacttgacggacttggtctgaggacaaacagcatcgtaatcccggcatcccgcgacctcccaattgagcggccaagcttggtcaccttcccgaaggccttgtcaagagcaaccacatccatccccgctctgcaacttctctttccccagggcctcaatcatcttgccgccgagctcgtccacggtctccatgtccgtcgtcttcagcgtgagccgcccaatcttcccagccgcggcaacaccggaaggcgcggagctgccgccggagacggggcggtcgattgagatttcaacgacctcgccctcgattatctccgcctccgccttgatgcggacgccgatggagcggtggaaggcctgggtgagcgcctcctcggtcttggagaggtcgagggagaagagctcggacgcggcgacggaggcgaagggcgtctcggcgccgagggactcggcgatgcccatggcgagtgcggtcttcccggtgccgggctgcccggcgaggagcacggcgcggccggcgatcttccctgtcagccagctggatggatatatgaagacgaagacgaaaggggaaacacggagaggtgttgcatacttgcacttgtgacatataatgggctgttactagttgggccagatgcaattccaatccttttttaggcctgtttggaaccagagttttttttttttttttgaaaagtgattcttagaggtccttcttagagtcggaggtctgcaatactttggtattttgggcttgtttgtgttgatgcctaaactagccgttccaaagaattggcaatgccaataaatttggatggcatttaaatttgtttgctataaaaaagggcaattttgacaagaaaatcaagcaataatttaggcacttctaaaaatttggcatcaaacaaaaccactgccgaaaaagatggtagggtttaaaatggccatgaaccaaatagacactagctttagaggaatggaattattgtatttggattcctttgtaaaggaagcaattcctcattttcatatgaaaatgaacatctggtttgacagggaattcttttatgagtggggacaaagtaaatcattttcctctgatttttttaatcgacattcgattagcgtcgatacgtagcatgtgcgtacacgggtaactatatcaaatgcaattagtggagaatgcatctatttaagcatgtatatataggtgtgttcggcaccacatgttcccaattcttcgacctcatgttccgcgcacatgttttttaaactgataagcggtgtgtttttttgtaaaaaagtttctatacgaaagttgtttaaaaaatcatattgatccatatttttaaaaaaaaataataatacttaattaatcacgtgctaatggaccgcatcattttccacgcagaagagaggattgacgatgttggtacattgcattaagcacatttacaatggcgccacgatcagtaggtaagacaggaatattcactgcgaaaaggaaaagcaactggtactactaattgttactagcaaggtttcggtttaaatggttcagactttcagtacatcctatacatggttagaccgccatagttgttgggatcattagttggttaggttactgtcttactgatcactaattagttgaaaatcaaacttctcggcgtcgtgttcatggaggaaacccagcttgatcggtgagtactgtacgaccttggtgcatgcaatttaactagtactatatcatcttcttttggtcagtacaaattgtaccaaccgttgtcatcagtacgcacctctgcttctaatcaatatctgtccatcacatgcactgttacaattttttttcctctcattgtcgccatatatattactacaaatcattaactagccaaagagtaagcatataccaatatgaaacaaccatttccttcggtttccatgaagttgaaccataaatatatttcctcttgcaaccatttcctttgtgatcacataccagattccaaacgattgtaatttacaaatcaatcaccaaggaaaaaggctcgcagtcgcaggctcgcagcccttcatgataagcggagttgtgtttgcaagctggccggtgttcgggccaagctgcgcaatgcgtgccagcctttgtacccctttcctcccaaaatcttgccaaactcaaccggcgtctcttcgccgtgcaccaatacaccatgcgccgacgcgacacatcgttgccacggtgtgaccactgaccagggccggccgggtcggcgcccgggcgtgcatgcccttccaagatttggaacgtgacgatacgagacaaaaatccgcttgtccgctccgcgcgagaaccccaccatgtcccacgccacgcgcgcgcagcgacacacacgctgcttccgccaacggcggggggcgactgccccccccccccgggccccccatggccccatcacaccataaccgtacgtcatccacgtcccctccggcgtccgtcggtgcctccgtgccgtggattggagtatgtatagtagtactgcctacggcgaggaccgcatcaccacggcatcgttaatcacggcgacatcacgggtgagacctcggagcacccgtaatgttagagtaataagttattataaaatatgtacatctcagcagtaaactatattaataataaatcaattcaatggcatgtctacatgggtatctatagctctctaatccattgcctcttttttctctatagactatctccatgtcagtagatagctttgctctctctctttatttaatctcttccaagtagaaaaactagcatggtggcccgcgcagattgcgcggctagcatcattatattttctctcatataatagcatatagtatgttttctcattatattattcaaatatattcaaatgacaatataattttaaattttgcaataactttacaaaactattaaggtgtaatattcatattgtattttatatacgtgttagttattaattatttttaatattaaattttagttatttgtaaattatatatattcctatatggactctagactcgttttttaatatttttttttctttaattccgaattttctgtaaattgtatttctatatagactctatgcttttcttccaatattatttatttttatttttgaatttttattatttctaattgtatttctatgtggattctaaactaattttgaattttgaatttcagttacttctaaatttcttcccatgtttttcttaatttcgaattttagttatttgtaaattatatttttatacggactctaaactctacttttaattttattatgtttattccaaattttagttagttttaaattcctatttggactctataccctacttctaatattccttattttttaattccgaatttctattttttttcgtaattgtatttctatatggactctatactctacttctaatattccttatttttaattccaaatttctattattttataattgtatttctatatggactctacactctacttctaatattccttatttttaattccgaatttcagttatttcctaatcgtatttatatatggactctatactctacttctaatattccttatttttaattctgaatttcagttatttcctaattgtatttctatacggactctatactctacttctaatattctttttttttaattccaaatttcagttatttcctaattgtatttctatatggaccctagtctcctcttctaatattccttattttttaattccgaatttcaactatttctaatttgtatttctatatggactctgtttttctttttctccgattaatgtgagaatttctagaccatgagagcgaacgtagaggcttctttttctatttctttaataatataatagatagatatactgacatagatctcttgtagagagcctatagataactattgcgggtgcgattttgctatatctcactcgaaagatttcttcttatctctcactcgattttctcactcaaatttacagtgtgttttcttgtaaattacagtgtaatttatgaaacttacaccgtaacttttgtaagttacggtgtaatttttgaatcttcgcatgtaagttttgaaatttatattggatttggtctttttcttgaagatatggtaatttagtgtccattatggtgtttcttagttgctttttgcattttaatgtgtccattggattttaatctatagattaaaaatctgtgtgatatgatcataaaaatctttcgaaagatgcataggtactcccttgcgggtgcccttagtagcacttgtcactaacgataggtcgtaaccaagcaagctaccgatggctaagattttaggtttattttctgctcgtgattgggacattgtacataccgatatctgaaagtgacgggttgtgcatggttgggactttgggagggaccttctcctcctcttcttcttcctcctgttttttaatatttgggccattgactctttccacatggatcaccaaccaccgagcgtgtaacaatgaataaactgatacctaccaccgggatattccgttgccgacgttgattatgtaaatttggtgaagaaaaaaccctgttgtgctggacatgcggctatatatcggaaagcactccctctgtcctaaatccggataatcttttgtctagattcgttgtactagaaaatatcatatttttttctaaatttagttttttttggaacggagagagtagtcttgtgggcaaagatccgtgtagatgcaatcttttctctgaaattttactgattggaatcaactcttaaaaataaactagtgggagtataaataatcggcggtaggcacttttgttaaggcaagacatgcactcgacatgtatcccttaatctaccgtcatttcagttctgtatgtgtgcaacatgcatgtgagcttttgcttgattaaggaatgtgcttgccaagtcaaatgaactggccactacttcacgctgattaagctaaaatctggtcaaaaggctcacggaaatgggactcgatccgaacgaactccaaagactttgctttcgcaggttctgtaactcttgctcccgtgtacacggtcaccggcctaacaattggtgaagtgtaacgtgccagaactctcttgccgtgagagtaatggtgggccaccaccgtgtctacaattcaatcatgttggccatgcatgtacctgtcagctggccctgttgcttgacagagtgacaagtgctcccaaacgcagataattccagtactttaatttgatctcgaaagccatgtttgaattgtcgctccaatcagtccatttgtctgattggtttagatcggatgacgagatcctttcacagattagcacgcatcatatgccttcgaaatggacacccaacatccaagttcagagcccaatttgcacactttggcctggtttagttttcaattttttctttaaactttaaacttttacaatacatcaaaacttttctacacacataaacttctaacttttccgttaaatcgttctaatttcaattaaacttctaattttagcatgaacttaaacacaccctttgttaaactgaggaagccgtcgagcagggcaccgggatctcgaggggagtagggctcactatgagcaaatgctaaagtaacggaccgtctaatatatgagtatcatatgtgatgcccccttgacaagaaaagactcgagttctttccagccttgcttgccatggcaggaaaggttattcagtggcgtagtcctaagcttcctgcggactagtatgtgctacacaataacactaagtgtattatatcacacaaagcgcacgctgaatggcacatgtacaagtcatgcatgaccatgacgatgaacggatttgtctaatcgtaattactgcttggttgctggtgaaattcagtcaaatatttgctgaaaattttaatttagttcagtttttaacttagatcggtttaccaagtggtttctcgatacatactgctaaatccccgacccctagcggtataactttcaaccaaattttgattgattttactgtttcaatttaaattcttgaaaaccatctaaatttttactcagagtctacttttgtcccaatcgaaacttcaaaatttcatggtgttcgatcggtttttgtcgaaaacgtagacccaaaggcatttgtcaacttgtgtcagatgaaggtggaacccataacggttttgctatttcacttgtgacatgtttttggactcttgtattttgattttttgtccataggatcttacattaagattcgtgtttgtatagatccaacttgtagttacactcttacaaaacacttatatttggttatagagcatttacactcagttacaatgcaccaaaattagatttcacaactgcatttgtttccagatttacgattttgacatatttatcctcttcttctatttaaagcactccatccattaaaaaaaaagctaacctcacaactagtataacgaatctggacacacatcctaatacaatgaatctaaaacctagatatactttatatacagattcgttgacacatcttactaagaggttgttttttttgggacagaaggagcagactgtatccattagttgaaaattttaactcccaacctatccaaaaatcaataggtaggtgatgttcatttatcctgaagataaagatgaagattatgttttttttgcaaaacgagatggtattaatatatgattgattaagttttaaatattataaatttgaaaaataaattaatatgatattttttgagcaacttttatatagaaagtttttacacgaaacacatcgtttaacagtttaaaaaacatgacatgaaaatcttaatattcatccagcttttattggagaaaataacaggaccgtagtcacgcacaaacagtctgcagctgcattgcaccgcgtggctgataagacgaagagaggagagccttgggcccctttcacctctttaaccccagccagcagcagaaccagtcgcgggggggcctcgcgggcgctttgaattgaactggccacggggcgagaactcggcgaaatccatccacaatcccgcacggcaaaacgcgcaaaaagaggggaaactgcaatgaaaaaggggccagcatgcgcgaacgcacagcccccggccgcgcccagatcccgctctgtcgccgtcgccgctggctgccacccttccccctcccctcct

SEQ ID NO: 75360 - DNA, 6920 bp, Oryza sativa
gtttcctctagaagtagaaagtagctcgaatatgtaaacaagactgcaagggaacacttgactgggacaagatataatctaagtttttttttatttttttgccaggtcggcgaaaggaagccgaccaaaattcattaagataaaggaataattacagaggtatacacgatataatctaagttttggtttgttacctgatataacaggagctgcagttagatctttggttgctttgataatagattagtagacatgggaggtgatatgtggaagcctttataatttagcccataacccacctcaactcatcctaatcatccttatctggcatgacaaaaatacgagagttagcacacagaactgtcttatgatgatactgcaaaataagatgtaaggaaaatttcactattgcaaatatattcatatgatcatggtgcataaaaatttagagccaaaactctatcctaccccaccagggccatgttcgctgatacattttgttggattgctctgtttttattttcaagatgtaattatccattatctgttaaaaccaccaaccagaacttattatcttcgttcatacttgcaggttagcgtgtgaaagtcatttcaggtactgcagtactcaaacctacctttctattaaaaagagaaaagaaacaatgttatcagtacatataaattcttattgctagcagttctgagtcttctgactcagcattcttctgctaaaaaagacaccacctgctcttacagtacccatcaggcaatcacaatcagttgattactagccacaactttcgatcctaatgcaatgtgctaatttccccttctctgttaattcagctacatcatcggtagccgcatttgttgttttttcgttcatcatggccacagcactctatctttcactgaagtcaaggtatgatgaagaggtacatttgaaggttgaaatgttcctcaggacatatggcacatcgaagcccacaaggtacagtttctctgatgttaagaagataacgagacgcttcaaggaacaattaggtcagggtggatttggaagtgtatacaaaggacgactaccaaacggagtgcctgtggcagttaaaatgatagaacactctacaggaaatggagaagagttcatcaatgaagtagcaacaattggacaaattcatcatataaacattgcccgccttctgggattctgctctgaaggaacacggcacattcttatctatgaattcatgcctaatgaatcattggagaaatgcatattcttgcatgaccctaatacttctcaagaactcctagcaccaaaaaagatgttagatgttgccttaggcattgcccgaggaatggagtatcttcatcaaggatgcaaccaacgcatcctccattttgatatcaagcctaataatatattgcttgactataacttcaatccgaagatttcagactttggtcttgcaaagctgtgtgcaagggaccaaagcattgttaccttgaccaaagcaagaggcacgatgggctacattgcaccagagctatattctaggaactttggggagatatcttacaagtcagatgtatatagttttggcatgcttgtgttagaaatggtgagtggaaggagaaactcagacccgagtattgagaaccaaaatgaggtctactttccagagtggatctatgagaaagtaattactgagcaggactttgtacttagtagggaaatgacagaagaagtagactgaaggttagacagatggccctcgtggcactgtggtgcattcagtggaacccaagaaaccgtcccacaatgacgaaggttgtaaacatgctaactggaaggttgcagaatatagaggtgccccctaagccatttgtttcatatgaaagccatgttgtgccataaatcatagtaatgttatgggagttatacttagttgacgtgctgcatagtaatgctgattaactgtatgaggtatgaatcgtcgctctttattaccatgtaataaaagtaataagaaacacatcagttgatgtgattaccttgttcagttgttgctatgatatatctccatccaaccaccgtgtgcagagtactcctcgttgcactatttcagtaagatgccctcctcgtccgtttcatgggtccataactagtggtttgcaacaaaatcctgcaaggaaattgaattatggcaatttttcccatgcagaactaatataaaatatcgaagcaaagagtattatttttgtctgtttgtccgtgcgaacggccgactagggtaacattcataccctgaattcgtcactgaataaagaagtagattcatatcctaaattactcactgaactaagaagtataataagttaagttggcttggtcacattcctatccatcccattcaaaaagtcagggcccgcctatctatctgatggaaatctcacagcaaacaggatgctgctgggcaagcaatcgaggagctacgaatttgcaatgtgaagagatgaatgggcatggactcgactagtgaataagtacactttaataaaaacttaggaaaaataatcaaaagcagaggaaacgggctacctttatcaatgcaaggagggggcagcgaaccgaacaaccaccggatcaggagacctccccgagttctgtcaatcctgcggctcggcgtggcatcccgcttggggcctggatttgcggctcgggtctcacaaggacgcagggagaaggcgacgcatagcccgggcaacgcgcattgacggcggagcgcaaagcagagacatcgccggggaagcagaggcggctgggagtcggtgggatcgccggcgacggcgaagggttcgtggcaagagagggaggaaaggggattccgtacggtttgcaaccagaaactaagctcggcctagggctagtaatggggccggccctaaagctcctgccgctaatgggcctttatttgcatttgggccaaaaatgacctgcgggaggcctgtcttctttctgctcgtggaaaattccatgtaaatcgaccatttgttttttttttagagaaatgtacctttacccggcctctatatccaacctgatatatgtagcctttttacattagaaatttagctctcaaataacccaatctgaaattcgcttctatagagatttgaactcaggatcttggggtgttactcaggtcacggcaacaactaggctgcattgtgcttatacaaagccaaattttaaattttaaaaacttaactttgaagtagatttcgtggttttttcacgaaagtttattttatagaatttacttttaaatcgctaagaacacgtatataattttttttacctacaaattatttttctaattgctgtaataaatcatacaaataagcatatggaaaagcaaaatatgaatcggaatcgggaatcgctagtcagtcacgtaggaaagaacatagcaacagtgccgaccaacacagaacactagcttagctcgatttttgcatgcattcatacagatgaagcacaggataataaatcgtacaagcccacatatacgcattctacaggaatataggaataggagcatagaaactgcatctgtgtgactgtctacaatcatcacaggcttgagcacaacctgctcacgaaaagacatagacacactatacttgctacgtactccactagctaattcaactcagtgatactctcctcgtctttctcctcggagatggcagccagctccagctcggaggacagatacagcgactccattgccgggatgtagtcatcgtcacagaagaatggcctaggaggaatttgcaaacaatcaacaccaccttcaagcatctctatcacctcgctcatcatcggtcggtcacaagacctcatctggatgcaccacaatccaacgatgcagagcttcttctccaactcatgcatgtcggcggcagcggtgatctcacctgtttcttgtcgggtcagctgacggtacactcgtgatggatagtatgcctggcttgaattctctgcattcggatcagcattccttcttcctccggccatctccaatagtagcatcccgaagctgtaaacgtcggacttgcttgatataacaccaaagctccgagagatcatctcaggggcaatgtaacctactgttcctcgtgcagcgctcaccggcacaaagctcttgtcccttgggtatagccttgcgagaccaaaatctgcaacttttggaacaaagttcttgtctagaaggatgttgtgtggcttgatgtcaaagtgtagaatctgcagatcacacccctgatgcaggtagttgattcctctggctatgcccaacgcgatttcatttagcttatccctggagaaactcttgtcggatgagaagatgtacttgtcaagagaaccccgaggcatgtactcgtagacaagcgctcttctcatttcttcagagcagaaccctaccaggcgcaccacattgacatggtggatccggccaatggtagagacctcactgatgaactcttctccgttgcagttggagttgccatttagcatcttgacggcaacatggatattgcccgggagcaatacgcctttatacacagtcccatagcttccttggcctagcctgtctctgaaatggcttgtgattgcaatgatgtctgtgtagccatacctcattgggctgagcatctcttgcattcggaggaacttctcaactgcatcgattgtgatccttgctttccagtatttgtgggaaaggaaggttaatacaacaagcggcgccaacaggaacctgcatagtactacataaaaacaagtttgtagggttgtttaggattggtttaacctttgaatataataggatcctgaagtacctgcaatccaagtcagaatggacatggctggtcctgttccgtaaattgcaaactcgtatgcaacacgaggcaatttaactggagccattatgcactgccagaaaggcccatacgctaaaaggattgctagaagtcgatttttgatgtatatatcagacgatggcaccattgtttgacgaaatatgctgcaggacaatgccatggtgaaaacggaaataaaattaaggtcctcacaaggttttgttggtacaaatgggatgaaaataccttacctaacggactctgccaggcatgctctaaaatcaaagtgatatgtccctgatgaagaagaaattccaatggcaaaccctttcctcatgtatttcaggacatcagcatagcttaagcttgcattgatagacgctcccctgtcatccagaggtgtcatgcccaggtacccacaagaaggctctaggctctcaacataaacagtttctgactccgagccagtcagcacgtagacgaaggaatggctggtgctcaggcaagcgacgggtttgtacctgacattcctcgttatctccttggaacaattcacaaatgcagcccacctatttgtaaaaggggccagttcaattacttggactccgtcactggtaggggccatggatatgcgctcgtgtggaggttgatgctgccgccgcggaagagggcagctgctgttatgtgaattcagcaagtctgtgtcaacgacgacgaaaaggctccaatggataatgcgagtcacgtagtatgttgcattgttgatgcgaattgtggccttggtgtcgctgcaaaccagctcgtgagatttatagccgcaatcaggtggatcgccgtgccggcggaacggaggggaaacgttcttgagatggccccaggagaagggaggacactgcgctgtctgcgctgcctcctcgggcccgtacatctgcccttcaacttgaaggagagctgcaagcacagacaaggcagttagcgcctgcagggcagtggaagtagaacgacgaaatgcaccagccaccgccatggcagacagccagacacagacagttactgttcgactagctagctctagctgccgcccaagttaccaagttgattagcaaagctagttgacgcgggtgattacctgctaagtactgcactgacctacattcagatgttgactggagtaatccaattcttaatcgcagtacagttttgatttgatctttaacttcttccagtaagtcaaatgcactgacctgtgcattattggtctagacaacctacaatgtcaggctaacttttcttttctgaaaccgaggcaggaaatgcaattaatatttgtaaacaagaaaaatgggctccagaataacagcgcggagctcaaagcgggtacacacgttgtcatgttcttgtctatcaaacagcaagcaaacgattagcgaccataagaacttcagacaaaccgaatatactaacaaactcctgcctaacaaggacacctgtactggttttctctcaatcttaatagatttggccggcgtttcctttgccagcccagcgaaaaatatatagatcataaaaatgtttgtttttagcaccgactgcagaatacaagtgcagactgcccatgatttctactgactgcggattagaacgggaagaatttcaacaggcagaaccgaaagcacatttgcatataaactacttaccccggccggcagtatttccgtagtgtttcaattgactattgctgaagacgacttgactgcagcaagccagcaagttcccattggacttagacaagtccacaacctcagtcttctttatatgatgatatagcttgccaactttacaagagtttatttctgtagaagatacatgtttcatgaggttagttatacaaattagtgagaatagtagtatgactgaagaaaataggacatccctgagttgagacaaggatagtcaaaataaggatcacagtacagctgtcattggcaaaa

SEQ ID NO: 75361 - DNA, 14195 bp, Oryza sativa
atcaggtattgtatatttactaggttgcccatttgcctggaatgtttgtatatgccgtcttgtgctcttgtgtggctgaaggtgcgaaacctctgcaaacctgtagatctcgaaattgagcatgatcccggtggtttgcttgatggaatgggtgctcaacagcaagcactacaccaccaaggttatatcggccgtggtcgtcgtggcggcgggtgttgggatttgcacggtcacggatgtggaggtcaatgccaagggattcatctgcgcttgcgtggctgtcttctgcacgtcgcttcaacagattgtgagtttttctccccccttaatcctgatactggacctgtgctgttatgcatttcaaattcccctttaggatgttaaaaatactagttatggatactgcaattgccaactactcaagcgtttttttgttaacactataggcttgatactcttttgaaactgaatcatgttgctgaggatgaaaaaaatcagtttttttttattgaacaatggtgtagcaatgtttttgtggtggcacttgtttttcaatcttctgttaatttacttaggacattctgttgtaacactattctgaattgcgatagcattcaaactaaagtgtggatgctagaaccttgccattgagtcctcagaatacagaaaactcagaaacagccaatctaaactgtagaatagtaatgctggccatagaattgtacatggaatgtttattttcgcatcataagctgtagatttgcaattctcacgagtcgtgatagactatttttatgtaccccttcagccttgatactttacattgtggaatttacatgctagctgtgaatcactttgaagatttacgaccaagctgaagcaacttttggactatttaccagtttctaaaacttggatcaggctgtggtccaactagggcaaccggggacggctccttttaggatactactagagatattttttgggggtgaaatggactataaattattttattagattgtccagctcaggatttgacttagaatacgacctgcaagctgcaatatccatcatgggaacatgtcaataggcaaaaaccaagctgggccatcacccctctattgctaggatgggactatgggaactaaagcctatataagtgttgaacaggatcatataactatgagttgagattggattcaacataactcaagtgataataactactatattattgaaccgtagacagacagtttgaagtggcagtcggacctgtgaactggactgcaagtggttcaccggccagcttttaaaaactatgcctatgatgtttatattcctgtaatcttattgcattggacagtgataaatatttatggctcttcgtacggtaataattttgatacataagttggtttttgaaatttgtggaagatgattacttaaatctgaatgctgatggatccttctttgtaaattatatgctgagttctgacaatgcgttacttgtccttgtcccagacaattggctcctttcagaagaagtacaacatagggtcatttgaacttctcagcaaaactgcaccaatacaggctgtgtctcttattatacttggtccctttgctgactattacctcaatgggcgatggttattaaactacaacttctcaactggggcaactgtaagttctctcgcatgtgcatgtcacaattttctattcatgacagcactctttccaaatgaatgatacctttgccatgttattgtatcttctactctagatttgtgctagtactattgagtattttattggaatgtttcatcaatgatttctcccattcttcatgttgagtggacatccccgcatcagtacaccactagtaaattgtcaactttgtttcccattgaaatattatttgttttgcctaatgttcatcccaagaaaattgttgaacgattagtttctattctatgactacagcacggtgaaactggaatttactgctaaccaaacagaacagttcctatcatgcagttttcgtgctgtggtctgttttaatcattatgcacttctccttgttgctttaatactcctactgggaattcttaaaacatgttctaacaacttgctatgttaataactctgcagttcttcatattgctttcttgctccttggctgtcttctgcaacatgagccagtacctctgcatcggccggttctctgcaacttcgttccaggtcctgggccacatgaagaccgtgtgcgtgctgattcttggctggatcctgttcgactcggccctcaccgtgaagaacatcctcgggatgctgctcgccgtgatgggcatggtggtctacagctgggccgtggagaccgagaagaaggcctccgccccaatcccccggaacaagagcgacatgctggacgactccgaggacgttcccctcaaggccagggtgagcggcctcccctcgtccgacctcgaggaaggcgagatgaagagctagctaatgacatattatttattcattcttcttgttcctttcttttttgtacgtgttcaaatccatatattgcccccattctgggggaagttcttgaagctatcggcacttgtgttaattttgcctcctcccttgttcctggggttcatagatgatgatgatgctgatgaaccccagccggtctcgacgtagatgaccattttagaagccatgttcttgatggcgtgttgttattatagatgacaagacttataatggaatacaggtgtttatccgttgtaggatgattctgttgaagctgtcgatattttttttcttcttttttgcttgaggtttggctacctgtctgcttgtgctgccatggtggtggtatctttcgccatgagtgctatgcgcatcggcatcgtgcattttgtcggggttgcctgcctcacatgggagatggtgggattggacagtggcacgtggcgaaggccggcaacgaggatgtcgacggcggccggctgccggcccagcgaggaaaagccacggccaatgacgggaatactaccttcttgtctttctctgcatgtgacgtgtgaatagttttgaactttagatgtttttattatactctcggttttggtagttctttgtccaatcaactttgtagatataattggagaatattcgtaatttgatgggtaatgggttctgtggagttcgattcagttggcttcttgtaaagtataatccgcctttgggagtttgggcgtgacaagtggcgtaatcatcaaccttaaaacgtgtaaatgagtcatgtgtcatgctatacatagggttcaacctctatgagggtaggataaatttcaagtcgagttgcctaattttccagtcagggtactgggtaaccccaccttcataaacaccatgataaaaaggagtactaatcacaagaatgcacaatcacacaccagtccatgcacgctttgcactggacgatatcaccacatacatgtccccctcttttgtttgccatcaactttgtccaaactgccaccatatgcattggaaaatcccttgcctatccggttagtcttgtagactccaatcacctggctgtcttgacacggaactcggatcaagctgctgattccgaacataattaacttattttagcgaaaagtacaaaaaattaattatgtttcacaatacaattgaaatatatatacactctccgtaaaaaaaaaaaaaactagaagtgaatgtgatatgttcggatttattgtactaggatatgtcacatacagctgtaggtttgtattttttttttacggagagagtatgtttgattgaaaataatgttaatcatcatcctattgaaaataacaaaatggaaagaacttctccaatttgtttatttctaaaggaagaccccctttttgtcagcttccttccttacccttgaatgttctcatcaactgctcctacagttctactgctattatactgctaccagtacattcttgacagtctttccacccttttgcctgcatgtgttttgaaattcttcatttcttcccgggcccgtggtctgtgaagtcaaattggatcgtttagtttatctgttttacttatcattcacctgatctcctaaacactagttggtccacgcatgtatccctttaacttgcacagtcgcggcacatgatctacccactgggacttccaaatgcacacacatacatgtgctttgaaaacgaataggcgaataactaactctccacgaccacgtctaccagtacgtactacttgatgtttttttttgctttatttatttttcctcgtgtgtgataggatattgagcaatctcatcgtcggtactttgcagaaataacaaggcaatatatatatacacgccgtgtcgtacccaattgctgccgaataaaatcgttggcaatatcataaatcgatagtactcgaaaatgtgtgatgtgtggttggtggcttggtgctaccgtgctaggatgatgccaagaagtacggttttctttttttggaaatctattgttctatctgacaaatcggattaaatcaagataaattatttttccgacaattatcgcatcccacgaaatttcaactattactattttacaaataacattgcaaagtgtagcacccttacattatttcttcggtataagaagttttggccctcgatatttttttgtctttctcttagctctagttaatatatatatatatatatatattttgtcttgagtggtttggggttttgtgctattgggccacaccattaacttttttttttacatataacatcaatgatactccaaatcatttgaaattcttttcattaaggttttgtgccacgccattaagctttttttatatacatatagtcaatgttagcttatctgaaattcttttgaagtgtatcaaattataccatcatttgcaccaagtaggtataatgcgacatcaacaaaaagcaccattaaaaccatccatcatccatgcgtcaaacatggtttgatggtttaaatatctcacgggtattcaaaagtttcttaaacaatgttaccatacactatgcaaaattgcaaatgaaaccaaactatatagatttcaaccatctaaattaagctggccactcgtatactcccttcgtcgtaaaacaaaccaatagatatgatatattataatactatacagatttgtggggttagatttaataagtctcagcacagcaactgaactttcatcctttcgttcctacagttcgtcagttcgtcacttgtcgccgagggagactggaatgcaaatcaaacgcacacgccttgcacgacgcactcatgcgcacctgctccccctataaatcgagcacaaaaagcctgtctctcctccccacaggtagtggaacggagccaccgcccaactcgcccccaaagttgcccatctagataagaagaagcgtcgcaactcacggtcgcagtgccacgccccacttcatatcctttcccttccccaactgaaccaaaaaaaccaccggggaaaacttcttccttcttcttcccctttgaagccatgggtggctttcccccggttggcggcttccgggttcggattttcccttttattcccgccggcgggaaggctgggacagcaggggcggcggcggcgtcgtacgcgcagcaccggcggaggttctgcgccatcgtggcgaccgcggcggcgtcaccggtgccggccgcggcggcggcggcggcgacggggtttgattttaacgcgtatatgggtgagaaggctgcggcggtgaaccgggcgctggacgcgtcgatcccggcggacgagccgcccgcggcgctccacgaggcgatgcggtacgcgctgctggcgggcgggaagcgggtgcggcccgcgctgtgcctggcggcgtgcgcggtggtcggggggcgggaggcctgggcgatgcccgccgccgccgccgtcgagatggtgcacaccatgtcgctcgtccacgacgacctcccctgcatggacgacgacgacctccgccgcgggaagcccacctgccacgtcgtctacggggagcccatcgccgtgctcaccggcgacgcgctgctctccctctccttccaccacatggccaggttcgactcctaccctccggacatcgacgctgacaagcaccccgcccgcgtcgtccgcgccattggcgagctcgcgcgctgcataggctccgagggcctagtcgccggccaggtcatcaactcgtcattttctattcgattccttattcgagctaattaagaaaatacaaattaagcaatgcactaattatgtggatcatactctttcctaattgctatgttttgtattgctatctgcatacgttttaattagatgttgttaagcaatgcactaattatgtgaatcatactccttcctaattgcgatgttttgcattattatctgcatcgttttgactagatgttgtaaatactcttaaaatagaatgtgacttcgagttgtgtcgttgctgaaaattgtttgttaaattttggataggttgttgatcttgagatgactggatcgaccgaaactgtacctcttgaacgtcttgagtacatccatctccacaaaactgctgcattgcttgaggcatcagtggttattggggcaatcttgggaggtggctctgatgagcagattgaaagtttgcgcatgtatgcgagatcgataggattgttgttccaggttgttgatgatatacttgatgtgaccaagtcttctgaggagctcggcaagacagcagggaaggacttggcgagtgacaagacgacatacccgaaattacttgggctggagaaatcacgggagtttgcagaaaagttgctttctgatgcaagggaacaactttcaggatttgatcaagagaccgcagcaccacttctgcacctggccaattatattgcctatcggcagaactgaggtgatgggtactccattgattattgttgatttgtaactttgtaagctcattaagattcagatttgaggaatatctgaattatcttgtgatacgtgctagttgtagtttcttatcttgagaagaatatctggttgacaaatgtcaatttcctagttagtcagtcaaaacggaataatgaaaatcagcctctctgccctataccccaattgcttgattcttgacaattgaacacatcatatcataaaggaagaaaatattttatcttcattgttttgattgattatcatagttcatgttcatacctgttttagtgtttatcctacgcaattgatttcgttttatgtgattgtatcaggttcgttttacaatgagtgtcaatgtaagctttgattcagggatgagcttgtcttggaaattgttctgttgaacatgtgtttcagtgatgttcttctgtttacagcaattgggatcaatgtttctctaacagctatatatatgtatattcttggttccaagcatgcagaaaacttcaatcagagaaagtgtttagttacagtgccgtagtaaataaatcggttataattgattcctgtctataggtgtgcattcagtcttttggtcaattcgctttgtagcaaaattcagttagtcaaaactcaggaatgaattgttattgggaaaaggcaagaccgaaattcggttaatcctgtctattgctcaaaaacctatacaagcctttcatagtgaatgtagcccctgcataaggtttcctgtacaggtacagtaggaccttgactaaatgtttttcattggaataatggaatggttataagctgcacctttcttgttcttttctagcttcttgcgcaaacttattgctctatcttcttgtctttgatctcattgttttactgaaagtactgggattcaggtgatatggaaagcacaaatgggactaaatttggttccccggtccagtttggctgtccatatgtggttttagtttccaagttgtttgaactgaaaagagtagtctgaaaaatttccccatcatgcatagaagttgagctgcaagtcaaatggtcactggtcagtttgagcgtggtattctttttcctaccatgtgctgtggtggtcttctggtcactttgccagtgaccgctgtaatttgtaattttgtatcatgagctccttggcatcccagtccgagttcgctttcaagactttccagtatctttggtcggaagaagaaaacaaaatcatttgttctgacgtttcctagtactgtcttctgaatttagtaacctgatggatggaaaaatatgaataatgtgttttgacgtcgaaacatgagtcctcggcaccccaagactgaatttgcttcaagaattttagcatctcgttggaacgaaaaacgaatcatgtgtttttgacatttcctaattgctgttcttctaatttcgtaacttgatggatggacaatacgaaccatgtgttttgacatttcgtaatgctgtttcgtggaaagggcatcgtgactagacaacatcttgggagagaagtagggagtagaagcaggcaattaacacttgattgaacgttcttaatagttgacaccttgatactaagtctgaaagtctcctcagttgccctaataaatcaaagtaaaagcaaaaatttaaattcaaaattgattttaagatatttttaacataattatttttagtgctgaattttaagttgctacgaaaattatataaaaattttaccaataaatccatcatgaaacttgttcgatgtccgtatcccgaactctgtaccttaaactatttcatactctggtcgtttggtgaagttgacctactgcagcagcagcagcaccaccatttacggtgaacatactactcctacaaaagaaaactaagaagttttaggctgcttttccacccccccccctaactttcccaatttctactcacttattttctaggatatttaactttttatcattttaagatgcggcaattaaaaatttgccactcgcagtaaatgccatgttggtccagtggcaagtccttaattgtcacttgtaacagtgacaaatagttaatattcccttattttccacgggcatgctccacaaagtgttaaacggtgcatttcttttaaaaaaattgctatataaaagatgttgtaaaaaaatcatattaatttattttcaattttttaagctaatagttaattaatcattttcgtgcgaagagaaaaacttcctgcattttttctccactttcttaacttctccttcatcgtttttcacgcacacgcttttccaattgctaaactgtttcttttaaaaaaatccattggaaatttgtataaaaaattaacatataggcaaattttgctgtatgacactgtggctttatggttttaggtttaggacatgacaaaattcgatctttggggaagacattattaaaatatgattatttgctgcaagacgccgcatgtattaatatattattttttggttgaataggagagataaatagcgtgaaaagtcaaaaatgcccctaaccctacttgttatatactttctcttcctcttcctcttcctccttatttccccttcctgacatcgctgcacgggcacatcactagggacatccaagttaaaatccattaaaaggaaaacctttgaaagtctaatatttcgaagaacaaatacatggaaatctagaagaggaaaaaataacgaagcactaatctcatttaggccccaaataaacgttggatttaaagtttatatgctaaattatagtggtttaacattttatattatatctaaaataaaagcaaaatgattcatccaaatgttattaaagcaatgacacatccagatctatagatttgtgacactagaaatatccaacttcaaaataaatcctaaatcgaagttgtgacaaataggtttaccgtatctatggccatcaaggaacaaacagggtgatgagcagcactaccatcgactcggatgattggggcctgggggtactggactacatcctccctcttaccagatgaactctttccaataatgtgattgccggtgttgtatctatatccggaggctcgtgtcagatcaaagtaacctaatgctcaacatcataaaaaagaaattaaaatagtactaaaagcctttataaaacatgtggttttagaagaccatacgcggactaattggtggatgcatgaaccgacgtgtcgattttcaagtatgtataaaatcaaatggcccaactcaaaagacggcggccagaggtgcgggcggcgcgacggccttcgtggatggcggcggcggcgcatcctggcgagggcggccgggatccggcctccctaggccagatctagccgggaagctgccgggctagcggcggctgcggctggaggtggcgcagcgcggaggctgcggcgcgtcagctgcggctgcacggcgtcggcatcggcggcgctggaggtggtgcgacgtccgggcagctggacgacagcggtggtgccggtgccggatgcggtgcggtggccgcgctgctggacaccggtgccggaggcggcgaggcggccgggcggctggaggcatgaccggcgatgctgggcggcccgggtggccattggtgggcggcgaggtggcggcggagcggtggcttcggcgaggccgccattaaacctggcggcagggtagatcgcgctggcggcgaggtcgtcttccttgtgggtggctaggcgttcactgtgtttggggagctcctccccttcttcgtggggagcttttaggcacggtggaggcgttggccggcatacagggaagactcagtttgccaaagcgagcttgttcccgttccggtcccataggtcggattcgacatggaggccgacggacggcgtggcggaggtggcctgggtcagcgtgcaagggagtggaggcagggtaagggcgctggcggcggggtcgtcttccttgtggtcggccaggctaatcctgtttggggaactcctccccttctctgtggggagcttctttgcaggctggaggcggtggtcagtctacaaggaaaactcaggttgccgaggcaatgttgttccttgtctggactcccttgggccgcattcgacggggatgccggcgtgcagcgtggcggaggcggcctgggtcagcgcgctggcgaaggtgggtgctgtggcagtcttgtcattggcaggacgggaagccggccggcggaggggcgtcggtcgggtgtggcggaagccatgtgccgccgatgtttagttggtggtttcggatttggcgacggaccatggcggtaaggggttccgagcgaaagcttagcccaatttctttgggccaataatgacttcgctttcgggcgtggtaaccctcctgagggcattgttgaggtaccccttatccctcgacagggagctctgggtgaaaaccttgtcccgtttttgggacggatgacgacggagtttttggcgtcgcaaccctcgtgagggcgtcattttagagtcttcgcgttgtggtggtgttattggcccggtggcgatcggtctcgcatagcgacggccggttcggtgctcggcttccctctctgtagcgtgtgtttgggcggttggcacacgttcggggtgtgtgctctggtgcacttccttcctcgacagccaactctgtaaccttttcttccaatcttaattacattgaatgacctcctttggtcattccggcaaaaaaaaagatggtatttacttagcctcggcagcctacaaaatgttctttgaagtcatgttttcgtaagctgttttggaaggcaagagttctaggaaagtgtaaactttttatgtggttggtgagttagggaaggtgcatgcttgatggcagataatctgcagtggcgcggctggcctcaccaggccctgtgttcgttgtgccaaacggacaccgaaacctgcaatagtgcaatgtcatgggctttgagctgggagtcctaggctcaatgggaacgatatccccatccccgacgataagtacttagtggatagagttagatcactgttaggatcagattaaggagtttgttaggattaggttaaggagtcctccatcaatataaggagggatcatatcctagatcagttaggtattaaggggttgtttggtttgcaactaaatttaccacatctaaccttaggcaagccatacttttagttgatagtgtttggttcctaccacaactttatattgcctaactcttagccacctaatccacatgtcataaactctattttcttgcctaattttgtctaagcttagtttgtcattcatcttcatattgtttgtcacaaaagtgtggcaagactattagtcaccttagtaaaaaaagaatgtgtgataatattagtccccaaccaaacatactctaaatcaagatttatcttagtgtccattgaccctgccttctcggtgcgacggagagcatcgcgctgtctaggttatctgtttctttctctattataatccaatctattcccttcaccccgtctcatcctaaataatcccagcacgtgacaacatggtactaggtcgctgtgccttctcgttgcaaatttggttgagaatctgccaacggataggaacggtgatgttttcacaggagatggtctcttttgctgggtgatacgaagtccggaagaaggttcacaaagaacagagaaaactgcttgactcgatggtgatcctcgtcgcatgggagatttagaaagagcgaaatgccagggtactcattcgtatttggaaaagagttcaatacgtggaaattagctggcttaatccggtcttgaatgtatagcattagtagttaactgttctcactactaggaccggctactcctggtgatcagcttgtatatattttgttgttcgtagcacctattttgtgatgtacccttctctccttccgccgttctggcgaaaagagaaggtaacacaccatttattttcagaagttgtccatactcctttgcgaactggagcaactttatgtaatccttggaaataatatgcccactagaaaaatgttgtaccaaaaggtacgatgactgaatcacgccattcctgttcgttcctaagaaccaatatactacgacattgacaggagctccatttcatatacaacacagaaacctcaaatgagtgttatagtcaagcgatcaggtaatacgttgaattttgctgatagacgacttctgaagtttggtatataatggagagccacaggagatcacagcacatcagtatccagctttctgtttaattatatcaggtgctatctctgaagatcttttcgcctttttttttttatctttcgagtcactaagtcaagtttggtgggcggctttcttgcttgttatcctgatctgagcacatttcatcaattcatctgtgtgtctgaaagtctgaatgtctgattcgattctggagatacactgcgcagggagcaccggcgggatgcccttcaagacgggtccaacaagcacatgcgcacatgccggctgatttgccgatcaactcctggacttcgaaccgtactgccatcgaatattgttcatagccactgaccacttcagttcttcgctaagtcaaatgccagcaagtccaatcctggtcgtaggataagagaaaatgatggaactccagctctgctgttcatgttacttcacttaacgttcgctcaggaagatgaaacagcgaatcgtatgtgtttctcctgtccgttcgctcaggctttgtggacgcagatcaacgttcaaccgcaagctcaagacgtcacgcagttccatcgtttgggtccaactacgcaagttccggcgctacactggcaggtcttcttcctgctttgcatgtgggctatttggaatcatcgacacgatgttgttttccgggggaaaagcccctcactaagagcctgcctacaacgatgcatcaccgaggcagctctctgggcagagaacttaacggaagatgatcgatttgtaatctctgttgggaaacaaatcttctcctccccattacaatctatcaatcttttgtaatgaacttcgtacctctaattgcaatgacaaattcaggtgggga

SEQ ID NO: 75362 - DNA, 2843 bp, Oryza sativa
ccgtcggcgtgcccccgcagggtggcgatggcggcgagcgacgacggggagagcagcgcgaccgtgccgtcgagggacgccgtcgcgaggaggcgcccgcatggggagaacctcacgcacgagacggcgcggctgtgcggggtcgccgccctcacctgccggtacggccggtacggcggcgccggcgcctgctgctgctgcgacatcagcggcggcgcgccctcgccgacggtgaaaaggtggggaaaagtgtgagacgcgtgttctcctctcttcgacacggacccgagatttgatcaaaagtaccttccattaaaattgaaatttgaggatttattttctttgacgcaggatttacttttttaaacacagtaaaaacagtgcatccaaaactactcccactgtcaataaaataaaataaaatacatactactaagagaggatgtgacctctccagcccttgtaatacgacgaatctaggagagagtagacctcagcgtacactctttccctgtaaacatctaaaaaaaccctgctccctccaactcataatataagggattttgagtttttacttgtaatatttaaccactcgtcttatttaattttttttgcaaatataaaaaataaaaaattatgcttaaagtactttggataataaagtaagtcaaaaaaaaataattctatttttttaataagacgaatggtcaaatagtataagtaaaaactcagaatcccttatattatgagacggaggaagtataacttatggtgacctcggatgcctcgacagaaacattgtcaaaataattaaacataaatagaaatatctgtgtgaagtttagaatttaaatgcaagtgaataggtttcactacaaggaagaaaattgttcacttctcgagaatttactcgtatttggttaagagcaggtagcatagcaaagtataaaccagctataaacatatgtcgagaagataaaagaaaagagagatgaacaacaagctatttatagctaggtgtaacacggactccaagacacgatgtatattatgacaggtgagaccatctattaatagtggttatatgtttatagataactaataattggctatatctctaacactaaaacgtggctatagctctaacacaaacgtggacaagagggaccaggatcctctgtagccgaagtcacttaactttatcactgatatgtgggtttgataatccctagattcacatgtaagtgataaaaatatcgtgcatttgactgcagagagcatctcagtccggataggaggggtaaatcacagttactgtaccaatccaaaatatttggtcaaattttacggttgcggattcgcgacttcacgtttcccctttccctatcggcggcgtcccaaatagcgaatcggttcgtgtaaaaaaaaaagtgagccgcttagcctcgccggcgccgcctctctccgggaagcggcggcgagaacgcggaggagagagagagttcggggttggcccgtcgcgtcgccggagcgatggatcttctgaagagggagctggagaagaagcggaaggcggcgacggccgacttcggcgggaagagcttcgtgcggcggtcggagctggagcagaagcagctccagaagcggcgccacgaggagcaccgccagctcctctccaaggccccgccggcgacctcctccgcctccgccgcgggctccgaccccagcaaccccaacgccgacccggcccagtcctccgccgcaaaccctaaccctaactcctcctcgtccgccgccgccgcgtccgtcccgccgggcctcgcggggaagaagaccgcgcaggatgaggcgctcctctccgaggagcgccggatcgacgagctcgacctcccgcggcatgaggtggtgcggcgcctccgcatcctgcgcgagcccgtcacgctgttcggggaggacgacgccgaccggctcgcccgcctcaagttcgtgctcaagtccggcgtgattgacgacatcgacgaccttgacatgacagaggggcagacgaacgacttcctccgtgacatggtcgagctccgcaagcggcagagggctggccgggacacctatgtcaagggcaagggcaaacgagcgggcggcggtgatggcggcgagggtggcgctggcggggataatgctgatgatggggatggggacggccggaggagtggggatgatgctgatgcggacaaggactcgaaacggatgaagaccaagtttgaggagctgtgtgatgaggacaagatcttggtgttcttcaagaagctactcattgagtggaaccaggagcttgatgagatgccggagctggagaagaggacagcaaagggcaagtcgatggtcgcaaccttcaagcaatgtgcgcggtatctcagccccctgtttgagttttgcaggaagcaggtgagaatccttttgtactgcatcaataagttacataaacaatgcattgttaaatgttaatttggttgtgtctataacttcagtaattgttagaaaaaactttaactaataaaacaatggtgtggattaggatttgaaatgaagcttgtagctgaatggcttacgtcgaagttatgatcctgggacctgggtaactggttaccatgatgaatgcattttatgaccatatcagaaagaagagatggcaaagctcggcgtctatgttttttgtagaaactgtctaactgtttgtgcttcactgttcggagctttgatatttcgtggtaattgtggtgacctctatgcatggcacctgggttcttaaagaacagcttactagcatatcaagaagctttagtgtc

SEQ ID NO: 75363 - DNA, 747 bp, Oryza sativa
ctttgttcctattgggatttgcctttgttctctactagcattatattctgatcctgaattcactgttatatagatacttagctgtccagatttagtactggcattgaaattaaatttctacaaaattatgccttctgtcatggattcagcctcaatgtaattttggatttccttgcagtggatccagtttcttactataccttgttgagctaaatcatattgctcatatgggggatatttttatgcattttaaggctacctatgacttccttgactacatattgtttggcaactctgataccaattattgttttgatttatgtttaggttcttcctgatgacatccgtcaagcattgctcgttattgttgaatgctgcatgaagcgtgattatttagcagcaatggaccaatacatcaagctggccattggcaatgcaccatggcctattggtgtcactatggttggtatccacgagcgttcggcccgagaaaagatctacacaaacagtgtggcgcacattatgaacgatgagaccactcgcaagtaccttcagtcaatcaagaggcttatgaccctttgccagcgacgttatcctgctctgccctcaaaatcggtggagttcaacagcctggcaaatgggagtgacctgcaggcccttttgtcagaggagaaagatccaggaaaccctcctagcgaggataggcttcgactcatgccagcgtcaaaagagtgatgcttcaacgca

SEQ ID NO: 75364 - DNA, 2422 bp, Oryza sativa
atcatttatcttcttaaaatatgtttgcagctagcttatagcctgctattgtatcttctctaactgtaatacattatgaatacacagacaaatatcttgaaaaagatacattatgtcattgaaacatttgaaaaatacacagacaaaaactagtgtgcaatgaaccaacattagaaaaacatgtaaaaaatatgttgataagtagagtgcaacatcaataataagtagaaaaaggcgaaaccctgttaaattcaaggtgaaacattttctggaacattaagtgccaactatcgaagcatcaaaaataacaaatctaaaaacatgaaacacagtcaatttcaagatataacatttcactattgcccgtgaaaaattgtagtccatttgttgaaacatcaagatttgcaaagcataccaatatggctttcttcctcccgcttccacaccaggttgtagagatctcattcgccagttacagcgtcttgacatctccattgtagctgtcgttagcttcatcatccttatgcagtcgtgcgtcaactctactttgtggcatgacgaagcaaacccgacgcccaacaccacacatttgcacatgtcagtatgtcactccaccttgaaggtcaagtttcatctgaggttgctgcctcccggctacttccctgcgacaaccctttgcttagccacctttgctcacgaccggttccccccgagcactatatggccaggtccaacaaggagatggcaacggtgaggaagaacttgaacgggaacatagaggcaagggagggcatcgatcttaacaacgtcaatgatgtggggatgggtttggaggagattgctaattgggttgcttattgacatgcaaggatggagagagtgaatgagttttgggctttggatgcctgaggaaaagcattatcgtccctatttccctcaacaccatatcatcacttgacctctctaacttgattctgctatagacctaattcatcatcctctgttggtctcctcttcttctcctatcttagatcattatgtcaaggtcttatttgcattggttgaaatccagcccgtaaattatacaagatctgaagaatcatttgagattgtgaaacgtcgcgtgttgcataaatggaagtggtcttccagacgaaggtctacacacgtggactgtgatgtttggctcagtactaagcttttttaaagtttgccgtactttacgactctattttttgtttcattacatctagtttggctcggcatgcatgcgcgacaatgttagggaaccatccacacagatcttacggtggatgtgccacgattgaggcatatccaaatgactactcccaccgtctcaaaatataagcatttttagcacagtaacaagtcaaacatttttaactttgactattaatagaaaaaaaaaatcaatcatgtaaaattaaagttactagatttatcacgaaacaaactatcataatatgtaactctttttatttaaaatattatttatatatatattaattattggtcaaattagcatcttgtagaccatgttagagtctgaaaatgcttatattttgggacggagagagtaagttaccagagtatttgagtaaagcatgggcggcgagaaatctcattgccgacccaagtacccaactgcgagtcgaattcaattgaaatttctcaagttcaaaggaaatcaaggtctaccaagtccaatggaactgcaaaaagatgttcccaataaataattggccacttactcacttgccacagcgcgtgtcaatccgacttgcacccgttgtccgttgcacgtgcaagcagctatagtcatctggaaatggagtcgccgccggcgcacgagcagttgacgagaggccggccatggccgatcggcatcgtcgtcaacagcgggttcctctcgaagaagttggacggccggagctcgagcccgccgctcagcgtcggcatcaccgggaagtcctcctggtacggcacgtggtgcagccccaccgtgtaccacagcacgatgtcctcgccgcggatcgccctgtcccgctcgctccacgcagcgaggccgtcgccgccggtgctctggtcggcgtacagccccgacgcccacttctccgacctgctgtacggcgtcacccgcacctgcttcttgcagtaggcggcgcgcctctgcgggaagtcgtcgtcggccagcaccgacgccgccatcgcgccgccggggacgacgcggtacccgacctcgttccccatcctcgtcttcttccccgggttgacgaacaccaggtcggccggggcgccgccgccgaggtccacctgcccgtccgcctccctctccgccacctcccgccgcaccgtccagtagctccgcctcggcgtgtctgccggcgcgtcggggtcggcg

SEQ ID NO: 75365 - DNA, 7668 bp, Oryza sativa
ctctgatgtcaagaagataacgagatgcttcaaggaacaattaggtcagggtggatttggaagtgtaaacattgtccgccttctgggattctgctctgaaggaacacgacacattcttatctatgaattcatgcctaatgaatcattggagaaatacatattctttcatgaccctaatacttctcaagaactcctggcaccaaaaaagatgttagatattgccttaggcattgcccgaggaatggagtacctgcatcaaggatgcaaccagcgaatcctccattttgatatcaagcctcataatatcttgctggactataacttcaatctgaagatttcagactttggtcttgcaaagctgtgtgctagggaccaaagcattgttaccttgaccaaagcaagaggcacaatgggctacattgcaccagagctatattctaggaactttggggagatatcttacaagtcagacgtatacagttttggcatgcttgtgttagaaatggttagtggaaggaggaactcagacccaagtattgaggaccagaatgaggtctactttctggagtggatctatgagaaagtaattactgggcaggactttgtacttagtggggaaatgacagaagaagatagactgaaggttagacagatggccctcgtggcactttggtgcattcagtggaacccaagaaaccgtccctcgatgacgaaggttgtaaacatgctaacaggaaggttgcagaatatacaggtgccccctaagccatttgtttcatatgaaagccatgctgtgccataaatcatactagtaatgttatgggagttatgcttagttgacgtgttgaaatagtaatgcctagaaattgcataatatgcaccttgactgcacattgattatctgtatgaggtatgaatcatcgctctttattaccatgtaataaaagaaataagaaacacatcagttgatgtgattaccttgttcagttgttgctatgatatatctccatccaaccaccgtgtgcagagtactcctcgttgcactatttcagtaagatgccctcctcgtccgtttcatgggtccataactagtggtttgcaacaaaatcctgcaaggaaattgaattatggcaatttttcccatgcagaactaatataaaatatcgaagcaaagagtattatttttgtctgtttgtccgtgcgaacggctgactagggtaacattcataccctgaattcgtcactgaataaagaagtagattcatatcctaaattactcactgaactaagaagtataataagttaagttggcttggtcacattcctatccatcccattcaaaaagtcagggcccgcctatctatctgatggaaatctcacatcaaacaggatgctgctgggcaagcaatcgaggagctacgaatttgcaatgtgaagagatgaatgggcatggactcgactagtgaataagtacactttaataaaaacttaggaaaaataatcaaaagcagaggaaacgggctacctttatcaatgcaaggagggggcagcgaaccgaacaaccaccggatcaggagatctccctgagttctgtcaatcctgcggctctggggcctggatttgcggctcgggtcgcacaaggacacagggagaaggcgacgcatagcccgggcaacgcgcattgacggcggagcgcaaagcagagacatcgccggggaagcagaggtggccgggagtcggtgggatcgccggcgacggcgaagggttcgtggcaagagggggaggaaaggggatggaaaaagtacaccgaaggttcctcaacttgtcatcgggatacgaaaacatcctcaaaccgcaaaaccagatatgcgggatctctcaactatacaaaaccggtcacccgaggtccctcggtggttttcatcccggttttgtccgacgtgacggctgagtcagcgtgggacccacgtgggccccacatgtcagcgggccacgtcatcaccctctcctctccctttctcctctctctctctctctcactcttctcgtttgggtaggcagcgggggacaacggcgtcggctggcgactggcgacgcccgccgttgcagaggccgcacgcacggaggtgggccgcgtcgagtgaggagaaagcaagggggccggggagtccggcggcgacctcctcaccggccgcgacgtcgccatcaagtccttccccaaccggcgacatggcggccggcgaggggagcaaggcgtccgcggcggcgaggctgttcttgtccgcggccagcttgacccggcgcaacgacgagccaggcgcgggcgacgagccacatgtggaccgtccacacgccgacgctcttcaccttggcgctggcgccgcctcgtccgttgcggccacggcggactccgagagctccccggccgcgaacctgccggcgaggtcgtggaggtaggccgccttgcgggcagagacgccgatggcgcggaggtcggcggcggagagggcgagcaccgcggcggggttgaccaccgcggcattgggatcggcggcggcggggaggcgcgtgaggaagcgagcgtagatggcggcggcagcggagggagcgagcgtagatcggctgttgctggccatggcgacgtcacggaggcggacgctgctcaaggtcatcgtcctaggcgacagcgggtcagcacactacactagctcatccttggctactgcaggcctagctgtttcatcttagcttgattcgaatcgctctagctatgcttctgtcagcttgatttcatggtgcttgtttgatttttgcctgactcctgacatggattggtttatttggttgtgattttggttttggtgcaggttggggaagatgtccctgatgaaccagtatcctttacctccatagctgcctagctgcatatcatcgagctttgtatcctgcacatctaccatggccaggatgagcttgagaccgagaggccggcggccgcgggaggcctgcggcgacgaccgcctcagcgcactccccggcgacctgctcctcctcgtctccgccgcctctacacccgcacggcacttgccaccggcatgctctccaggagctgggcgcatctgccccacgagctcccggccctcgatttcagggtcagcgacatactccgccgcgctatcaccggtgaccggtgcatcctccgccaccgcggcgtcgtcggcgcgtcaccagtcgccagccgccgccatcgtgtcgcccgtcaccggccgccggcgacgccctcgtcctctcccaccttgccccgccgaaggcagcagcccgccgacgtcctccccagctgccatcccaaacgagaagagcgagagagagaggagaggagagggagatgacgtggcccgctgacatgtggggcccatgtgggttccacgctgactcagccgccacgtcggacaaaaccgggttgaaaaccaccgagggatctcgggtgaccggttttgtataattgagggatcccgcatatctggttttgcggtttgaggatgttttttatcccgatgacaagttgagggaccttcagtgtactttttcctcttacaaaaggattcggcccaagagcttaaccggtcattaccacgagccttcatctagccttctaggaataagttcaccggtggtcctcaacttaacagggagattttttaggtcctttaaccacaaaatcaatacccctaaactcacacaaaccgtgcactcaagatcctatggcagtatatatgggttgtttagcaacgtggcatcctactcagcaaaataaaataaaaaaagtacgtggggcccacattgtcagctgcacattctcttttcttctccttctattctctttcctctcttcgctcttctcttcttcagtaagggaggtcgtcggcgggcggagcggcaatgggcgagcgcgatgcgtgcagcgagcggagagccgacagcggcaagcgagcgtggcagcggtccacgggtggcgggcggagcaatttgggagggagggggaggtggccggcgaccccgtccgagctcgtctgacttacgtgcgagctcgcccccgacgtaactcggtgtgctggggacgacgacaaggaaagggggagagagaggtatcgacggccgacgacagtggaggcgggcgagctcggtgacgggctgctcacgctcgtcgaccaggccccccgctctgtactcgcccaccgctactccgcctgtcgcgctcatggaggaggttgaccagcacgacgacgacgccggtggtgaagatctagagcatgacgagcgccgttgctcttgcccgccgcccatggctagcttcgctcgcccgtaactctattgctgctctcgctcgccgctcttgcttgccgctccgcctgccactctcactcgccgccccacccgccgctcccgccgtcccggcggcctttctccccctctcccgcttcttccccgcgcgccgccgcacccgctccgccgtcggctaccacgcccgcatctgcccgtctgctcctgaatgtgcaactgacatgtgggccccatgtatttttttttatttttttctgactaggatgccacgtcagcgaaactacccatatatattgccatagaacgttgagtgcatggtttgtgtgagtttagggtgcacatttctggttttgtggttaaaagacctcaaaaaatatcgttgttaagttcagggacctcaggtgaacttatatcatcaaaacgcagcgattgtagataccatagatacataaaatagatcaaaaggtgacatcacatctcaaggcatcagcatactgatatactgtttgtttggttcatttgattagtggaggcttgcagctctgtagctgtgccgctgcgcgtgctatgctttcctcctgcggtcagacaaacataaacagggtgtgtacatggaatttgttagtcagacataaatatattggatatttgaattacagctcccagcggtaacaacaggcactactaggctgtccaaatcgtggcatttcttttcagcaaaaacaggtccatataacctcccggagacttgaccatcactatcgggatgaactctggcgtgctcatgcagcagtagcacacacaccagtacaccacataaaatgcaacgaccaacaacacatttggccaatggccacacataacgatggcgtcccaatcacaaagttatgataaacgaaagcttccctctagttcacggcaaagaaacgacccggtcagtcaaggcaagaagctgcctccttccgctagccacactgacctctggagtcaacacctccagcgttgcagtgatccgaatgccacaccaaagcagagaaccaattaggaatgtattgagtagcattttttttcagaacttttttgaacgacttgcacagacagtgtgaaattcaaattgatatagtaggaaaaaattacaaaattacaaccttgggaggtcgtaatcaggaaaaaaacaaagatttccacctcccacgcaccgacagcaccaaacacaaattgggaagaaggctagcaccaaaccggacgctgctaggccaacaaaggaactacagtcgaggtcgcccaaacctatccctaacatctgacattaaacccctactctagccacctctttgggattgagagagaaaaagggtgagacagaaggatggaaccgctctcccccataggccctctgacatggtcaacttgcataagctagggcgctgacacgagaggacatgcatctagagagctagcttgcaccaaaagtctaggaggattcaaccagggttgcctagacgatgtctccagggagaggagcgaataaaacaccgccgccgccgtccatcgagctctcaaaaagagccaagactaggttttcacccaccgaccaccacctgcaaatccacggctgacacaccgatgctccaccaccgtcaaacctttgccgaaatgtgggaccactgcaccgacgccccccgccggctagcctccgcgtgccccacaccacaccgcacccatcggcagctcctcctcatgccgtgccgacctacgtcaccgccggccacgccttcttgcgccgtgctagcctccgaccactcctccaggcgtactagccagccgctgccacgtcggcccatccgctggccatgccggccagatgtagccatcgcccacgcctctcctccgctggccgtgccgaccatatgcagctgtcgtccatgcctcctgatgtgaccatggctactacggatacaaccattgcttacatcatggatgaacaacaggagatcaagttcaagacctccaagtgctggaatccgattcggccacctgctagactgctgacttcaaacggccgccaaatctacatacgacctccgttttcggcccgcgagtacttgatggaaagctcttggagtcctctttccaatgggttcagcctcatctctaaatcccatctcatttggccgcaatcaaagaaacaaggtgttgcgtcacatattataatgtgcttatgggcttgtaacttcatttgtgaccttggcccaagtggggcccatgtggggtgcgccccaatctggtggagcacgaccctaggaccctcttggtcatctctcacccctataagtagctaggtaccccttcagagtttcgagggttttgttagattaaagtttagacattcctacttgcttgcagcgcgcgtgtcagctaaaccatccgtcttcttgttcttcggaactccaactcatcatttgtattcaattcctatttgcaacatcagattgcttttatcttgttcttgcttgtttcttcgatttgcttgtaggaatagagttgatttgcaccggcaagatcaacaacccacggagaggtatatcaatcgctaaggtgcaacacaacgtctcgtacggttgtagtcggatcgtcaacgctcctcccaaatcgtggttatctgaactcaccgaaagatcgggccaacaacatccttgagtatcgagtggaactcagggttcatcacctccccgactagccgtctgcaccccgtccgcagccgcctgtgcctcccgtcgtagtcgccctcgcccgcttcccgctgtcgacatcgttgttgatgaccaaatttggtaaattatgaaccaggttcgacattgggatcgaagcggattcaataaagagattgattctgtcagagatatgggcccgggcgtatgcaaagtgtgggggagttcccttcccatcctcacacgtggctctacagcctggccctgcccccacgccccatgagtcgcaggcgcgaccggggggcctcggggtgccaggtcatgcccctcggggtgcggcgtcaggcccctcgggccctcgcgctgcggcggcccgaggccctcgcccaactgccgcgtggcggggggagcgtgaggagagagaggcatggctgagtataggtgtccaaacgggcggcacggcccggcccggcacgggcacgggtccggcacggcccgtttcggcacggcccgttaggcacggctgatgaaacgggccgtgccgtgccggcccacgtgccgaaccgccggcccaagcacggcccgtggatggccgggccgtgccgtgccggcacgg

SEQ ID NO: 75366 - DNA, 5077 bp, Oryza sativa
attcctgcagcccacgataattagacacattagtagaattagaagatttagcagacacaagcaacaataggagattttgcatgcacaacattggattttgaagaagatgcattcatagtagacatgataccagcagatttaaacacagttttattagtatcaggtttaaccaaaatctcaccacttctagcaccaacacctaacacaacaggaggatgtctagaattatgagcagaaggattaaaacctaaaccacgattatgtgtgctaacctttgattgatccaaaatcatgttgaggttctttttaccatcagaaaatcttaacaaagaatttttcaaataagagacctctttttccaaattagcataattttcacaatctaccatgacacctttgctttgacgacatttagggcaagaaagcacttcattgtttttcacaacatcttccatgtactcaacacgacctaaagcatctttcaatttcaacttattcaaattacatgttgagcaatccaaaacatcatgaggttgttttaactttttagcagaaatcatgttaaacatcaaactagcatgaaaagcaacttgatatttttgcaacaactttttagttaaaaacaattcatccaaagtgcgtgtatgcaagtcaaaactacaagcaagagaagatctattttttaaatcatgtgcagcattaacatatctaatttttgaaatctcattcattaaaacctcacaattttcacaatcatcatcattaggaataagagattttaatatatcaatttcagatttaagagattcaatgataaattcctgttttctatatatcttctcacacttcttattttttgcactcaaaatattaatagcttcctcaaaagcactcacctcattatcttcatactctgtgtcagattcaccacgcgccatgaagcaaacatcggagatgttgtttcccttatcatcatctcctctttcaccatctacatcacttagtggctcgaaggcggcgcaaacttgttgaaaagccttcctaagattctccatcttcctccctttgtatgaacccttcgacttgttgttgttggacttgttgttgttgatcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaaccaaaaccaaatcctcctcgatttgttcgagttgatcatcggatgtggcattaaaaatagcaagaaaagaagacttagaatcaacttttcgagaaagaacattcatctcatgtgttttcaattttgtataaagtgaatcaaagtcaaagtagacatgttaacagattcctgaatagatgtaactttcatctcccaaatagacatgttaagaccattcaaaaagtggcgagaaatcttagattgtggataattagcatcataagaagaatcaacagatctaagatcactcaaaattttattaaaccgagaaatatagtcatccaaagcttctccaggtttcatctcaaatttattatactcctttttgaaaagatcacgacgaagttctttaatattatttgtttcttgatgaaaattacacagagcagttcaaatctcatgagcagtttgaagatgagcaatacgattataatccgaacgagaaatacgactcaaaagaatattgcgagctttgcaattttgttcaaaagcagttttttcagcagcagtattaatagcttcaggaatcacataaggatgagaaaattttctccaaatatcataatctttagccattatataagattgcatcctactacaccaatgagaaaaatccgttccatcgaaaacatgaagcttagttgaaaacctagcgggagtagccatggcaaaaactctagatcgataaaaatccaaagaagaaaacaaggctccgataccacttgtaggaactaagccaagcagaggggggggtgaatggttggtatacccaaaaaccaaaaacttttagcggaactaaaagttaccctcgaaatcgacggatcacggtctgaccaaagttgtcctgccggtttgaccgcctggttgccgtcggtctgaccgcggttatatctccggtccgaccgctgagatcagctgctgctcgctgtcgccgccgccggtctgaccgccgtgctcccgccggtttgaccgccgaaacccggtaaacacaaatcgaagaactcttaaagtagatgatgactttattgattctctctgtgtttacaaagtgcaccaacagcactccttacaaaaatttcgactaaactcgaaaccctaactcaaaactcaactcaattgctctcaaaagcgataccgggaagcctcacgctccccctcgatttatacatgaggtaggcagcctaaagccacgaaccaaactcatactaagagtcctaaacaccttaggaaactctctagtacaagaaagaaactttacataaccagtcgtcttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtacagtatccatctagaagtcataatcatgaaataaactcggatatccaaataaacaacccgaaatcgaaaccgacacagtgtcggcctgttagaccgcgggctgcgccggtctgaccgcgcaatacacgccggtctgaccagctaccagagcctggtctgaccggtcacataaaataacgaatcctgcaatcacatgtgaaatccaatcatctccgaaaccacttcgtgaataaattccaaacaacaaaaccaataatctccaatgcccaattgttcatcacaaaataataatcaaaaacacctttgattttacaccactagcagtgaagaataatgcctgaaaaagggcgggaggatagcagccgggaagaaggggaatgtgctgtgtttcccaccttgtgtggtcgcgccgcgatgaggaaagaaaaaaaaaggcagagaacttgaaacgacggcagcgagcaagccaggtgtgacactagctagtggcgtccacagtttctactgtagcatacgtgatacatccaaccacaccccactggccccaaatatgatcagaagtagcattggatattcacacaactgcatagcattattgttcagaagtagtagtggggataatcacataagagaacttggataaaagctctttaaatttacagaaggcaacagagatgaatttattgacgcttgtacactcagaacgacgaaacacgggctgatagcaaagctacaacaaacgaaaatgccaagaaaacgtgcatcaggaggcaggaggtccaaacatacattatccatctcctcaaaacgatactaccagatcaccagataccaaatcaccgtacaagacatgtacacaagaacgaacagcgatcggagctggatggtgtagagaagcgctgaagcggtggcgcctacagaaagttcagcaccagggcccagacagggtagatgaagagcaagaggatgccaatgctgttggacactccgttgcccttcctgaaggcgttcctgaatccacctgacgccctgatgtgctcttgaagcaggtagcatccaatgatgaggcatatgaagatgccaactaagtcgcctcggaaggtgctcgcaaacaggttcggggcaacagcaatgagaaggatcacagcaccaggcagctctaaccaatctaatcaacatgacaaagcattgttgtgagacccatgtgaatttttgtcaggctatcaaacaacattctagaaagtagacatcaaatgataccagggaaatggcgaggaaagaagagacgaaggatgacagcaatgatcgcaatccattttccaatttctcccctgcaatttacgcatttagcgataagaattttttttttgaaacctagagataagaaaatttgtttgatatatctatatgtgatgttgtaaactttaatacaacagaatagaacataactattttgtaagtatttacaactatatccctagtcctccaaccagaacgcaaagtatgaaaaactagcttcagcagcatataacttgctttcatcttatgcttataaaaaagctataacctttttaataaaaaaatcctcaattcttcaaaacttatgtttaccaagattatcattcagcccctaatcccatgatgccaattgtcagtttactaatacatctttcatgttttgtgggctaagaaatgcagccagcgtgtcagggtatttgcatatatacctcaacagagagaacagcccaccaggcagtgtaaagaaaatgtaagggaccaagagagcggtcagcatgttggtcttccagtttgtcctatccaatatcaggaggtacctgcagtagaagagaacagagggggttcagtcaaatactcaaatgcacaaatgacaactgatgagtgacatttataaggaccgttctcaggttaaatgtacacagaaagttctaaagtcatggtcttgaaagtaaatactgaagactgagcgaaatcatcaagtttactgagggtggtgcagcaccactggcatatgaagcatattctgatattcagaaagcacaacttccatggacggtcctaataattacaactacaactccatgtgcagcagttatctgctcttcctaaagtacagtatgccaatatcatcgtatcactcatatcacatcacaaattcacagtccagcgcacagtcactagttcattacactgcatacaatgccaaaaatacttaatatgcagaaattaggctgtaggatcctacaaactgctcaacacagcatagttctgtaattgtacaatcgtatctcgacttcctgctcacctgttaaaaagatataacttgtgaatcga

SEQ ID NO: 75367 - DNA, 2943 bp, Oryza sativa
aattcctgcagcccaatttggcgcaaatttccaaaatttctgagctatctctagttttcgaacagaaatcaaatatgccagctacagggtgcgtctctcatgcagtcacggatatcaggtagaacagtagtactaccaattaatcatatccccaaaatggcgtacatttattctcagtactaacggagctagcaacacaccaactatcgatcctccatgcccgtgtcggcgtgtcccgatcagcaacacaaggagcttttgagcccccaaaaaatggcgagatcggagatccccttttggaaccaaagctcactcttggtcctctgcaaagagacaccgaaacgaacaaacaaaggacatggagggggggtgttttgggtgactcacacggcggcgaagaaggcgagccacttgaggaaggtggtgccgaacccgaggccgccgccgaggacgagcgcgtggttggcgagcttccgcgccgccacgcccagctcctgcaggtcggcgtcgatcagcgccgcctgcgccgcctcccctcccgccgcgtccgtcttcatcgccaggtacgacatgaaccccttccccatctcccacgctgcagatcgctcgcaaccctagctagcctcctccacctctccctctctctctcgcttcgtcttctccgcgcgcggatcaaatcaaagcaagctctcgctggcgattgggtaaaatttgactaaattgggtttggttgtgtggatgagtatgtgtacaggtggggaactaggtggcgctcgctcgatctggacggttcccgggggggacgtcgtgggacacgtggagggctccaggtcctacagtatttctgcatgcatgcattattctactcctcactgtttttgacttggctatgattagataatttagatcttgtttagcactaacaaatactaatccatttttagcacattaattaattgccttttgtttgtataaactggatagtaatgcagtattaataccggtatattccccttttcttcgcttcctgccagaatgccagttgtcactccctatgagcatatgagcaaagagcacgtggccctacgattaattaagttttgatgtagacttggttttcttttttatgttttggcgattatttcatactgaaatgctgataatcctatcgatgtgattaattaagcatttactaacaaatgttaacatttctttgaaactgtgtagccgacgtgtcagccacgtgctccacacaccttgcacataaaaacagtcatacagaatcgttttgcatgcctaatcgtggccaaatgggatggataaacaaaaaaaaaaagaaaatcaataatgcaacatcggccagataagacaagctgaaaaagacggtaacaggctgaccattctcatcctaattaaccaatgaaactaattcagcttatcaaccgatcataattagccaagtcgaaacactaatttaatttcaggcgtcgctgtctccccctttatttctggatcaatctgccagctcgtccatggcgtccgggccaatctccccatgatcgtgtcgctggctagctcgatgtgagagacgaccaaacccccaacggtcttgccgaattcgcaactactagtgtccgtccgtgtgtggctgcgtggtggcacgtcggcatgcagagttacagagagagctccgctgacaagcacgtagctgatactgtagatagctgaccgtgttcgttttgtacacgtcgtttcagttatctgaagcctgctttgtctgtacacggccggcgtacgtaaagttcgtcatgttttcgtctcgaaccgacaccttttgtacgttttttttttccttttttctttcgagaacagagcattatgtacgttaacggaaaaacgaggaagagacagaaaatacttatgggtttattgggctagaagttactatgggctcattgggtgcttatagactatattgggctaaaatatacatatgggcttatttgcacgaaactgaaagtctctctattctagtccagtccagtaggcaacagcttacaactgtgggtcggcccaataaacgggcccggttacatatggaccgggcgcgtaaacctcatcgtctttctccctcgctcgcgcggctgcggttgcgtcttccgcttccgaccgcgacccactcccaccattaccgtcggattcggagattgctccgccactccggcgccccacacatcgccggcgaaaatgctaatatctcctatgctcgccgcgccgccccctcctgcagccgctgcaagcccgcgctgccgcggcttcctcccggcagctgcggcgacggggagtcgacgccaccggggagggtgccgcttgcttcgccgctccgcacctcccagggtcggcgccgtcacgagcaccgtacgaacgcggcgtgaagagggccgcctcgaccgtgacgagctccggaggctgtgccaggagcctaacccggaggcagccgttaacctgctcgacgaaatgctcgtgcgaggcggcgctggcgcattggccgacctcgcgccggaggagcaagccgcggttctccaggcctgcggagaggcgcggtcgctggcgtcgctcaggcgagcgcaccgattgctgtccaagtccctgcccgggatcgccacgcccatcctgcacatgatctccacgctgtactgcaagctcggcgcccgcggcgacgcgcggcgagcactcgagggagcgtcgaggccgcgggggaaggatcatgagcaggagcaggagcacggcgacgaggcgaagaggcgggaggcgtacgagaaggtgcgggagctgcacgaggagatacgcgcggcggggtacgtgccggacacccgctacgtgctgcacgacatcgacgaggacgccaaggcccgcgcgctcatgtaccacagcgagcgcctc

SEQ ID NO: 75368 - DNA, 8659 bp, Oryza sativa
tcccccccccccccccccctatttagtcaaaaaaaaaaaaacttcacttaacagatctgagacaagacaagtgactcattgcagaatcgttgcaattctcacacaaaggtttgcagggaaaaaaaataaaattctaggttttaaggtaagttgattggggttgcaaaattctaggttttaaggtaagttgactcgttttaattttcctttctatgtttggcagcaatggcggctgccaaggtggtcgccaacttgcagattcttggcttgtgtttgctccatctctgcctcgccgcgtccgccgccgcgtactatccggacatgttgctggagacgtcgttcatcccacgcgactacgcccgctacgccgacgagctgtcgccgttcgatcccgtcggcgccggcgtgctggctcgcgatctgtccttcgccaatggcgactggggccaggacgccggccgcgcgccgctgatgccgtcgcaaggtggcgactcgccgttcctccgcctcgcgaccttcgccgtcacgcacatcgacaccgacgcgttgcggcggcggcggcccgcgatgtccgccgtcaacgtcagcggggtgctcagcttcacaatcacccgcaactgctgctgctcgtcggagtatgcggtgccgcaccggcaagtgtcgccggagttcaagctccttcccggcgcttcgaggctcactatactgttcgagggcgtgtacaccgagacgaggtcgccgggtaacgacgacgacatcggcggcggcgagagggtgctgtgcatggtcgggaacggtgttctccccatgcgcggcggcgacagcgcggacccgtgggcctgggcgaggaatgccggcgacggcagcttcgaaccgccggtcatggccgacggcaacatggtgctcatgctacggtacccgaaggtgcacacgttaacgacccgagcggtgcgtggcgagctgacgagcacgagcgccgcctcgcacaatgcttacttcgacgcagtccggctggtgtcgcggattggccagtactccagctacctgttccggccagaacacggcgagctcgcggccaacgggtgcagcaccagcacgacgcgtcccttcgtctgtgacgacggcgtcgagggcaactgcgccggcgacctgcacggaggcgcctcgttctgtgacatcctcaccgagttatctcccggtgaccatggcgtgctcgccgtcgtcccaaactggaactgcaactccaccgacgagttctgcagccagctagggccgttccagactggcggcggagccacgaacacgacggacaggatgctcaccggcttcgccatcgcgatgcaggacctccggtgcgagccgcacggcggcgagaagccggccgcgagggtgtcggccgtgttccgtgccgtgtcgccgtgggaggaccagcagctggcggtgaggcggaccggtctgggcggcgcgacgctgtcggcggagggcgtgtggagggcgtcgacggggcagctctgcatgacggggtgcctcggcgtcatcgacgccgccgccgtcggcgacgaggcgtgccactaccgcgtctcgctccacgtcccgacgacgttctcgatccgccgccgcagcatcatcgtgggacagatcaccgccggcgacggcagccacttcccgctctcgttccaccagagcgtgcctcccaaacatccatggaaccggttcggccgctccgaggcgtcgctgcgcgtggcgtacgactacacgaaggtcgagaacgccggcgagctcctccggaggagcgagccgtccggattccggagcagctccattgcaaaagcactagtaagctatccaaggaaagccggcgccgccgccgccgccgccgatgagatgatgagtctctccgacctcgccgacgacctgagcctccacttccaacccggtccaaggctgccgttcttgccggagcagaaagtgtggccgcaatggccggcgttacacctcgatatgctctctgtcgggccgctcgtcggaagctactcgccgccgttgcggacattgcctagtacgacggtggcacgggctgagattgacggcggcgtggagcaacagcagcatcagcttctgaacgtgtccgccgtgttgagcttgtccgggaagatgttcggctggagtccggtgatgtcgctggagggcgtgtacaaccaggaggacggccgaatgtacctgatcggctgccggaacgtcgaggcgccatggcgaatcgtgtcgacgagcagagacctcgaagacggcatggactgttcgatcgaggttagggtggagtaccgccgaagacgacgcggtggctgttcagcccgacggcgacggcgtgcatctccagcacgagggacgccggcgacccgctgcatttcaacacgaccgagctgcgcacgacgccgatctcttaccgcggcgggcgccgcgacgcgccgccggacacactcacggagcagaccatcgaggggctcgtctgcatcgccatgctgtcgggcaccatcgccgccgccgtcggccagctgcgctacatcgcgtcccacccggacgtcgcgccgtacgtctccctcgtcgcgctcggcgtccaggccgtcggctacaccgcgacgctggtcaccgacgccaagatgctcccggcgtggccgacgtacaactaccggatgtacgtaggccacctccactggaacatggactccaccgtgaaggccctcaccctcgccgcgctcctcctcacgctgcgcctcgcgcagaaggtgcggcggtcgagggcccgggcgcgcgcgcggtcgccggccgagccggggcgcgtcccgagcgacggcgccgtgctcctgcgcagctccggcgtctaccttgccggcctcgtcttcgtcctcgccgtccatgccgtggccacgcacaccagctcgacgtcgaagcaggaggtgttcttcgttgaacagaaggcggcagcggcgtcgcacgcgccgccgtcgtgcatgcgcacgaggggcgccgtcgtggagcgctacgtcggcctcgtgaaggagtggttcctgctgccgcaggtgatcggcaacgccgtgtggcgcgtcaactgcaagcccctcaggaacgcgtactacggcggcgtcaccgccgtgtggatgctgccacacgtctaccgctatctccggccgccggaggtgtacatctaccggcccgaggtgcaggacgacgccatggccttctacgagaaggccaccgacgtggtggtgccggtcgttgctgtggcgctcgccttgttgatctacgtgcagcaacgctggaactacaagattgttggttggtcgttgctgagaacggaagcacgtctactgatcatgacaagaacagtggtctttgtcgctgtagattgttttaagaatcgtctagaagtaaaataattagtgactgttttttttttatcgggaatgctaggggacgggataccgttctccaacgggatagctcctctccacacgcgattcttatccatacactcacttgccgccgtcgccgtcccccaccgctgccgcgcccgtccccgtcgcctcctccgccgccgccgtgctcgtccgccgccgccgccacgcccgtcccccgtcgacgccgtcgctgtcccccgccgccgctgcggcgtccgtcccccgtcgccgccgccgtcgccgccgcgcccatcccccaccaccgtcgcgcccgtcctatgccgccgccgtcgccgtcgccgtcctcggggtgctcctcccccaacaggatgtccaactatatctagtaggaatcacctgatacctggtaggtatcatccaatacctcgcaagtatcatgtgatacatggtagaaatcatccgatacctcgcgagtatcacgtgatacgtggtaaaaatcatctgatacatgacaggtatcgcatgatacctcgtgagtatcacgcgatacgtggttgaaatcatctaatacttgacaggtttcacatgataccttgcgagtatcacgtgatacatggtagaaaatcgcatgatacctgataagtatcacatgatacttgcaggtatcacctgaaacgtgtgtagaatcgtctgatacctgataggtattacacttgatacctacttgggatcatcctgttatgtagaatcgtctgatacttgataggtatcacacctgatacctactcgggatcatcccgttcgaaaacgggataccgttatatagcagcccctttttttagaagagaattagtgactgttaacgacccaaattatgtccagatttatgcagctatagtaaccttaactttgtctccttcccacccctcacaataagccttcgtcacccttgacttgctagcgccggcaagatcacaatgtcggcctccgtccttccccctccctctccctctcccaactccttcctaacctggctgtgttcggtactaggagttgggaaccatctcctccgcacgaaaaacgaagcagtccattagcgcacgattaattaagtattagcttttttaaaaaaatagattaatttaattttttaaagtaactttcgtatataattttttaaagtaactttcgtatataattttttttaaaaaaagtaccgtttaaccgttcgaaaaacatatgcgtagaagacgattgagagggattgggaacctggtgaatcgaatgcagcctcaagcagcagtgtcaaggtgtcccttccccgctatcttcccatcttcgggcggctctcgccactagagatgccactaccaccatcacctactatattataaccatatactctgacttctgtgccaatacccaccgctctcgtctaacccaacggctctggtagggcaacgcgctctgtatttgtagtattatattacttgggggcctctgcaactctcgttccactttgattctgtctttactccaatcaatttttttttggagtgcgtatcgcgtggttgagtctttaacggccctgtttagatgggactaaaaacttttaagtccctatcacatcggatatttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaattagtctatatttaatactctaaattagtgtctaaagacagggacttaagtctgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcaggacttaagttaagtccctggatgtaaacaccacctaaatattggctagagacgatcgtgcagcatgtggtcagagattgatcataactatcttcaatctcggcttaaagattcggagaagatcatatcagtagctcttctcgtttccaaggataacatgctgcagcctggagaagtcataagacagcttcaatctttcttggtgaaagatttggagcagattatgtcaatgttcatttgtaaggtgtccaattatccattgttattttcatctctcataaaccccaaaaaaaaacatcttgctgttgcagcaacaagatctccggagccgtcgatatgggcacaaatttgctgtttcttccagagttcttgctgtatacgtgcatgatggcatcatcatgttttgcttaccagttcaacccaagcgaggaagcagagcacagctatcttcgctttgccgatgtcaagcggcaatgccggtccgtgctcacctcggcgtccgagctcgccgataacgcgtaccgggtcaaacgcgtgaagcgtgagctatccttcgagaagggcgactggcgccaggacgccggcacggatccgctggtgccattcgacggcggcgacgcggcggaggatggccgccggccgccgctggacccgctccgtctcgccacgttcgtggtcacgcatgtcgacgacgatgacgagcgccgtgcgcgcaatgctgtcaacgtcagtggcctcctcgtcctcacgatctcccggacgagcgcttcaccggagatcgggtaccacgtgccggtcgtgtcctcgccggtgttcgagcttttgcccggcagcaccaagctcaggattgtgtttgaaggcgtgtacacggaggcagcgaggtccggcaatggcggcggcgagagggtgttgtgcatggtcggggccggcgttctcccaacgcgcggcgccgacggtgccgatccgtggggctgggccaagaactccggccgtgctggcttccagccgccggtcgccaccgacgagagcatgctgctcgtgctacgttacccgaaggagcttacactgacgacccgagcggtggtcggcgagatgaggagcacgcgcgccatgtcggacgccgcctacttcgacacggtgaagctcgtgtccgggcccacctggaaccgccagtacgagttccggcgccccgaggagcttgctgcggccgccgggacgtgcaggccgctcacctcgagcgacgacggcggcaaccgcgcgagggatctgtacaagggcaggcatctgtgcgacgtcctggaacgctacatccatggcgtgatcaccgcgcgcccaacctggcgccactgcaactcgacggcgacgggcgcgccgtgcccgttcgagatggaccgcgcagaggacgccgccatcgtcggcatcgtactgcacgacctccggtgcctggggtacgacctcgacatggccggcaaccccgggggcgtgaaggtgtccgtcgtgttccgcgccctgtctccacgggagcactggtacacggcggtgcagcgcacggcgctgagcggggcgacgctgtcggccgagggcgtgtggaacgcgtcggcaggggaggtgtccatggtggcatgccgcggcatcggcggcaaggcgtgccacttccgggtgtgcctgtccttcccggcgacgttctccatcaccggccgcgacatgatgctcggagagataaccaccgtcgacgtcaacgaaaccggcggcggcgcacgctcctcgctgtcgttccggcagcgcatgcctccgccacggctgcagagatgcgtctccggtatactgccagtggtatacaggtacaactacacgaaggtcaagctcgccggcgagtttctccggaggaactcgtcgccgtccgacttgagggagatcattgcgaggtctctacccttgagctatccaaactgcggcggcaatggcgatggcaagagaagcctggccgacctcgccgacaggctcacgctccggtttacggc

SEQ ID NO: 75369 - DNA, 12017 bp, Oryza sativa
  unsure (1)..(12017): unsure at all n locations
ggcacggctactcgggccgtgccggcacggcccgttactgtagcaggccgtgccgggccgtgcctgctacaggttcggccgtgccccgggccgcccgtttggcccggcccgtttggccacctctgtggctgagcagccatcaatgcgcggcgccccaaccgtccctcaccatgtttaatgcggtaaggatgaacgtgcggtgccgcaccactggcccacgtcaaatcgggtgtgaccagtctgtgatcggcctatcgccggtcacgtccgattgacgcgcggtcgtgccctcacgtcgcctttgtctccggcggagtggaggtaggtatgtcccgtcacatcggggcgtcatcggagtcctctccacgtgagaaggacagtcaccagtcatcgcccatttaagagcgaatgatagggctgtcccccgtgtcaggcggggggcggcgctgggtcccacctagagacgcacaactaccttgcttccggttgaaggcacggatggaggtctgatccaggctaggtgggtccccctcccatggaggggtaggtatagacggtgcatgtggtatccccttgaactataaaaggaggaccttgctcaccgggaaaagggacgacactcggaaaaccccgaactccaggaagagaagggaagtaagctcttctaagttggggaacccttgtaatcctcatccataattccacacacaggagtagggtattactgtcacgaccggaaataacctaacgggcgttccttacatacgtgtattattccttgtcccaggaggcaaggtacaccaaaagttgatacaattcagagtttaacaagcggaagcgtaaatagttaattattacatgggcgacgagagcccagcacacagaaaggcaatggaaaacagcggaagactagggcgacgaccacaagcgcctgacggcaggcacgagctagacaccaaagccttcatcatccaggagctcctcttctgggtttgggaaaaattgagcaagactgagtacaaccaccgtactcaacaagacacacccacaagtgcagcatacgccaggacaaggttttagtaacaccattttgtgttactatatgtccaaaaatgtgttacaatgttattcagtaacacatttatgaactgttactatagcctatgttactgtagcgcaatctactgtaacacatctatgcgttgttatatataagaaaaggtgttacaactaggctatagtaacatgtatttaggtgttgccatagaccattgtaacaccattttctaccattaccaacaccgttggtaacatcattttctacttgaagtaacatatttgtaacattttattgtatatattacaacacaattactttttggattggtagtgcatttcacctaaaattactacatttagaaaaaaatactgcatgaagttttatcacttcaaaaatggaagtggcatgaccatatatacgtaataggagaaaataatcacaagtgaagaagtgaaatgatcataatatattgcattgcaataaggaaatttacagaattattgtttacatcttgtaacaaagaaatttataggcatatcttttaaaaagaaaaaaatacacattttagcagcaagctgctagataattgtgcaatacatctattcatatatcatcttcgcaaattccttcgcttctttcttagatcttgaagtgggcattcaactgtcagaattcagccactgatcatctgaatctgcataagaaatttattattagccttcacaattgcattaaataatattgacaatattcttcaacatataaaatgctactatgaccatacataaaacaacatagccatattgtcattttccttaaaatgatgatctgtaaccactttactaaactagttcaaaggcaaaaaaaaaagttgctcacagattcatctagcattaaactgaggccaattgccacctgaaaaatagattaggagtactaatgttcatcaagattatcaatgatcctgtcaccagtataattatctgatagtttcatcctttatatctgatgaaactggggaatttaaattggtttttggacagatcattttattactaagcttcatgttctttctcctctgttctgtcaaccaaaaacaatgtggaactaacctttgataccattgcaaccccagtgtggtagtgtcccattcatcttaaatatattcttgcaaacctgcttcagaggggaaaaaagacgacgtagcatcaaagtatcaaataatgtattgaagcaagaatcattagtatttaagtccatctaaagcaaactatctaacgccatgtttgtggagtattgactgtacacatcatgcttccatgcttcctccaaacgtgcctacacaccacaatagtttcctacacaccacaatagtttcctccatactacagtagaacgggggcccccccctttggtaaggtaatttttnttcctttttttaaaaaaatttgggggttttaaatttttcccaaaaaggcgcccccctaaataaaaagggtgtaatacaagattttggaaaaacacagtgctcaggaaaataattttctgttgaaaatgcaggaaaatagttcgaacggcacatttcttaacattgaaagctacagttgactgagatatacaaatcggatatcagtatccactgctaccaccatatagaagaataaatgattactactcctacaatggcaataatacattgggtagcatatcaaactttggagccacacaccatagaacaaaaagatataatactctatatatgcgctggatatgtcaacagttaacatcaaatatttttgcaacatcatatatttttgcagcaggaacttcccaatatgcatgtgagcatgcacttctgaaagttcttactactcctaccaatgacagtacaacttctatcaatcatctgtgaaggaaaataaaaagtaattatgaccttcttttcctatatagcatttctccaataagttggaaaatacccatagaataattatgactaaccagagaaagctgcagccataattaccttgcaccaagtgatgtgctctgtgagttcttctcctgtggttccatctttacaatctcgtaagcaggcacacatagtgatatagagttgctttgcctcattttctacacttaaagctgcagtgttagtttcttgtatcagaacttcattagacaataatatgtttgatttacttaacaaggcatggaagaaaatagatgacatgcagaatagtaccttaagatttcgttcccaaagtttagacatagcacatcttattttgaacttccatgcacaaaccacaacatgctgatccaaaatattgttcaaagctagtgttttaatcaaacaagttgacatttgtttgcaataagaagtcaacttgtattatattggttttgctcttttggccctctgttgtgagttgtgacctttaagtaatgatcaggcataactggattttatcgaacaaatcggtccatatatactgcctgcttgaaagagtcaacaacttaatccccttgaaaatactggctagctgcataaaaagttgttctgttgatggtgatcacccaatgtgttcatgaaactgaaagcaatcaagcactactaattcacagatttaggtttttttttttatgaatgatcatgttggcataagaattttgcaatttcgcgtgatcagaaaaagtatggagagatgtgaagataacatcaataatctgtctaaggacaaaattatgcttttacggagttggcatgcaacagtacacagtgaagcttttcatcaaacacatgatgtgcatatgtgtgatagagaacaagccatccactcctattaaagaagaatttagtgagacagtacacaaaccacaaaaaggattcctttgggttcttgtgatgtgctcaccatgcgtacacaagaaggatgcagtgatcagatgtgtttggactctccagcaatcagatgtgtctcgatcttgcatcctgcaaatgccaggaagaaagggatgggtgagacaggctagatagatggccagttttggggagagcaagcatgtgcggctgagcaatttactccttctcgccccctcctccgaagccgccggcgtctgtagtccctcgacatcgctcacgcggctcacctgacgagatcgatgccgctccacggacggaaactcccctttctcccctgcccacctgccaccgtaggggctgcgacgagccgactcccctttcttgtcgccgggatctgagtagttgataacacgagattgcagcagccagcagatgggaagcacagacctcggttgctcgggtgatgagtcgtgggatgttgggttcctcctggaaataaggaggtgatggggtagggggcgttgggtcttattatatcgtgaactgaagatgtggagataaattagccggttcgttacaagtgaaattttggcggcagtctctagacggaaagtcgagattggcgggaagtatttttatgtaaattgcgcatgaaaatagcacggtatttctttgtctaaaaactatgagaggccataatttaaaaaagttggtccacttgtaagtattaaattaaggtaattttaattttgtttatatatgtaacatgagatttacttctacattactgtttttgagatggaagtttgatcacaattctttaaccaaatataaatttatagaaatgtaataagtttatgagattaagaaattactttcaaaacaaatgtacatgtatcattgctatatgcacaaacttatcattttcgttgatattatttaaagttataataatttaatagaaacttttctaaaacattatatattttctagatcgaacgtagtaaatggtaaacacatccattaatttaattctatgttatttggctctaccatgctatctcaattagtttatcgtctattggtttatccgagtctgactaccttcataaatagcctgaagtgcaagtccaaacatcttatcactattttacttcctatacttttcacaaccaaccagagccgtctctattagacaccggtccttttaagttagtgttatgtcttcagcgtcctacgtgtaagctagagaagccacgtggctacaaacgtgcgaaacacaaaggtagcattcgatggaagatgattttcacaagttcagtgaagcttgcttgtggttcgcatattttgacttaaatttcattgtcaaagtaccctctcaattctttagaaaattaataaaatttctgccaatatgaagttaattgtgcatcccatacttatggacaagtatcctctacatgccgttgtgcctagagagcgtcgccagccgttgtcattgcagtaaggaataacaagatattatcactctttgcctccttccattctcattcatcatattacataaaaaagatacatatacttttccgtaaaattttattttccgcacattataaataacattgtatatgaaatgtaataggctattatttgttatagaggggaagattttgtttcattaacatggattaaactaatttattgataaggtgagtacaaaattattaaaactttatagaattccaaataaaactactactaatttatttctttataggtccaccctgtcagatttccatcaatctagttctattgtgcctgaaaaagagaaacacataaaactgattttgccgcgggtttgctccaaatttttgtgtttgtacgcttttttcctccctcaatttgccgggttttcttctccactatcggaagcagttatgatcctaatagagaaaacaaaacccatctccttactcctgaacataccgatccaatctctccagtcatcgcagcttctccacagcagatcccggcgcccgccacggccgacgacgtcgtcggtgcggcggtgcctcagccctgtctgctcgtccccagggcaagatcacccgcctcaacgcgcttctccacgccgtcatcgagatcgaggtcaactccgacgcgctccagcagccggcgcgcgccgacaccgagcacgcctctggccacagctactgcgggccgctccacggcgtccccatcctcaaggacaacatcgtgaagcgcgaccggctgaacacgacggccgggtcgttcgcgctgctcggctccgtcgtctgccgtgacgccggcgtgacggccggcctccgcgccgccgctgccgccgccatcatcctcagcaaggcaaaccccgtcccgaacggttggagcgctagacgctggtaacccctatcaccacgctaagctgtcgttttatctccagcatctcgtcttgtatgcaatgtgtttgtgaaattgtccataaagagcctcatgttgtcaattgacgtgatctggtccagccgcgcagcgccagcatgatgcatcatcgtgtcaaacgggtggcggcttacgcaggcgcgcatcccctgtgctttcagtttcagcaccagcagcaaccacctcaccgtgatggattcactggctgaatttgttcctgccaatcaacggcagctaatcatagtaagcacttgttgaatttgtttctgccaatcgatggcagattagttagcactctatttctttatgcacaccacatgttcgatactttgggccagtgcaaatcattggtcttattgtttgaaccgactcaccgctgtatacttctgtggatttaggcagctccagttagctactcacaggaagatcatttttgcatctactagaagctgcagcatggacatgatatatttgcaagatatggtgagcacactatttaataatcccaaacatcatattagtgctggcagtgattgtcatacttttgctcatgccataattgtttggaatgtcagattgcattaggaggtgatgaagtaagtgtttcaaacatgcaaattcatgtcatcatccaccagaactgccccctcgctactttctctaccgtatgtactagtaattattatagttatactctactttaaatttgatttcatgctggaactttcttaggagtaatatgcaacttgtgacctgtttttgctagcattattgttgttttgaatgaaaaattgatggttgcaattggcagatttctgctaacccgtgaatcagtaattaagttatgaatggatgcaaattctgctaaatacatagctatttttattcaggatagagcttcgagctacgacatgaataatactcatgtacatgaatgtacatgttaatacatacattaggataaatataataaagaactgcatgattgggtagtgtgaactagcctagcaaaatgcttgtgtttcctattttgtcctaagaggagttctgatttcagttctgttttttaaatcgtttggtggaaaatctgtcagtttttttataaaaagatatgtggaatgatgtagacactcccagtcttatatacggtcctcatcaaggttgttcaagttgcttaggattttattcattcatccttatgtttttttttgtctaggagcaacatctttgtaccatgatctaagctgtcaacgtagtatgatcagccatctgtggcctttcaattattctaattatgcatgtgacaagattgtcattttttttattcaattcagcgatctccaaggttgcatgtaagctttgtccactagatcatggatccaacacaagcctccacggtgctgttaacctcatctccacatatttagcaaacaaactttgtgtgagttaaagatcagattgtttaaccaaggttcaacaccactattttaacttgtggttattaaatttttaacacacctaaattacctttactttctatttcaacacagggaactatggatttaaatgctagtaaacagccaatgcttttctacagaccatttatgagcatttttggtagaataaaggagttttccgatccaatggccatttaagaattgtgtgaattagtgattattacagcagaagtgcgtggtcattgagtatgtttattaaaattctttgaagtggtggaatttaattacactgccaccacatatttgtcactgttgttgctatggaaagtacaaatattcatctatttgacatcaactgtttattttcaggcccattctttggttgtcaaggtggtaaatacaagtaaaggcttgttttgataacctctcttgcaggatttattttcaatttgttcaaggctgttggtattgcaccgaggaaatttattaccttctttttttttcaccttgaaatgtcatattgataacccaagtaatcatgtcatcaactcatatgtgatatttggagtgccttggagtgtattgctttgaaagcaatttgaatatcaacagagattgtacaatgttgctttctactctgctagtggagggtatttgttaattaagtccattgttgatggatgattatttgatttttgcccatgataatggattaaacttagatcaacatgctatctgcaatatatttatctgactacatatggaaattcttgtatactaaacaatgttatgaagtccaaaataatttacagttgagaactgcacaagtccaagggaactttagtctggtctattatagaaaaatggcaaaagcagaggtgattaaaatgagaggtatgagagaaaataaaagagtattagaaattttaagtaaacaatgcaatggaaagtaaacggttgatgtaaatctccgaacaaacgaatacaatacacatttgagttagtttgctatatggttagcagttttccttttttttttgtatatatatttggagacatgtcgcaaatcagagtaaaaaaacacaaagtaaaattaccacaacctaatatgcgctttccaggtgccactggattgcgatgcttgcgatatactccctccgtttcaaaatgtttgacaccgacttttcagtacgtgtttgaccattcgtcttattcgaaaaatttaagtaattatttattcttttcatatcatttgattcattgttaaatatactttcatgtacacatatagttttacatatttcataaatttttttaataagacgaacggtcaaacatgtgctaaaaagtcaacggtgtcaaacattttgaaacggagggagtacatgtttgagcccagatattattattattctttcaaaaaaaatcttggacaacagttgataatgtgattacgaggttcgctgaattggccactagtttggatggcgcaaacaataagtaaaatcatctacatgcacctagcaacaccaaggcacacttgcctacttggttgatcgagaattgcatataccaaaggtctagagttcaactccctccacaagcagcacttttttaccatatatttgttcgttgtctcagcattcataacattgtgttactataggcgtcagtaacatatatgtaggtgtatatttgttcgttgtctcagcattcataatattgtgttactataggcgtcagtaacatatatgtaggtgttactgtatgcagttcatgtgtaacataactcatatgtgttaccaagaagactgtaacacatagctttgtgttgctattgaactttcttgtaacacatgtcataaagtgttacaaaattatgttacaatatgtaggtcctggcgtagtgtaaatgcaaagaagtacaatggagttatagtatagggggttagggtttgcaataaacagcatttaagaaacacttagttgctcaaagctaaatttaaaacacgatcctataactatttaatattattaaacaaggccgtgaacccacacgaacctgccttaacccaaggtctacgatgattcagaccgaactggcaacccgaccctgggccccagctcgtcccaagccaacccaggccagccattccacattttagttattaagcaggttttaagaattgaaaacactaacttgggtacattgctaggcttgcccataaccgagggcgcggttattcgaataggttttactctgatcagaggtgtacatctttacccacaagacacgtcttcctcacgtgcaaccccgtgccacataccaccgcggcatatggacggaagacatgacatagtttccaacccatcctagccatagacaagagtaccgacccaaccccacctacgaccggaacctccgggacaggtaggcaggactgagcccctagcagcaggacaccagccctgtgccatgacatctcgactaccgggccgcagctcgtgtagccttcatttgtcctagagatgtccatcgacccctgacttcgtccatctccattcgtgtacttttgtttataaccagactgagccacaaactaagccttacccactagacatgtggaagtacggtagtgctttgcaacagaggcccgaagtccggtccttatgtggtcgaggtgctactatcaaaaccatgcaccccaagcccagcgtaaaaccattttgagagttttgaatagagggagaggtgtgcatccaattccacaatagtccaaccattccataaagtccaagagatatgaatgttcccaaagtctaaagttataaaaaccacctaatgttgtcttattaatcagcgaagcatctacctaaattcataccaggggaaccatgagtagagtgcccactagtaggggttttgtttattctagggtgaacaaggtaataataacaatagcaataataaggtcataacaaaggtaaataggcatggctaaataaaacagtgataacgcgggaatttaaataaagtgataatgcaataatttaaatcaaagtaatttcataaagtgggatccaatatgttcaaagaatgatgtgacttgccttgctcgctttcccaaacgtcggcttcaacctccacgaagagcggatctttcgaagctgcagcgtctacacgaccaacggaaaagaaaagggcttttactctaataaactccatataacaagcaagaacaaagcacaaaaatgggttcttgacttcttaagaaaaaattagagacttgaacggtccaattccgagttcaaatggccaagttatggccatttgaagtttatatgctctttaaatgaatatttacgaatttcttcatttaaattttaattaaaaataaaggtttattgcgtcagctgaggggaggggcgcgcggaccgggtccatgggagtggggcccacgcggcagcctctcggtccacggtggaccgggtgcacccgggctcacaccggccggcgccgtgggccccacgcgtcagccgcacccgagggcgcgggcggctgactgccgggccccacgcggtagccgctcggcgcgcccgaagacggccacgtcggcgcggccggcgggagacggcgcgcccgcgcccctatggtcgccggcggcggccataggcacggcggagcggcggccgaagaggggagggaaagggggaaacgaggcggcggtccacggctcacccaaggtcgacggcgacgacggaaaaggcgaccggagcggaggaaggcggcggcgcggctcgggtggacggggacggcggcgctccggtggtcggcgagctcgacgagggggtggacgggacggcggcgatgcggcgaagccggaggaggcgacgccggggcgggagacggtcccggcgagcgagaagaggcggccggaggtcgtcggcgacggaggagagagagagcgacggcgcgagctcgattccggcgaggagaaggcgcggcaaagggtggaaatgggcgaaggaggtgcggggagggtttaaatggggttgggaggggcagagggcggccggggaaggaaggaaaccggccgggaggtccggccgccatcaatggcgccggcgagatttgcccgggcaaatccggccgtttgaatgcgacagaaagagagggggg

SEQ ID NO: 75370 - DNA, 6441 bp, Oryza sativa
tgaattccttcactacggttgtacattgttactgctactggatcatgtcagtgatgaagaaatgatgattcactttgcttagccaacgtatgacttgatgcattggccatccagatggcactgagcaattgtgcaccgctacaattcaatgatcaaacatggtaaaactcaatatctcccaaggaaaacccctccattttccacaaatctaagtaaagaatcaacacgagaaaacaagtggaagctatgatgtgcaagggagaagaatttcaggggctctgctcgattcgtggccggcgaggccgcgccaccaccgtgcgctgctgtgactggcacacctgcgccgggaacttgcacccgaaccgcttcgtcaccattgatccccaccgtccttccatcgccggcgttgctcctctctcccctggcgtgctgccgccgccacgccggtccatcttctcaatggctttcctcatgcttgtgcactcacgctccagctcctgcacccggtttcgcatgctgtccatgtccagcctcagcatttggttcccccttgtcgccacccgccatgttccaccggcatcgctgtcgccttcttcctccccttgaccagctgctccaccttcgttcgccatgattgtccttgcaatggcgcgacgcagctggagctgctcgaagaagagcacctgcaccaccgtccgcagcggcagccgctcgttctgcgccgcgtgcgtgcatgcctctagcgtcagcttgcggccgtcgacgacaccgctcaccttctccttctcttcttccctcaatccaggatgagcctaagaacagaacaaaacaatcactgctaagtaatggcattgtgttgtaaagaggtagaacactcgttgtcagtgttggtttaccttgagatagatgtcgacggcacggtagaggccgtcgtcgtagacgcgggcgccgtccggcaatgcccaggcgaggtcacagaatttgtccggcttcaggttggcatctgcggcgatctcgcccaggtaggcatccatcagcctcccaacggcgagcatggctcgtcggctggcctctctgcccggtgtctccagctcgctgccgtcgtcgttgccgtcgtcggcgtctcggccttcgaggaagtagcgcacgatgcgctcgacgcactccacgtcgtagagcgtctcgacgaggtaggagtagctcgggatgagcaggtcgtcgagggccgcgtcggggagcctcgcggctatgcgccgctcgagcatgtcacgggcggattccgacgcctgtaggatgctcgtcgtgcgcaggaggccgaagaggacgcgcgccgtcgtggcgcccacggccgtgccggtgtgggcgttgctcttgatggtctcctccgggaggttggcgatgacggtctccagaagcgccttctgctcgccgtccgatgacggcgcagccgcggcggcggcggtggcgccgcctacatggcggccggagcgcgacagcccagggatggagcgcttggcgtaggcgatgagagcgccttcaatgatctccgggccgacgttccgctccttcatggcggcaatgacgcgggtgaacgtggccagcgacaagccggcgaggtcgtcgaaccacgtcgcgccggcgccggcattgttcttgcggcgcggacggtcgccggcggcggcggcggcggcggcggcggcatcgttgatgggccaaccgaacagtgcggtgggcgtggacgcggcggccttggcggcgatggcgtcgacgcagcgtgacacgaggccgaggtcgtcggcgagggggaggaggccctcgcacgacctgagggctcggatggcgtccctggggttcctcaggacggtgtgggacatgaacctgtcggcgcgggagatgaggttgtcgtcggagtggtcgtcggacatgccgaggcgctcggcggcgcagcggagcggcgcggcggtggccggcgtgaggtccagcttgacgccgtagcagaacttggccgcctgctcgaacgcctccgcgccgccggggaagtccgggaggcggatgcggtgcacgtcggagtcctcgtcgacctccagcaccacctcctcctctctgatctcgccggcatcctcctcctcctcctcatcttgctctcctccgcccgcagctcgcgactccctgttggtgatgaggtcgtggagcttcttgctcctcgacattaacgggaactgcaaggaaattctcgatatcaacaacaaacgcagaaaatcttcacactttccatagcccgacatcaagaaatggaccacacaagctcatgaatcatgacagagatttggagtacgagatttagcagcaaattaattgagatcaaggaaaagaaagtgctcaaagccaacactgtccgtgcatcaaggagagttgggaaaaaaagaaaaaaaatggaaattatgggagacacaggtgtgggggataagattcaccaaccttgtggagatggaatgtcatgtcgccgacctcgatcacgacgtcgctggggagtccggtggtgcagaacctgatgaacacaagacagacacacagattggggatcagagaacagcaaatcggtgacagagagacagagacagagctcaatcagtcgcttgccatgcttggcctttggagctcgattgctgctgctgctgctgctgatgatgatgatgatgatgattcttctcctccctggccatctccctcgcgctcttcatcttcctcccctgcatctcgtgatcctttggaagaacgaagcagacaacagcaatggcgaaaaaagaagaagaagaaaaaaaaaactctgctatgagctaaggcatttctcgggagaaaggaaggggtgtgatgtgtttgctcatttgctgtcgctatgggaatcagagaaggggaaggacaccagggagagacgagagacgagggagctctcaataatggcgtactattctgatgcttggttttaggtgggagaagtgaaggattccaagtggggaagacgaagacaagatggcgtttttggttttttgaatgccgttcggcttgcctcaaaagcacgtatcctccattacccatttgtttatcctaccatccgtacttgctttctcttaatctaatgctttactgtctctttctgaaagattgtcatctactctaggagtgacagttataaccatgttttacgcattgccaccaaaatcttaccagtaacagcaaaattttcacctctacacagccactgctcataatagtatgttttactactctattatgcttggaactccaaaagaatgtctggtatgcttggagctgtctgatcatccatcatatgtatagtgtgacactgacacaagaattcaactacagtacctggttcatttgtagaaccatttttttcccagaaattttctagtagtaggaaataggatgcattgcaaaacaagccttcacctatcaggtagagtatcaacatccagtatgaagattcggataccacctcgataaaatgaagccatgaaccaaagtcaccattactttaacccaagtgaacgcaggtcaggttaattaagtactaacaacgagaagaatgaaggaatctacggcacaagcgcacaggtaacgactgttcttttccttttatccagtacccaaaaatttttacgtcttgaaagtagtactcctaaccaacgtccatatgatccagccatctttctttgtcaggtgaaggccaagacgtgctctgaaaaacctggattttgaactttgaactccagctgccgcctggccaagggaagaagaagatgatcgcctgatcggacaataataaatgtgaaggcgtgatccggtcatcaagactggaggtggtggtgtcctggcgtacctgccggtgtgtgttactgcctctctcttttatggctgtacacatgagagagagagagagagatgcaggttactggtggatggagtagatcagtgctcatcacaaggcaacaactctggaaggtgagccccaaatccggctgcttcctcaccgcctgaaaaagagaggcttctgtgtcaatacccagcactcgtgccagtggcagcatgccagtgtagtgcgtgggcgtgcctgggggctgggtgtgctggacaatggacctggcaggcgccatggcctggcctggaggacacaccaaaggagaaaaagggctcaaaggcaacaacgcgagtagctacgacaaccttaactttgctcggattctgcaacagattgttcaggagtgcgtgtcactgtagaacagtagaggcttggcatgactcaagatgtctgtggttgtatgggcattggtctcatcagggcttgtgtggttgatgaggttgcagtcttgcagaaacccagggaatctagtagcccagcgatgtgcaaaggcagagatgagctttcctcaactttctgaaagtgttcaaagcattttcctatcagaaacaaaagtgttcaatgcattggagttcgagaaaaaggctaaggtcaagagccatttcagtgctagtacgactgttggagtaacatttgatgtgtgaaagttttggtgtcctcaagccaggtgaagtcgcttctgatgagtgatgttcatcaagactgatgtgtgctagtcatcatcaacttacagcccacaacgtgttgttcggtctgtcccttttgcttcttgttcgctctacatccacatcttctatccttatgttatgttaaaaagaaaaatcagcagcgacacattaatatggaagctgttttttgttatagataacagtgcagaagctggcaatcttggcgagacaaggcatggagccatggactatatggggtgtgagcaactagtgctgtgttgctttgtgaaacctttatggaagtaacagaaagagtcaatttcatgcggtcctgctccaagcaaccttttcccgagccttttgttcatccattgcctttcctaatcttcaggtaatgagtgtgcatgcttaaacaatctttgtactctttgcattcaccagattacatacttcctagtgcagtagcttgcatatccaggtatgtttgcacactaagttcatctcaatcttggtctgttattattgaacaagagtacagatgtaccatccaaactcacaccatgttcatccgacatgacgtatgagccctactctgattgttccttcacaaaacagtactattggaagaggacaattacctctgtaccggcatctgcagatcggaggcggaagtgaagaattcccagagcagaaaagttacagcggtaacagcacggagcaagggacaaagcttctgaattgccctaaacaaatccatcaacattcccttcacagctacgactaatatactgtaagtatcagccaggataaccaatcagagtatggttgtatgctctcacagctcacatgctgcacaataattggacgcatttgcaggttaagcatcagggctaacacacaattggaggcagtataaaactatgcataaatatatcaagatctaggcgtgtagcaaatgtgggcctctcttccactctctcacacggcttgaccaacctcttcttctgaaaaagaaaataaatacgcacaaccactgcccattattgctcttgcatcttgctcctagtatactcctatgcctgcagcatttgcatctcgttcaattgatgaattcttcctttttttgtaattctgcagggacctgatgatggggacaaacaatcggacaagcccaggttggcacgcaagcgagcgtgcgtgcatgcgttgcatgcttgcatggcaaatgcaaatggatgcatcgatcggtggacagaatgatcgcctgcattatcgcctccgccgctggctcagcctgcgtgcgagtgtgtgtgtgaccgatcatccactggacactggtcagctccagctgcgttgatagtgccggcaatcatccagccgcccggaggccgggacccagctcgcccgggttttcgtctccgtcgcacgaagcgcgccgcggccgagctttttgctggggaaaagaggagcttttgggtagacgattctaatcaccaggtgaacggctattcgtttattacatgtcaatcaaatggttatatttttttaaaaaaattaacacgatatattaatatataattttaaattcaacttatatacattataaaaaataaaaaaatgactgtgaatgttcgtatgcaaaatttgttttttttttcataacttgtacaagttaaatttgcaagtttataaagtgatatattatgaaacttttttaaaacaatttcataactatttaattgacatgtacttcctccgtcctaaaaaaaacgaatttatgactggttgtaacatattctagtacaatgaatatggacagagggctgcaggaat

SEQ ID NO: 75371 - DNA, 1594 bp, Oryza sativa
gggggagaggagagagggggagggagatgggccgaattcggcccaagagaggaaagggggatttttagggtttttctttttataaaacctttttaactttgtttatttcttaataattattatttgtgctctgaaaattccactaaaatttatttacacattttaggcttttaggaaatatacaaaaatcctccaagccttaattgacttttaactttgcacattttaatttttgaaggctttcacaaggattttaattattctaggcataatttaaagggtatattttagggtcattttgggacgcgacaattacgcttcgtagcggcccgaacctgtataatctcggtgctagtgtgcagttcagtagagtccagggcggatacaccatctccttgagcgagcctcttcccccggccgaactcacaaaggggggtctcacgatctcccgctagagaggatcactcctcgacagattcgaagaacggagtatgcatcggctgcgaaggcatcggctggagtctgcattgactgagatggatcggacagagggtagccgatacagccgatagaggtgatgcagccgattctgatgatgatgactttgaagatgcttctagaattgatcaaggtacttcacgaggattgccgtgatggagataaagctctcggataggcaattgtatctattaattaggatatttcatgtaatttccttagagatatgtttgggcaaaagtatgccgcaaagacttatggtatcttagagtttgttagagataaatatcgtgtccggcaaggacatatcttgtatctagggtataaatagaacccaaacccatataatcaattaacacacgttcaatacaatctcgtgcgcatcagccacccttttacgttttgttttcatctacgacgaagttctcgtctttcggcgtgagctgcactgtttcgatcttcaactagaggtaaacttgtcatgatggcttgcgttctcgggattagtgcttccatctttatgatactctaatattgtttatataattcgtcgagttatcacatatcctatataatctttgacaatattattatctaacctttaatcggccaacatctatcgttgtaaggcagccgattaggtttgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttcgggccgctgggaagcgtaataccctactcctgtgttttttggtggatctgtgtaagagcaagttacaaaatatcaaccagccctctcctctcccgggaaaatccccccccttctctctttgtgggcatggtcctccttttatatcttaaaagggggggggggggggaataccccaacaattgtttaaccccccttttcctttttccccccttttttttttttcccccccccaaaaaaaaaaaaactgacttttttcttttatggcggagattggtatggttgccgtccgaatgacacttc

SEQ ID NO: 75372 - DNA, 1288 bp, Oryza sativa
ctgagttgctgggattttacatttttaatgaccactcattcttggtaatggtatactgatctaaacatgcttcattttcggtgagatttatatcagaattcagaaacatgcgctagctagctgcatggcgctaattttcgggataactagcaaaaccatgtttcatgtttacaagactagtgctgtgctatacatcaatgaaattgaattattgatggattgaaagtttcttcgcttcgtcaggatgagccggccgccaaagatgactcgactgaagataaggctgaggcaagtagtgcatcccaggatgctggaaatccaacttttcccaataaagatctcagcagaaggatagcactggcctccactattggagctgtgggcctctttgcatatcaaagactcgactttggaggcgtttctctcaaagatcttgcagcaaatgctacaccgtatgaagaggtttgcagcctttctcctatgagacttatacacttacccattactggaaaaacagaagcaaacaacgtggaatttctaaatgctaaccgcaatccaccaacaagaaaaggggagcaaaatctcttatgtacttaaaaatctctaagcatcacccattatagtaccttttttgggggcagactgatcagaaccttttacgttcacgaaggaagatgaatatgcgagttgacatttttttatgtgcgtcaagacgatgttctgccactaggcaagctaaatgaaacatccaatcatttcagacaagatgttgttttggatattaatctgaaatatgttttcttctgtaaatgtattatatttttccattggtcgcaagatgctgtctttctttgggcagttgtcacagattgatgatgcattcatttccaatcaataggtccgatgcctttacatgtgaaaactttcacttgtatgacttgtcaattggttaagcaatatttatattttcttcctgtgctaaggtgaatagcttgaatgacaaataaaccttccatgtttttgcttcaaattggtatctggatttgctgcatttcctttgtttggtccgctttgtacataaattttacttcttcttaatacaatgatgcgctccttgggtattcccaaaaaaggatttgctgcatttcctgtgaagacattttctttacatgcctatgaatgtaacctgataatatatatgcaggctctctcaaatggcaagcccactgtagttgaattttatgcagactggtgtgaagtttgtcgagaattagcaccagatgtctac

SEQ ID NO: 75373 - DNA, 15196 bp, Oryza sativa
ctttaatcggccaacatctatcgttgtaaggcagccgattaggtttgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttcgggccgctgggaagcgtaataccctactcctgtgttttttggtggatctgtgtaagagcaagttacaaaatatcaaccagccctctcctctcccgggaaaatcccccccccccttctctctttgtgggcatggtcctccttttatatcttaaggggataccacatgtaccctctcctttccaaactggacttttcttctctttatggacggagattggtatggttgccgtccgaatgacacttcgatgggacagcccacacctacttccactcccggcggagacaggcgcaatgtgggatcgtggctgtctgttgctgacgcgaccagtgtcagaccggtcacagatcggtcattcttgtcctctatgcgtcagttcagcgatctgcatgatcacccttctttttatagcatcttgcctgtaatggttgggatgaagcctggtattcatttaaccagggctaacgtgccatctctaagaggtaacacgctagccccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgtttgaccagaccgcaataaatgcggttaggtgagccctaccgtgttcacccaacctatgtacatagtgcaaaccccacagggggtcggggcacctcggccctcggggtcggggcaggagcaacccgaccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggccgggcatgacgccactcatgaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagatttgtttcgtctggagatatggtaacgtcgcttcggtcagcgagcgtaattaacgcacacacgatacgatctatctcgactgccacaaccgcatatcttccttatgcgccgcaagcgggcgaatgggattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgcccctaactctctctttgctgcgcctcaccttcgccacacacactcgttctcaaccctctctttctccgacgacatggcacggggctccgctctgctcgacggtagcgtactaccgccttcccgcattgtgagtgagaggcaggctgggctgccgcgccgcttcatgccggaatccgccaccggccgggagatagtgatgctgggcgaggcgcgcccagcgccagattacccggggcggtccatcttcttcctccccttcgcaatggccgggttggttcctcctttttcttctttctttatggatgttctggagttctatgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggcggctgctatttcctgccgcgggggccggtgttgaaccgctacatcccctgcgtcctccgcaaaaagtgggatgactggaagagcgactggttctacacccccctcgccgacgaagcgcatctccgacttccgagccagcccccggtgcaggcctccagctggcgggcgccggtagatctggtgtcacgccctgaagttcccctcccttgctctaaattcataaaataaatcgttcgaagaaattgtttaatttaacctagagagaaaccctaaattaataaacgcaaataataatcggaatcggcatgtggaatttttcttgggttctacatgtcaaaatacgctaacaggatttttagtggaattttcagagccttggaaataattttaaccaattaaaatgagcaaagtgcaatattaaatccctgggaaaatcctttttctttttctttttctttttcctctctttttcctcctttttgtcaaatgggccgtcggcccatttcccttttcctccccctcctctctgctgggccggcgacaggccgaggcccagtccggcggcccaggccgcccgccgcctcctctctcggggtcgccgacaggtggggcccacctgtcgggcccgtctccctcctcccgccgatcccggcgcgccgccgcgcccgcaaccgtcgccgcgcccacgtctccgccttccccggccctcgtcgaccacgcccgcgcgtgcgccgcgtcccccgcgcccacttccctctctctcccgctcgcgcccgcgcccgagatggccgggattcgaaaatcggatcccgcctctctctcctcccccactccccacgtcggccggcgattcccgccgctcccggccacgtccggccccctctccccttatttaagcatcgccggcaccccctctctccttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcgtcgccggagccctcatcctcttgcgcacgggtgagcaccacctccaccgccgccgtcggccatggtttccgatcgccgtggtccatctccctctctctaacccctcccaaccttttctctaggtcctcccggagatcgttcgcccgtcgccgtcgtcctcccgtcgctcgtcgtcgtcgttcgccgtcgtctccactcgcgccggccaacctcggtgaaaaactccccctcctccccctttccctctcttccgtgtgcgtcgccgtcctccgcgcgcgcatcgtcgtcttcggccgccgccgccgcttttcgcgccgtctgccgtcgccgtccgtgccgccggttgccgtcgccggcgaccgcgcgtgccgccgtcgctcgccatgcttggcctgccggctttgaagccgagccgagcaggccgccttttccccccccccttgtgtcactgccagtagggcccgcgtgccggcgcctctccctcactctcttgagccgccgctcggtggggcccgcttgccagccgcccctctccctccttgagtcactgacccgtgggtcccgcatgtcggcgccgccccaccccttgctgacgtcagccctggggcaatattgcgcaataaattgattaagagtttttctttattagtaaaaacacagataatcttctaaaaatcataactaattcatccgagctccgtttaagtccattcaagtctcagtaaattcataaaaatgtgtagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgttttccgtatgccattgatagctggggtattaaaatgactagatgttggtttaggagatgcttagtcatgcttagttcaactagtgcacaaagggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagtttagcttaatgaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaaggcgtggatctgtatgtcaacaattgtcgtttgtgtaccctggctggtcctggacaggggtttaatacacattcagcttagaaattctggttcgtgaatttctgggcgcgacatctgggggatggctatgtcgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatgcggacccgccagggggtcagatgggattgggcccccgaggatttcaagatactgatccaacgggtgctaaatctcaactccgtggaggcgtccctcatcccccacggtatcctccccctctgcagcgacccagatcgcgtctccatcttgaccattatgacggcggtcggggcctcagaggagcaggctcctaagggccatggcggcgcaggtgggagccgccggggggatcaacctacccccggagggggtcgtgcttctgggccccgcgtcgggggctcggggagcaaccgccctaccgacgcccgggggaagaggaaactgggaggaacacctcccccatctcctccccgagggggcggggcggcacgtgccagcagcaggcgcccggagggggccgcgccaacatcgcagcccgagggggagcgcaagaagaaacggctgcgcaagatgggggagacagaaccatcccagggaaacctaatttcccctccaaggtggtcatttaaccgaccccctcgcaggttcgtcccgctctctttgcgaccgtcttttcttctatcccaaaagcaagttttaccttacctattttgtttgccttctggttttttcttctgcttcagcgatgtcccgtcgcgtccctcccgccatcccaagtccggccaatccgaggccgaagatccggcggccgcagaggaacagaggcgagaatctgaccggcgagaggccgcagatcgccttcgggaagctgaagaggccgcccgggaggccgctcgggttcggcaggcggaggataccgctcgggaggaggccgcccgggctcgccaagctgaagaagccgctcgggaggaggccgcccgggctcgtcaggctgaagaagccactcgggaggaaaccgcccgggctcgccaggctgaggcgatggcgtcttccgaggcggttcacaacaagaccgccggcgcgtcgctcgggcccactccctcgggtgacgctcaggcgacaacctccggggcagcttgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccaccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcgtcgccaccactgcgatgattgaggcgcaggactccctccgccttcaacacgggagctgggaggcggagctaaagaaaaagctcgacgccgcccagggggtcctcgacgccgccgctgcccgagagcagcgagcaacagaggctgaagcggcgtcccggcggcgcgaagaggcccttgaggcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccacgacacaacggctggcagacagcctgtccctccgcgaggcagcgcaggaggagcaggcgcgccgcaatctggaatgcttccgcgccgagagagccgcgctggagcagcgggctgctaacctcgaggcgcgagaaaaggagctgggcgcgagggagcgcaacggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaattccgcgctccaccaatctggaaggcctcgccccgcaccttaggaggatggcctgggctgtccaacaactccccgaggaactcgagaagaccatcaagtcatcctcgagggacctcgcccaaggagcggtggaactcgtgttagcgagttaccaggctagggaccccggcttctccccatggatggcgctggaggagttccctcccgggaccgaggacgatgcgcgcgcacgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcacatttgaatgagcccccaggcccccgccaatctccaattttttctttttctttcttcttttcgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccctggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgcagtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctaagggagtttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcatactctgctatattattggtcgctcgaaagtcaaggcggaccagatatctaaggacgtctcctgtcggggaggtcaacgtgacccccgcaccggcaccctggagggacagagaaccatcgaactgcatcactcagtaggtggtgtgaggtagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgaccgagggggtaagacgtaaccgcagtgaccctatgtgcctgaaaataatggcgcagtttcctcgaggccatcagaatagcgtaaagcatcttctgggcctgagggtatcgggtcttagcgtcccggagggcctcactaacaaagtagacaggccactgcacctttcggtggggccgatcctctctgctaggggacgtatccccggggcgttcttcgttcaagtggcctttcggggcacacttgtcttctgtgccgatgacctcggggtcggaagatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcatagaatgggggtgcacgaaatgaggattgtcttcaccgcgctccacaaccaacgctgcactaactacttggggggtcgccgctaagtaaagtagcaggggctcatttggctccggggcgactagaaccgggggagagctaagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatgagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccagggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggccagaagctctcgcttcatagccttgaagctccggcgagaaacgtgagcacacgctcccccgtcgacagtggcaatggtggccccaggttcttggaaacctaggtcatcatcaccatcatcgacgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaattttttcgagcatgcggttgtgccgcacacccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcaatgtcgaggcgggcatccggctcttcatgctgatcctcccgagtcggaggcgccgacgagggagtggtagccgaatggcgtgcagcagccgccgctcgccgcgccctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcttccccccgcttgggactttggcgtggaggaggtgggggagtacgagctcgacggcgcgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttc

SEQ ID NO: 75374 - DNA, 1061 bp, Oryza sativa
tgtaaaactatatttatacatgtaagtatatttaacaatgaatcaaatgatagaaaaagaattaataattacttaaattttttaaacaagacgaacgatcaaacatatttaaaaaaaagtcaacggcgtcgataacaaaatcggtagtgatgattcaacttaaggcggcaagtactgtaccttttcatttctttcacgttacgactagtagccatcaaaccaatacgtttggaaaatatatagtgaaaatccatgtattactacataaccattattactgcataattactagaggtaagtataggtataaaatacatttacaccaaatcttaagtttatactcagcttcatttgatagggaaaaaaagataaattttaggtgaatagtgtcctactactattgatctgatctttttttaactccctaataaaattgagttcgaacttgagattggtgagaatatatttcatgcctacacctatccctagttattttttgcatgaatttataaaacttttaggtccaattttaatgggttttcatttatttgatggttttcaccggatatgctccgatgtaggtatttgtgcgcaaattatttagatcagtgaattcttgtaccctagattgggttcaaaccctagatgaattcttgtaccagtgtgttggtgatatgtcctagagacaattaaagagatgattatatcacatactatgtttatatatttatcatacgttgtttcttgaaatagataactcattattgattaataaatatgtgagtccttcaagagacttttatgttgtatgttgttatttataaatgatccctgatgaaatatcatatgtgtaacaaatatggtttaatgattagtacatatattgattgatgatcatgcctcatagatcgtggtattaataatgtagacatatgttggggagcatgttgctggataaactcaatatgaggcacatcaagaactatatgtgatgtgccatcagtgatctcatttagtgttagttagaaacatcagaccgagattatcatagttcccaacat

SEQ ID NO: 75375 - DNA, 4172 bp, Oryza sativa
  unsure (1)..(4172): unsure at all n locations
ccttaacgggcccaccggttattgtcgacccaattgacctttaggtttgatgggccagaatagcttctttggccctcccggggccaaacctgctacggcgaagtcgtccccctttggcatatgctcttcgccttgagtccttcgcccatgaggcctctagcttggctgcgattccctgcctctcgccgtccttgctccatagtcttcgccaggggggggggggttcgccttgactaaccctgacgtctcgggcttgaatccccatcggtcgcatgctttcggcaggtttggtcgaagggcctcatgccatatcgccaacaagcccctcacgggcaagggtgagataggagcttcggccgagaccgtgcaaaccatgtggtatggtatgtggcgccccctttcgaccggtgctcctgtcgaaacctatattgttcctacaagtaaagtttgtttgtttctacgtttacaaaaaatttctttcagaaaaatctcctcttcacgttcgttgcaaagcgtcgatgggggcttatttagtctcttttattactatgaatagtaataggccctttgggtttttccttctccgtaatcgggctttttactgttcagcaccgtcccgatgggaatttaccgtttcgtctgccctttgacacgtgtcagagctcgattggttggcaggcgaacggtctcactacagggttatatatgcccccaaaccggcctgccatttttcactctccccgtgctcttcccctttttaccgctttacacgctccgtgctctcttcgctctcctgttttttagctttttcgccatcgtcgtgctcctagcctttcggctttttacctctctttcctatgctacaagcctaatggctccccgcaagcctaccaaggccgggtcaactggcgaagatcctggaagccttggcgaaggatggtcgtgcttccttggcaaatctcttgtcaaagaggccgacttgggcgaactggtatcatccggtcttctcatagagggccaaggatcgtgtgggggcaaggctgttgttccctcgcctggggatgggcgaccggttgtcttcgccgcatacttcgctgctgggcttcgcctcccatgcgacaacttcttgccttcggtgctttcgatgtatgacgttaggcttccccaacttagcccgtcagcgttcccgaagatggcggttttcgcttggatgtgccggacctgtgggttcgcccctaccgccaagctattcgccgctctgattactgcatgcgcctcgaccaaagacgtgcaaacgccggcgggtccgaggaaaaccgttttcggctgcgtgaacttcatgctgcggccggagcgttcagatgcttggccagtgcctgcatcgatggcgaaatgggacaggaactggatgcagaaatggttctatatcagcaacccctactccaccgaaaatactcaggcaaactggctgctttttgagcgttctgccgtctgcatcaacgcgaagccaaacgtggagatcgacgggactcttgagtcccgactcattctccttcgcaaggttgcccggcggctgagcacccgggatctttgcgaggagttttgtctccttcggatttccctctcgcccgtgtgtgggacgtttctgtgaacgagggcgaagaagttcttgggcttccccgccttgttctccccgccggggtcgaaagtaaggtttttgttttcgacttaggccgcatacttccttcgtggaagcgcttttttggctaaacggttgtgttcctctcttttcgcagtgcggactttggaagacgctgagattgaggcgtcgaagatgatcggagctctaaccacagccgagttcgcccgcttgctccagcgccatgttgacggccgagtgaaccgtgtctataccggcaaattgccaagccgatcgaacccctctcgggccggcgatgacgaggctggcactttgaaaaaacgcaaacgtgcggtcgcgaaaggcggccaagtccgaactcgccgtagcgcgaaggccgccgtcgaaagtgatggggaggaggaagaggaggatgcggaggccggttctgaggaggatggctctcatggttatacccccagccctacccctgcgaaatccggggcaggctctcatgtttcgcctacgcgactgcaagatatcgtcgtagcgaacaccctcttggcgatctccagcacagccgcgaaaccggtgattaggtttaggtaaaagttcgactgttatgccggtgaagcacttttccatagaccgaacggcctccaaatacctcttcatcccttcttcttttgcctcaaaggacttgtcgatatggcccgccaccagcttagagtcggttcggattagcaggcgccgaatccccattgctttcgcctttcttaggcccagaagaatggcttcgtattctgttgcgttgttggttatgtcgaactgcagccttgtggcatactgaatcggcacaccacttggcgaagtagtactgccgcaatgcccgccccgttgtgcgaccacgaaccgtcngaatgcatcacccagggctgttcgacgggttcgggctcgggggccagtgccggtgtccattcggccacaaagtcagctagcacttgggacttgacagcagttcgggcaacaaaatgtaagtcgaaaggggatagctctgctgcccacttgctaagccggccagtaacttctttgccccggagtatttcgcccaaagggtactgcgatggcactatgactttgtgggcctgaaagtaatgcttaagcttgcgcgaagccattaccagggcgtaagcgagcttttccatctcaatgtatcttgtcttcgctccttgcaatgcttcggagacgaaatagaccggtttctggcctgaatctgtttcttggacaagggcagcactgactgccactggcgaagctgctaggtatagtagcagttcgcttcctggtgctgggctaatcaaagttggcgggctttgcaggtattgctttagctcgtcgaacgctgcttggcattcaggtgtccagttgaattttcccgcgccccggagggtcttgaagaagggcaaacctctttcggctgcctttgagaggaatcgactgagtgccgcaattcggcctgcgagcttttgtacttcacgtacgctcgacgggggcttcatttgcagaatggcatcgattttctcgggattcgcctcaatgcctctttcagaaacaaggaagcctaacaacttgcctgcgcgaacgccgaaaacgcacttctcaggattcagtttcatacccgctgcgcgcaagttgtcgaaggtctcctgtaggtcggacgcgtggtcgaaagccttgcggctttttacgacgatatcatcgacataagactccacatttcgccccaactacttgtaaaggaccttatacaccagcctggcgaaggttgctccgacattccttaggccgaaaggcatcctgaggtgacaaaacgtgccgaatggtgtgatgaaggctgtcttggggatgtcggccgggttcatgtggatctggtgatagccggaatatgcatcttgaaagctcatgagttcgcagccagctgttgaatccacgagctggtcgatccgtggcagggggaaatcgtccttcggatatgctttgtttaggtctatgaaatcgatacacatgcgccatttgccgtttgacttccgaaccagcactggattcgccagccactcaggatggtcgatctcttgaatgaccccagccttgagcaatttttggacttcgggttttgctgcttcttggcgatcaacggacatcttgcgcagcttctgtttccttggcttggcatccggcttaactgctaggtgatgcatgatgaggtctgtcgaaacacctcccacctgatcggggccccaggcgaagatatcactatttttcttgagtacttcttggatgcttgccgccacttcttcgcccatgtcgccccccagcgatacgagctttgtgggatcggcgtcatcaatctgcatcttgattatcttgccgtgaggggcaggctttggcgcgtgcttcgcccagccatgtggttcggcctcaacattatgtactgttctgttgattatggcaagatcgccttttgaagcggccg

SEQ ID NO: 75376 - DNA, 1344 bp, Oryza sativa
acccgcacggcgtcgcgccggctccagcgtgcggcgttgcagggggcacgcgggaagcgcgccgaagcggaggagaggagaggggaagcgggcggcggcggagggccgaggaggcgcggagcaggacgcccgctgcggctggcggtggcggcggcgcggcaggggagaggaggggaggcgagggaagccatggagggagagaggggggaaggggaggaggcgtggggtgcgtttgactgtcagccacccatcatcgccattgatgacgtggcaggaaggagctcctggaagacctacggatggtgtcggtgagtgacgatggaagatgagaaccgtgcgtttgttatcctatggctgcggagaggaaggtacagcccaatcatttagcttattcggggaagaagccaaacaatatatttatacaaacgaaatataatttataaataaaacttttatgtacgtgtttttagtgatgaaaaataaaattcgatgaaaaacccctaaaatcagcttcagattaaatgttgaaaaattaaattttggctaataagtataagcataagttgcgtcaaaatgagaagaaaaatataaaacttacttaaaagtgaaatttaccagaaattacatttgttttcacatattactagaaatatgatatatttacaatacaaatacaccatcgtaaagaaagtgaactgcaagttcgatatacacatttgaaagaaaaaggaaaaaaaatatagatctatttggtcgagtttgacttgaaattttgtacaacggtactttattcaatcataaatatttgatgtttaaaaaatatttactttttaagatgacattttgtattagaatttttttagagtaagtttacaaaatacaataaattttatgatattattataggagttcttatggtgaatctatgtacagtatttttttaaaaaaccaaacatttgagaaacaattgtgattggaattttaagtttgattaaatcttatcttaaaagaatatatttcaccatgcactctgtcatcgtttttcagaattgctccgtaacaatctgatttgaatttgagaaaccccatataataaacttttcactcgtcatcaccgcgtgtcgtcgtctgaaatttgagaaccgccaaaatttttacttggcctccctctcgtcgtttctccagctgcccttcatcctcggccccgtcgggccctcgccgacgaagacgctctcgacgagcttccgcagccgctccctcgtcgaccgcggcagcagcttcgccacgcggttgatctcgcggccgatgtcgtactcctccttcggcccccactcccggtcgaac

SEQ ID NO: 75377 - DNA, 4246 bp, Oryza sativa
cgtacaccttcgcgccggcgaggtcgcccttcttgacccgctccctctggaagttgtccaccggcaggtcgagccagtacccgccgtcgttgccgccgccctgcgggaggttcgacccgtcggcggcgaccggcgtcggggtctggctacccttctggtacagcagcgcgccgttctggaagaaccacgtcaccgacgacggcaggtagggctcgtcggggtggaggaacagctgcggcgcgtaggcggcgaggagcgcgttcacctgggcgaggtcgggcatgcaggacgtgtacgccgcgccgttgttcttgaggcacgccagcgccgacgcgctacccgccgtcgcgtcgctcctggcgaggacgaacgtgccggcgtgcacgccgcgggcgtccacgccgcgaaccgccggcctcagggcgacggcgctgaacccgtccttgtcccacaccgtcgcctccgcctcgcacgcgtcggtgaagtcggcgcggacgcacgcgacctcgtcgcgcggcggcttgtccggcgaggccgtgaccgcgacgccgatcgccctgtagccatcgggaggcgtggggagccagaagtgggcggcgtcgtcctggctggaccagacgggcgcgtagtccagcggcggggcaaggagcccgccgccggagacgtcgcgggcgacgaggacgtggccgaagagcggcccggtcgttgcgctgcgcgtagtggccgagggcgctgaagccggcggggacctgctccggcctgaagaaggtggcgccgccgccgtcttggccggtggaccagaccttggcaaacgtggtgacttggcgcacctctagaccaccaaggtcaatgctaccctttgcaaatcctccatctgaaactgaaaattcagaaaggccagtcagcatctcgaaaagaaaaagaagcaagcaagcaagcaaacaaacaaacgccagtcagacaaagatgttacagagttgacaaaaccacaaaactgggcctatcaaaatggcaggccataactaagaatagaaattcgtttagccaagtgtttatagagctgaaaaaattagcaagtcataatgatagcaacagagagcagaaatggtctattcaagttgtggtgttctggatagagatgcgcatttgtcttccaaacaaccctggctagctagatgaaggcataagattatgctggtatatgctttctattctcatttgataacatatatattctttggaaatcatggttatcagtgtctgttcagaaaagggcacaccaatacgagcatttcagagcaaccgaggactagaggaggatcttgtagcccatgaatatagcaaagtatgttcctagtcgtcattgcaggtaagctacctcgccagcatcgcctaaagctgccttatttgcatttagccatataactcctgcatttgccatgcatgtatttttctctggatatgttccaatcatattggacttgtagtcaagaggaaaattaatgatgaatgcgtgatcaggacaagattgaaaaaaataataataatcagaatttgctaagtggagctgtgcgtgagaagaacagtaaccgagtatcgaaaggcaaaccttagtaatttagcaaaagaagcgaagtgctgtaatgatcaggatcaccaagttttgcaagaaatcaattccattcgagaggtacacaaaaccattcgtgcaaataataacataataaccagaagaacaaaaaaaaacacgaggtatgcacaaatatgcaatacgtacctgacgacggccacgacggcaacggagccggaagagagaacgccgtctcgatgggcagcgccgccgtgctggccatgggaaaacaaggcaaacaccacttgctccttcgcatagcacacacacaggacggggactaaccggagaaataattcaggctgttcctttcttccttcacttgcacagctatagagatcggagggaaagaagcaaaagagaggcaaatttaacgggcgagatctctgtccaggagacccttgtccctttcaacggcacagcgacttggcaaagacgactcgactccttcacagtcacaggcttggattagctagctagcttatcgtctacttctggcctatggttacttgcaagaaaccaatgtgctcctaagctctcagctctgcctgtgcggctgtgcctgatggcaatgacttcacttctagtgatccctacccgcatagcttggccgtctttaagaaggtgtggcttggcttgacggctcttccatctcccacgacacaagtctaatgcagacacactataattaatattgcatcgacgcatgtcagcgtcacttccatgaggaaaacacggcgatgttgtttagtgtttcttgcctgcctcaacttgtgtggatgcatgtgtgttagctggaggtcagcgtggacagacaggagtacatgacagtatgataggttcgttgtacaattgtactcttcctgaactgtagtatgatgtaccatatcattggaacaggagagaaaaaaacgtgctgcaaactgaacgttggtagcagcaaccagtaaccaccactacgcgccatgagctgcggttgttgcagactcgcggcaagattggttgggtcagataggcacaagtgacaaatgtggcatttctctaagcttctactatagataccgtaccatggctattggtcagataaggacttggtagtagttcacacgaatggcacgaggggaagctgaagctgacctgacctgatcagagaggtgtgctcggagttgaaaaattccggtgctgatgtggtggaggggagagctagcttgctgggacaagaaactgtgtcgagcaagtggattgcagttctggccttctgggttatctgcactctccagttgaacaatggaagtattcagattcatggagcaagaacagcagcatgctgctgtagactgctaaaaaaaattcagaaatgcttatctcgtagattgaaaggcaagggacattagaaacttgaaaaggatgtacaatgggaatatccgtttcttcgacatgcatatacatttagtcacatcaacttgggcattttcaggattaataactaactgttggtgacagactgaagaagtggatggcatgattttattctcatgcacaattatggaccattttctaatcattgagatgaacggatgtatgttccgtgaaaaacagtgcagaactttagttggaccgatccagaagtcacatgctgtagatcgaacacagtttatatattcccagcaaaaaatatgtaacaagagtagtttttcaactatctaaaaatattcccagcgaaaaagatatgaactttcatccctcgagggatgttccctcgttgtttgcatgtcatctaaatagttatcaaaaagtttaaaaaaatttgacaacgtagattaatatgaaatatatcactccacaaacatgcaagaccaaatttaacttctacaagttgcaacaaaaaaaacaaaaaaaaactgaaaatagttatcttacattcatagctatatttgttatttttgttacaacttgtagaagttgacttttaacttgcatgttttttgagtgatatatttcatattaatctatcttaccaattttttatgattatttaggtgacatatacgaaacgagaggatatcccctcaaggtatgaaatcactttctgagtgaaaaatccatgtctcatgtgctgcaacgccgttgcccaatttcgctgaccaaaccctcacgaagtggttggtataaatatggaaaacaaagacgaatgcataggataatatagagagcacaagttgtcatgtatgatggagataggcatggccaaaacactgggaaacattgtctccagataagatgagtatgagggacactagcccatgcagccatgctacagtgactttcagttcaacatcttttatccatcagcaaaattgaaatcatgttattcctttctttgggacattgaatacggatatttcctagattatgacaggcatactgcagatatacattgaataagcgcaaattaagcattcgattttgaagtatttggttttcattgctggtttattttggacaaacccacttggctagcatgcaaaatcgtgaactgaaaagagcgaagatttcagggtggccataagagaattaatttactgaggggactgctaatactagtggcatatatat

SEQ ID NO: 75378 - DNA, 7018 bp, Oryza sativa
  unsure (1)..(7018): unsure at all n locations
acatcttttatccatcagcaaaatgaaatcatgttattcctttctttgggacattgaatacggatatttcctagattatgacaggcatactgcagatatacattgaataagcgcaaattaagcattcgattttgaagtatttggttttcattgctggtttattttggacaaacccacttggctagcatgcaaaatcgtgaactgaaaagagcgaagatttcagggtggccataagagaattaatttactgaggggactgctaatactagtggcatatatatacatactgtcagattacaagtaagaatgattgcagagagaatagtggaaatttcacatttatgaacttgccattattttcgttataacttaaaaacagaataaaacctccatgctgctggtactaacccctctgctttgagaagacaggttctttgttccctccaataagtcagattccttcgtcatcccttgaaattcaatcagtcaggtgtgttatcaccaatactcaaatgcaagtactgcaaagcacagtacaaaactaaaattacatttccatttcccagagtcagttacacacaaacttgcgactgtatggctaaagaaacacttaccatggcctacaaagaagggaccatctggtatcctgagataaaatagttgttcccgttttccagcaaaccagattttagtgggtcaggggctttaatacaaagagaaagcagccccagccatgtgctaactatggcgtgtaacaaatgattcgacaagtggatttacaaggtcaggtgcttcatcctgcaaggaaaattataaacaaatgattcagctgccaacttatcaaataaaatatagctaaaagcaaagcaaattgcaaaaaagaattaatcaactgatttcagctgttacaggacctgtgggcagtgtccaacatttggcaagacaacaaaatcttcaacagtatcaaaagatgcgtaagctcttccaagctccacaggctcccatgggtccttctcaccccaagctaccaaaactggacactgcaaaaaaaaaaaaaaatcatatatagttgatataaccgaaataagttctaaaaaaacaaagtgaataatcactcacagaaccacaggaaacctaaccttcactctgggaagtaattcttcaggtagaggacctcctgagtagcagatgaactcaaggaatacatccacagcaccagggtcaagccctggctgcagaataaactgaactagctcatctgtcactgcggatgtgtcatggtagcactgaaatgaattccatcagaactaggagaaaaaacattgtggaaaaaaggttacagttatgttacaaactaaataaagggaaaaaaacaggttctatacttaagatgatgaattaaagattttctttctacagaatgcagccattggagcaaggtcatgtggcttttacttaatttgggacgttaagcctgaatgttgtgttaccatagatttttgtatatgcccaataatctgcttatgctttgattattttccaagatgagaggattaaataaatatacacctgacagagaatatttttcacagattctggtgtagcaacagcgctgaagaacagcttcccaataacagtattcctaaaaaccagaaaagggattgtaacaaggaggtaacaagtatgtggatcccgcaacaaactatgaaattctgagttaccgtagcagactttggaatgatttgatgaaaggccttccaaaccatggctgcttactgatatgaagcatcctcaatgaaatattcaataaaaagatacccttgcacttctgtggttccatagcagctgcctgtagaccaacaagccctgaaggacaataataaacacattacaagtgcttgttaaattctttttcatgcgtacaaatactcatcagtgacatgtatcactcgcacctcccctcaaaatttagaggtacatgaagagaacttgtctcatcttggacactactccaaatatcattctggagtagttactaggctaatacactctagtataatgaaaatcaatttccattgtgaagcatgagcgcatatgacatatctagttgatatcaccataattttgaacagcatcatgcacccactcactacagaaatactccctctagtcattaatatatgatgtttatatattaatgaccggagggggtaacagataggaacaacactactaaactagcatagacatcatttacggtcttcctttttccctactcaaatgtgttttctgaaataacaaagggaggaatttgaaaaatgttcttttggcagagtaagcaattttatggattacatcgagcgacatgcattcttatgctcgtccattagttacacatacaacatatgatccattgcatttcatgtatgatgtatgtaagcatggagctgagcatacctccaattgaattgcatatgaagaaagcttcgctcttaataacttcagcacaaaacgtattcagctgttctccccatgtctcaaaagtataaaagctctcaccaagctcacgtggattaggcttatcagaatagccataaccaataagatcaattgcatatactctgtttttcagagcaagaacaggaatatttttccgccaatggtcactggaaaaaaaaaagaggggagtctgtacatgattgctaagcaaagtgatggggtgttttttgacgcagaaaagtgatgtagtgtgataattaaaaaacaaacactagtagtccccattattgtatcaaatcaaactattggaaaagtaatgcagcttgaggtttcatcataaaaccaacatttaacacagcccaagatttaacaataactaaggattacatgtgatcagtgatcactaaccaaaaaattctcaaaatattaggtccaacatttcttctcctaaacctttacaacatagaactacagaagcatctaaaaaacagttgcagcaacagctactgcactgccatggccttaagctaactccccattggcatgataactgaaaattttagtttggttgcctgcagatatgaaacagaaagtccacgcacctgtttgctccgaaaccatgaattagaaccaatgcagggccagaagttcccgcgtactggtaccgaatgttgtagcccttccaattccacatgctacgcaaacaagatggtaatttagaaaccagaaatacgagaaactggaactctgtaagcaaggtcacacgcaaaataactcagggtaacacttgaactatagactggagtgggggagtggagacttgtgcctacctggtgcgcacctggggctgagtctccaacggagcatccgtggccgtgtgcggcgccgcggggaggctctcctcgaccgggtcggccatggaggaggcctcgacacgcagcagccgcgcccgcgcccgcgccgcgttccccgaggagagcctcgccccggcctccaggtagtgcgccgcgccgactacgcggggcagaagtcggcggcggcggtggcggaggaacccgtgccacggcgcgcggagagggtggtggccactggaggacgtgccgccgcgccgctcgtcgccatccccgacggccgcacgcaacgcaactacgcgggggcaccgggctgtgtggagcgtggaggagagtcganacgagagagtaagagaaagggatcggtgacggtgagaaaaagcgtgacttgtctgcacggcgtttcgccgcgtgggcgaaacggaacggaagaaaaagtgcgcgcgtgcgtgtgcgtgcgtgcggcccaggtggtttcgctggtccgtcacgccagtggacgcgtgggccaagaggccgggacgtatttgggccgaggcagtaaatcactccgcgggccgtagggatgcggcggctaacgtatttggtctgggctacgtgcacgggcgcacggctgctctattgtgcatgggccatctattattaccaggtggcccaatgtacagacgcatgctactactaccagagagttataagaggggaccacctatacatttggcgacaaattttctcctaaaaatttgacagatgtaattgtagtacaatcgtagtataattacactgtaacttatatgtaattacactgtaacttgtatgtaactacagtgtaacttgtgtaattttgaatcgttatatctattacaagatttgttttggtgaggaagaaaaaaaatcacggcacacacatatgtataaggatttgttcccacaacctccattttaccgaaataacatattacagaaagatttttgaaagttacatacaagttacactatagttacagtgtaattacatgcaagttacagtgtaattacactacgattgtactgtaattacatctgtcaaatttttgggagaaaatttgtcgataaatatatagcaaaatcgtataagagttaagaccacattgaagtttgaacacacttgaggtgtgtttggataatggaaaatggagggtgggattgggattgggaaataaatgaagggttagattaaatggaagagggagaatgaatagttaggatttaaagatatcttttgatggatggaaaattatttccctatcacattatccaaataatgccttgatgtggtatggactcatagcggactcggattacaaacagatcggatagttcatacatgtataaataagacgttttaatttttttacaatcaaatttataaaaaaaaattagcaaatttaaacattaaattagttttattaaatctaacgttaaatatatttaattatgtttgttttgtattgaaaatgttactatattttttcataaatttggtcaaatttaaaatttttttactacgtacacaataacttagaaacaacgaaacaagctactctcaagtctcaacctagcgaaagagtctctcaaagttttaaaaagacagattagtcatttgaatagactataatggtgtatggttcaatcatagggtgtgatgatatgcccttacaaatatcagattatcttaaatagcactttgtcgaataatccgcgtaaaaaaattaaacaatccacatccatcggattacagtaataccatatctttatctatctccgtcaaattttagatacctaccatatatcctcatttcgggtacggatgggatcgaaaagtatccgatttattttcgtcccttatcattgatgaggttgactgctggacctacaccaataatccaactagaaaacgagcagtggccagtggagatgtggaggtacaggcgtaagaatgacgagcaggtgagcgtgcagccgtcaggtggctgcgcactgttcgtttgactattggctagggaatctcttcgactaatctttcttcccgtctcaaacaatcactgacctgaaacaacacacgactagttcagctgaaaacgcagccacgcaagtcgcgcggaataatagaattgatcacactttgttcagagtcaaaattgtcaatcattggacattccagctcgttcatgagctggtcgtgcatcttgaacatcagaacatgcccttaatttacacgtagcttaatcaagtttggagatctcatctgacctgagcatggtgtgattcgtttgtcacactcacaatgcaactccacagcaaaacgatgctcgttgtgttcatcaatatcgtgttcatccactgccttagcgtgaacattggagcggcggtggccaaccctgcagccagcgatggccggttcgtccaccacggcttcacggcggaggacctcaccatggacggcctcgccgccgtcacgccgaccgggctcctcgcgctcaccaacgccacgtaccaaacgaaagcccacgcgttccaccctgcgcctctccgcttcctcaacacgtcgtcgtccgccgccgccaccgtgcggtccttctcgacgtcgttcgtgttcgccatcgtgtccgacgaccccaggttcaggaacaacgtcgaccatgggctcgcgttcgtggtctccccgaccaagaacctctccacggcgaacgccggccagtacctgggcctcctcagcatggccgacgacggcaagccgagcaaccacgtgttcgccgtcgagctcgacatcatcacgaaccccgagttcggcgacatcgacagcaaccacgtcggcgtcgacgtcaatagcctcaggtcgctgcaggcgaagaccgccggctactatgtcgacggcgacggcgcgttccggagcctgcagctcaacagccagaagccaatgcaggtgtgggtggactacgacggccaggccaagcagctcaacgtgacgctgtctcccgtgcaagtgcccaagcccaagaagcctctgctctcccaagccatcgacctctccacggtcatggccgaggagatgtacgtcggcttctcgtcggcgacgggcgtcgtgttcacgcaccactacgtcctcggatggagcttcagcttcgacggcggagctgctccctcactggacttctccatgctgcccaaggtgccacgagtgggtcctacacgtcggtcagtaatgctgtatgttgtgttgccgattgccagtgcactactgtttcttgttgcgtttgttctgggtgtcttcttcgtgagaaggtggcaccgccagtttgcggaggtgcgcgaagattgggaggttgagtttggtccgcatcggttcacatacaaggatctgtttcatgctacgcagggattcacagacaagaacctactcggtgcggaagggtttgggagcgtgtacaagggtgtgcttcccgtgtccaatacagagatagcggtgaaacgggtgtcacacaattcaagacaagggatgagagagtttattgctgaggtggtaagcatcggccgtatccgacaccggaacatcgtgcggctcctgggttactgtcggcgcaagggagaacttctccttgtttatgactacaagacaaatggtagtcttg

SEQ ID NO: 75379 - DNA, 588 bp, Oryza sativa
ttcctgcagccccgtaatattaggatatgtcatattcagtattagattgtttttttatgggacaaagggagtatgtaagaacaagttgatatccaggtgattaaaagagtttcccgtgtttttcttggaaaagggcaaactttttctcgcaggtgaagcgaggctgggctggctcggtggtgagatgggccggcaaatatcgcgatgggcttttgttcggctctgtagcgtcccggttcttccattgcgcgattgcgggcgacgtggcggcgcgtcggccacccacatcatcatcgtctccacctccgggcttttgactcgggtagggagaggttactgactttaactctgctcgagtggttcttcctcctgcggttgccgtgccgtctcgtactctctcgtgcaggctaacgttggaatcttgggaggggagatggcggtcgtggcatcgaggtgtacggggctgctcctccccgacctcggcgcgagcctcgccggcttccgccgccgccgctcgacgccggcttcttctctcagcttccgcccgcggcgggcccgtcgacggctcgggtccctctcctgcatcgc

SEQ ID NO: 75380 - DNA, 1762 bp, Oryza sativa
ttttcttgatcatgtggttgctcttgcttccggtgagcccactgtacctcatgcacgggttgttggccaattctcgagtgcagaatcccgaaagttcatcaagttgctgatccaagaagccatggctaacaatagcttgtggtgatcaattttagtggtaatgctaagacctattgacaagtaagtctcgtttttctgttgaagaggtactatgtgttgtctgcctgagcaccagcatgtctatgtctgtttgcagaagtgccaccagattactttactcactaaaatctcttggtgacagaaactttgaacctttatgaaagctacctttccagctaaactaatactatatactataatttaataatagttaaatgaacttgttttaaatgtatgttatctgaatatcacccttatcgtgttctctcacctgtatattgtcatatgtttcccttcatctgcatctcgatttctaaaagatggtctaattcctgcaggaggcgatatggtctgcatgctcagtcctggaaccaagcattagcgcgtggacattggtactgagctgttccaactcccttaacgtatatgattttgctggtagaaccaggcattcggctacagcattgatatgttggtgatatttgaatcggtgcatgtctgcatacatatttgcataatgaaaatgcagacatgtgttgcagccgcaagcatgcccatgttagtaaactgtttaccaatcaccactagtttctacttagaattgcaatagaatgtttatatacaggagcttactaaaatttgtgtgatatatatatgcttctgctactcttggggaaagctgcacaacctgtgttgatctatcttagcatactctcaactgaagtgaaaaattgcaggccaactattgccgtgtgtcgttcactcgttcgtctgaactttttcagttcggactttctatattttgagcataccagatgagatgacagaatcgtgacgcaggctcgttgtccccattgtcgacagagttctgaactcttttatctaaatctctgttctgttcatatgaagtcattcggtctttgttttcaagagcaagccccttctttagtactctttttaatatttgacggtttgactctcaacataagtttgaccatttattttatatgtatttcctttttccatattataaatcgttttgactttttccatagtcaaacttcttttaaatttgattatgtctatagaaaaatctgtagcatctacaacatcaaattaatttcactataactaacatttcataatatgtttgttttgtgttaaaaatgttgctatctttttgtataaatttggttcaacttaaaaaaattgactaagagaaaaggtcaaaatgatttacaatatgaaacacggggagtaattatttttatgtgttttatcattacaagtattttaaatatgattttttttcatatttgcccaaaaattttaaataagaccaatgtatgtctgtagatcaacgatgtcaaacctagtaaattttactttgggtcatcttttattatcattgttttgcttttgaccgtcatttaacaaatgttttcattttgaaccaattaaatttattttttatggcactttggaccaaccttaacaaggtaataatctaaagttagctacgggagttcattgacaaatagaagccggcgcattggttgtcctaagtgaaacaaagccgatctaaaatgaaaatattagttta

SEQ ID NO: 75381 - DNA, 5755 bp, Oryza sativa
gacccccccccccctcggggaaatcaggaggagggcggacacctcaccctcgggcccgacgtccccgaaggtgccaggccacgtgggcgattccatctgcctcaagcctccgggcgcaatactcccggtcccatatcaccgacaaggttaaatactaatatcgacttagattatatagggtatccaccatcctatgaaatatccaacggcttgattgtctagatactgttattctttccatacttataactgcatcagttaagtttgaccttataagtcgtgattagaatctcaatctctagcctgcttttggttgccgattagggtagtatcggggtttcagccgatcttacctgatttaactcctttatattttatatgcttgattgatatgttaaatccgccctttatattaagatcttgttgcatttaggtatattaaacttcctgtttgatatattttgcttgctttaatatcttaatatagaatggtatcggagttttagccgatacatgctagatctatctgatcggctatgctatgaatgcttataatctccttgttaatatatattttgatctaagtgatttatactatctcggcatggcgaccgatatatcctaatcacttgatttaagtatatatcgacagaagcattatataccattaatatttacagccgatcgaatagatttagttctttctttcctatttatgactgccgatcgattcaaatatgtcatcggctcaaagataaatgatatgtcatcggcgactggccgattggctatcatttatggatttaaccgctatttttttgtctttatttcttgttgattgcaggatcaaatcaactggcacgctcacgaacctaaaggcaagattttggacctgcactgaagttaagcagatcttccaggccagtgtgtgtttttcgcatcaacttctattgtttgtaaataaataaatagcgtacgaaattcatttcactgttgccggcccggcagaaaattcatttcactgtttacaatcgtttctagcttcagcattttacagcctacttacaagctagctagctagctgacttggcttccaagcagacacaagctttagtgctcatcctcctccgagatttcagttagctcagagaagaaatggtaagaatccactgttagtgtgaacgcaaaatatgatcttgcggctaaacctaaagtcggcaaagagatattttgtttagggtgatcgctacagtgatcgatctctcatgaacatccctgatcgggggataaccgccataccctagtgtcggttccccctgtgtgcagtggctataaatagagatcaatacctaagtgttaaaccctaagagatttctctcgctacccgatcaaacaacccactgaaacacagggaagaatcaagacacgattctcttcgtgcttccaaactagaagagaagaaagaagaacaaagacagagagaatgggaactccaggagatcaaggtatgatccaatcccattttaatttgtagttccactttgtgccaaaccgattctatcaaatccaacaatggtatcagagcaccgggttggcctcaaattggaactcaataagtgtttatgttcaaattgttcttcgtgttcatgcccaaatccctctgttaaagttgagttaagcccaaatcatgcaatcccgaaatataagaaatggaattaggccttctagggtttcgggttgaagaaattagaagaaggggaaagcaaaagttcatgcaaatctcagacaaatccccaagaaccgaaaccctagctacagtaagatcccaaatttttccccaaatcatgaaaccctaaccctaaaatcaaggggaaaaaggagcacggcgggcttacttaagggccatggtggccggcggcgaccaccgtgtcgccaccgacgccggaaagaggcgagcgcgcgcccgaggacttggtccccgagcggcctcgcgacccgtcgtgctggcccggctcttcctcttcgcgtgctcgtctcgccgacgccgcctcgctgaggtagccgtcgccgccccgtctcgccgtcgccgccgcggatcttcctcgcgcgagcgaccggcgggtgcttagggcaccgtcgagcaacgctcgacggggatgcgcaccagctatggcggcacgcagccccggcgagcaaggctcggcggcgccacctccaccccgtcgtgcgccgcttcgccgtcgtcatcgtctcgctcaccgtcgccgcgggcgtgagagaaagaggggaggagagaatggggctagggttttcaggggggggggcggccgcgcgccggttttgtcccgcgcgggagcgatcccggccgtccgatgagatggacggctcggatcggctcgtcccgacgcgggctaaccaggccgcgcgggaggcggcgaatgccggcctaggcccaggttgttgggcctggagcccaggcggaaggcggcgcggcaatgacgggccaggccgagtgcggcctggctcgagaacgtggcccagttcaaaaaaaaaggttatgtgggctgcatactaatgggcctaattaaaaggattgggctgagataatattacaattaaaattttcttttttgaagaattatgattatgattatgatatttgtgtttaaacattgaagatattttattatgttttagttaatgataataagaataataagtgattttgttatgtgataaaattctctttcatttatttatttattttatgatcattacattatatttattacttaaagttattattgttttatgcattatgagtttatttccgttacaaataaatattataattaagtgtgacaaataattgtcattctggccaaagctgattgacttttatttgatcacaaaattttattaattcaattcaaatctggctaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaaggtactcatcttatgcctcacaaatttccggaataatgggcaatattgaacaacttaatggaagtaattatgcttcatggaaggagaagctggaaattactctagctctattggatattgattatgccctccataatgatcctccggttgagcctagaccggaaaatgagaattatgagacattaaaaaggatatatgatgaagtaaaggcaaaatgggatatttcaaaccgtaaatgccttatgattatcaagagctccattattgacgcaataagaggagcagtcccagatactcagacagccagagaatatcttgctaaagttgaggaacaatttaaaggctcttctaaggtttatgccaccactcttattaaaagattggtcaatgaaagatacgattttactgaaaatctgagggaacatattatgaagaaatgtcacatggtttctaagcttaaatcaatggaaatggaaatctctgaaggttttcttgtccatttcattatgtcatctctgcctcaggagttttctccatttacgatcaattataatgcaatgaagatcaagtggggcattgatgaattaatagccatgtgtgtacaagaagaagaaaggcttaaggcagaaagagttgaccatgcaaatttatttaagcactccgagaagaaaaagtataagaaatttaagaaggagtatttgaagcctaagcctattcaatttaaagaaaaagggcaatcttcgaatcaatcccagcagaataaatctggaggaaatccctatacagaagaaaagggaaaagaaaaggatgggtgctacttttgtggaaagagtggacaccgccaaaaggactgtattggatttatgagatggctcagtaagaaaggtactgatgttatttcttttgttgatgaatccctaaatattgattatgccaccaattcttggtggattgactcaggagcgacaattcatgttgcaaattccttgcagggattcgctatgaggaggaccctaagaagagggcaaagaagaattagagttgctaatggagttgaaactgaagttgaggccattggagacttcactctcacacttcatactggcttcaaacttcagctgcatgatgttctttatgtaccctctatgaaaaggaacttagtttcagtttcacgtttagataacggtggttactattgtacttttggaaacaatagatgtataattatgcatgataataaagatgttggtctcgccgtttgacgggaacaactttatcaaatctctgtgtgcgatgccacctataatgttgactcctcctcaaatgcaaatgtcaataccaaacgaaaacataacgataatgagacttcttcgaaattatggtagtatcgtttgggccatatttcaagggggggaattgagcgtctcattaaagaaaacatcctttatcctttggacttctcagatgcagatgttgatcactgcattgattgcatcaaaggaaaatattccaagcaaatcaagaaaggtgcaaatcgaagtatgggagttttggaaatcatccacacagacatctgtggtccatttaatgaaaagtcagtcgatggatttgattcattcattacattcaccgacgactactctcgttatggatatatctatccaatcaaagaaagatctgaggcattagacaaatttaaaattttcaaagcagaagttgagaatcaacatgattgaaagatcaaaattgtaaggtctgaccgtggtggtgaatactatggtagacatactacttatggtcaaattcctggaccttttgcgaggttcttacaggaaaatggcattaaggcccagtactcagcaccaggcgaaccccagcaaaatggagtagctgaaaggcgtaatcgcactcttatggatatggtacgaagtatgttaagtcactccactctgccggtaaagttatggatggaagctcttaaaacagctacaacattcttaacagggttcctagtaaatcagtccctaagacaccttttgaattatggactgggaagaaaccaaccctaaattattttcatgtgtggggttgtcctgctgaagcacgagttttcaatccaaatatgggaaaattagacatcagaataatcagttgtcattttatcggttatcctgataagtcaaaggcatatagattctactgcccaaatccggaagggttttttttaaaaaaaaggtttcacttggagaccaagaacacgctgtgttcttggaaaatgacataatcaaggggagtatgacacccagagaagttgttctggaagagaaacgaaattatattccaatgcctataattgaagaacccgttttctcaacacatactcatgttgcaccttcaatagaaagaaataatgatgcaacacctgctgaaactcctgcaactacttctagtagtgtatcaaatgatgagaataatgaggatgctcagcagccccagattgtgatagatgagcaaaataacgaacccgtcagaagatcacaacgagttagaaagtcagcgattccaagtgactatgtcacttacataaatgaagaggtgaataaacctatgggtgaagaggtgaatgagcctatactagataatgatcc

SEQ ID NO: 75382 - DNA, 701 bp, Oryza sativa
ctgcagcctgttatgtatggatgatggaaagattatgttctgtgcatgatattgtgtgttctgtatgaatatctctattattatatatgatgctattgatgctcttattttaccataatcaatttcttgtacagaggaaccaatttcttctatagagaaaactgatgactgtacagacagtcagcttttcctgatctattatttttccaaacaaaaagttcattatattgcatttttttcagtgccacaataaatttgttatacgctcattatttagtctcataaaatacacatattgttcagttaacattttttcaattttttcaatctagctgccactcctacatctacaaggggattttagacatttggaaccacacataacgtgaaaatgaaggaaacctaacgggaggggcatggaagggatcacagcgaaatttcaggggtacacaggggattggataaaattcgggggtatagaagggattaggtgagttttggataaaattcgggggtatagaagggattaggtgagttttcatgggcacacaggggattttctctatattttagcattgcatttacatggaattagaatgaggagtattggaagaaggaagacggcggcggagcatggggcagcgtcgaggaagacaacagcaggtacattgatttctgcccatgctcccctactgcttgat

SEQ ID NO: 75383 - DNA, 5566 bp, Oryza sativa
ggcaaaagtggcaaatagttaagaaattacctctctcaagtggcaaattattaagtacaaatctaagaggggcatttggataattggcagatctaaaagtggcaaatagttaatttccccgccaccgggacactatagtccttggagaaattggcccacaaacagttggacggtctaagtttaaagcccaagtacgtcacttgtatggcctaaatagtttgcaattatatatccttgcgatattttagtttattataataaaaaaattaatttcttaagagacattttgatcacaatatgaagagattttatttgggggcatctaggaatcgggcgcccgattcccaggtgcagtagactcgaatcctcctcctcccatgcgccaatcaaaaatcaactaagtaaagccactgctatgcccagccggaacaagatatttctacgtcagagggacgtccgtgccggatcgtcgtccgtttcacatccgacggtagcatcattttcagaccgtgctcctccatcgaccatcgtctccgtccagttgcagaccaagggaaaaaacgaggttccgctcgtccgcccgccatggccacgatgtcggcgaggcgcttctccgtggatgccatgaccaggcagcagaggttgacggagctgagtacgacgagcagccagtagaagcagtcgagcctcccgtcatcgaggttatcaacgagctagccgccgtcagcgccatggccggtgaaggtgatcttgtgcacgatgatgatgagcagcgtgctgaagaacaagctgatggcgcacatgctcaggaacagactcgtgttcatggtcttcatccctttggagtttggatcctcgcggaggaagacgttgaggagcatgtaggtgaaccgtgaacgcttcgccaaagctgacaggagaaactggggcatcagcaggagcacggcgctgtgcgacgacgatgatgtcagccggtgccacaacggccaagcgggtgatggagagaaagaggccacaaacacgcttggagctggggcttgccaacgtcgtggctatggcggacgagcggaacaccagcggtgttttcccctcgcttggtctgcaactggacggagacgacagaggtgcatgggctggaaaacgatgctaccgtcggatgtaaaacggacgacgatccggcacggacgtccctctgacgtagaaatatttgtacgtccctctgacgtaaaaatagtttaaaacaaactttaaactatttttttcttaaattatttaccaattcacaatccaatttcaccactaaatttgttgcaattaaatctttaaaacaagactacacatggctataattcaatgaaaaaaatatttagctttattaatgaattgtttttaatgttgcacctatatcatttaaatgtttcatgtagtattcatatgatgtttcactttttaatttgtaaatgttgcacatgttgttctaggaatgtttcagcatgtactttataatgttttaataattatagttccaccaagtagtaaaatgaccaatgaagttgtttacatagtttaaatagtttgaggtgtcgatataactggttttgtgggataggaatcagatctgacatatatttgagggagacaaattatactcctccggttgataaagatccagattggtggggaattttttgtatttttagatttttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaggagaaggggaggagaagaaaagaagaggcgaagccctgccagtttcaaacttcgatttcaggtaatattcgtagattatatacgtgactaaatatatgataaatgcattgtatgaaataaagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagatatgtccagtaaacttatatttcaactataccatggtcaaggaaacgtccgttatgggccaactggggtagatctgtcagaatttattgtaacagcaaggggaattgataggccagccgagaggagtgtaccttctataaaaaaatggttgatgcggggcttgggagttgatccacagactagtgacattacaatctatgttgtagtaagtcgggcaacagagggtttttattgggaactaatgccggttcaaaactctgggatgtggagatggtatgtggagaatgcattgcaacgtgggtggcctctagctatggttccgtatgttcatccgaaggatccaagtgtacagatgaacatggatgatggcgaggggccaagtgcagaagtgaatgagattgaagtggatcaggtcaacgcaccagaggaagatggagtagctccagtagtagctccagtaggcatgcaacctggtggagtggctgacgagggggagactgtgggtgccattgtggacgaaatggaaaaagaggatagtgacaacgagcgtgtcgaggaagatgattcgtcagatgatgacgagaacaatattaatccagctgaatgggctagtgatgatttttctggtttggtcatctctgaaggggaaaatgtgagatgggagtacaaggaaaacgagattatcgagggagcgaggtatggtaatggagaagacatgaaggaggcggtgaagcattatgcagtgtcacttcatagggagttttgggttgccaagtctaaccggacacaatatgaagttaggtgtgttaatgaaaaagatgggtgtccgtggagagtgcacgcctataaggggaaatggaaggactactggacagtgtcggtcgttacgaaacatacttgttatctacctggtgttcaaaaataccacaggaacattacatgtgcatttgttgcatctgagatgtatgcgcatgtcgtggacaatctggcatatgaaccgaagtcaataatccgacatatcgaacagactttcaagtatacaattagctatgccaaggcgtggagggccaaacagaaaataatagagatgagatttggaacttatgaagcctcatatgacaatttgccacgtctgctatctgttatccaacaaagaaaccctgggacctcttgtgcactcaagacattcccctcaattgaacatcctggcaagactgtgctgcaaagagcgttcttagctctacatgcatgcaagatggcattcgtgcactgtcgtccagttctttgtattgatggcacatttttgaccgggaagtatcggggccagatactaacggcaattggggtagatgggaacaatcaggtattgccgttggcatttgcttttgtcgagagcgagaacaccgacagctggtactggttcctccatctggttaagacagaagttgttggtatgaggcccaatgtgtgtctaatacatgacaggcacgccggtatgcttcgagcgatagaagagttaaagtttgggactatggaaagaggataccctggccagtgggaagatgtacaaagcaggtggtgcatgcgtcatatgggagctaatttcttcaagcaatttaagaacaaggagttgatgaacatgttcaagaggctatgcaatcagaaccaggagaaaaaattcaatgagctttggaagagattagatgagttgacaggcaaatgtagtgaccagcgtgcaacaagaccagcggccgctgtacctgaccctcctcaagcactcggagctctcccaacagacagtgtaacattggttagaagaactggggagcaaattcgaaaattttctcagtggattgagaatgagccaaaagagaaatgggctaagacttatgacacaggtggtgctagatatggtataatgacaacaaatttggcggaagtttacaactgggtgatgcgcggtgtccgtggactcccactagttggtatagtggagttcattttacatgggacatgcaagtatttcagggagcggttccaagcagtttttccctctatgccgaacaacaacattttatttggaactttcatggagaaaaaactagcggagtggcgtgcaaaggccatgaaacatccgagctctagtgcaaggtacccaacaacacaggtttgaggtactctgccaagacaaggcaggcaggggtatctaccgcaagagagtaaagcaggagtgcgttctcaaagacgacggcacatgtcactgctcctgtagaaagccgacgctgctccacaggccatgcacccatgtcatttccgcggcatctgagtgtggcatccaagatgcagtatatgtgtcacaatacttctccaagcaagcaatatatcacacatggagtggcgagatttttggcttcggtgtagctggggagttcacaaagattaacgatctgataatctatattcctgacccaacgaaactccgagacaaggcgggacggaggaagactcggcgcatccgcaacgatatggatgagtcggaggcaggcagggtgaagcggtgcagcaaatgcgatgaacgtggccacacctacaagtattgtcctaaagacaaggaaaaaccaagtgcggcggaggcaggtctatcaggatcagcagcagatggagctcgccctacgggtgaaggcactacttcaaggcgaccccgtcctagacgttctcgtggaacgaccggttacgtggtgtagttcgtgtgttgtatgttggcaaaaggctttgcttgtaatttcgttcgaacttatcgatatgttcgcattgtgttgtgttgcgaaccacttgttagacttccgcatgtaatgtctttatgttttacggcttgtaattttgttttatgttatttcattctcggtacgtgcctttgtgtaacgaaagttatgttctcaataatctgcactcttgcatgtctctataagtattcttccgtttcagataacttgtttttacaattatattattaccttcttatttaccctaacatgtaacacgttacttgcagagatggcacatcctgagttgttggatccggcgatagatcagcgccaccggtcgtaccttactggggtggagggggctcagcttgggacgttccgtccacggtcgtcacgtgagcgacttttggttcacgactccttcgtcgagaggtatggttttactgtgttcacgacaccgggcttaccttacta

SEQ ID NO: 75384 - DNA, 8146 bp, Oryza sativa
cgcacccgtgcagcgcctaccaggtctaccgctcgagccgttgcagcagtaccgcaacaccgggcctaccaagaggtggctgcttcagttcactgtaagttctttctacctaaactgacgtgtattatgtacgtaacttgtaaagtgcctaacatttcatccaacacttgcaggttgaccagctaccggaggaggccgacgagtactccttcagccgttgtttggaggcgtacttgttgtggctttttgggtgggtgatgttctgtggtagtcacggacactcggtcgaccggggtctcgtgcactacgccaggagcattgccgacgccgcggtcggtgaggtgcctcagtggagttggggctccgcgttgctggcggctcaataccgtggcctctgcgaggcttgtaccaggacggaccctggcgcgatcttcggtgggtgccctctcttcatttctctttgggcggctgagaggattgcgatcggccgcccccttgtggagcaccacccttacgacgcgtcgctgtacgagaacagaccggcggtcgactacccaacgatgggtactctgtggtgccggcgtcaggtacgtcgctagtatttggtaatgttgtcctactattgttaacttcatcctacgtcacactgaccttattgtattgcagcgccgatgggctcacgtgcaggttaggcggtcgtacgcggaatttgtgatggagttcgaccgccttctgccgacggacgtagtgtgggagccctacagtgccttgcttacccacagtcgggcgccgctaggcctgtccacactctgcacgagggaccaggcgtactggatgactacggttccgatggtgttcgacatctgtgtcgagccgcacgcaccttaccgcgtgatgcggcagttcggcttccgtcagtcctttccagtcccgtttccggcgggcgtcacggctgccgttcaccggtaagccgttttactacgttttaatatgttgcattaacatcgggctgtccataataatttgctttgtttgtcgtttgccctaatacaatacattaatttgcaggtactcgcgcaagggtcagcactcagctggtcactggcctgccaagttggggccttttctcgacgactggttgcttgctaccgaggaggtcgtggaccacgcgggagagccacacacggaggaggggtatgaggcgtacctacgttggtatcagccacgcacccgtactagagtcacctacgctccgacggagcaacaggcccacgccgcgagcgccagagacctctacgccaggcaccgcgaccaggacttcgctcgtgcggtgagtaccttgcatcgcaccatcgtctcatcatcctttctgttggacaaaggctacgaatatttacgttgtaattaaccgtgcaggccgttgagtgcaacagggtcgtcgttgatgctacaacggcgatccaacggttaggcgcggggattgaggtgggggcagacgagcacctgtcgacgtacacgcggatacgggactcgatgcgctcggttctccgtgcgctgacctgtcgtgctgccgacgttgctcacgcagacgcagcaccacaggtgcgtccccgaccgactgctcctcgtccagctgcgcacgttcctacgccgacaccccctcccttcggaggtacgtatattcaaggtctatttgtacatcatcaatcaattgatactcaatttatgtgtaagcttacaagtgtcgcgtcgtcgatgtgtaggcttcgctcagcctgggacgacgccgggcgcccactcctggcaggctgcggggtcatcgtcacaggcaggtgtgtcggcctcgctgtctgcgcagttctggcaggacgccgggacttcgtcacagccgcccggcacgtcttggcagggtcctaccgggacttcgtccgagcacgggtgggcttccgccacgcacttcgacattagtgacttcgacttcccggacattatcggtccctcacagcttggaggcgcaccgccggtgcacacgcaggagcagtcgccctccaccccactcccagaccctcgcgctacccgtgctgtcccaccggatcgcttcacgtactcccaggaccacgtgcgagcacaggcccggaggaccaagcggggtcgcggcgcgagtcacggccagtagagcagacatctctttatttttctttacattcttgtactatatggttgtaaactgaatatgttgttgtttatattcgggactcgcattcctacacttcgctgttacgttttccaaaaacaggagtcctttccagccgttgtgcagagaggaagctgccgcccttgcagagggcggcaagccctcggctccccgcggcccgtgcgcgccgtcaagacgcacacggcgccgtgtgccacgtcggcttgccgcccttgcgaagggcggcagggtctagttttgcaaattttttcggcgctataatatttctgtaaatattaaaaaaaaaaaattaaaacaaaaaaaaactcgatggtgggccgaattgggtcgctatcgatccaaattgtagtgggcctcaaaggacttgggccagtttcgtcgaaatggaccagatcctttgtgtgcatggttggacgctgcaatgtttagcttttatcagaaccacacgatttcaatccaacgatgcggatggaagttcgcgagcaccacttctaggagatggagccaggagggtccatccaatagtcttgtactgaatttgaatttgtcccattttgatttgcacaaatttgaagcgattgaatttcgtcgatcgatcgagaggaggattttacagtggaagggttttccagccgggcttacacacgatgaaagtccacgaaccaaacacaaaacaccttcttgattaattaattacgatgaattcgtttgattaattagctaggaaatggtgcgtccgccgtcgacgccgacgacctggccggtgatgtaggaggccgccggcatgcagaggaacgccaccgtggccgccacctcctccggctccgccagccgccgcatcggcagccggtccatctcgctcttgatcagctccgggtctatcgtctcctgctccatccatccatccaaattaatcaatcaaaatcaatgatgtgattaatcacactaactgtacaattaatcatgcactaattgcatatgagtaactgagctggagatcaattgacgtggtatatactcccctatttaagattttagattataagtagttttgattttggtaaaaatcaaaatgctttaagtttaaccaagtttatagaaaaaaaacagttacatttacatcccaagataaatatattgtaaaaatatatttaattacaaatttaatgaaacttatttggtgttgtaaatatcattatatttgtctacaaacatggttaaatttgaagtaattttgctttgactaaagtcaaaacgattcctagtctgaaacgaatgggagtatttagcttacgtcttggcagatatcagtcttgacgcctcccggcgcgacgcagttgacacgaatgccgtcgccggcccactcggcggcgaggctccgcgtgagctggttcatgccgcccttggtcatggagtacacggccagcgccggcatgccgacgctgccggcgacggaggagatgttcaccacgcagccgcctccgccgccgcgggcgccgccggcggcgagcaggagcgggtgcgcgagctgggagaggtggaagcaggactcgaggttggtggccacgagcacggggaagtcctcgccggagcacgccgccgccgcccggaacatggtccggccgacgttgttgacgaggatgtccagcctgccgccgaactccgccgccgccgcggcgaccagcctctcccggtcgccgcgcgcggagacgtcgcagacggtggcggtgacgcggagcccccgctcctcccaccgccgccggctcgcctccagctccgccgcgttccgggcgcacgtgtgcacgcgcgccccgaatccggcgagctcctccactatcgcatgcctatacggtcgaacacgtatacgtaggtatatacagtcgtattatactcgtatatatacggtgatgtgtatatatatacccgatgcctttgctgccgccggtgacgagcgccgtcgcgccggcgagggtccaccggtaggggatgctgcgagctgcggcggccgccatgatcgatcgagcttggtgttttctctctctatgccggtgtagctgagtgctttgggatgaatggattgtagacgcatatccgtatacatatttatactagtagctcgcacgtatagtagctttaattaactaaagcggtgcacaactggtcgtcgttgaaatttgattacaataaacatatacttgttccttcgttttatattattagtcatttcgatttttcttagtagttttaaaaaaagtaaagcgacactatttttcagaaaaaaaacatattatcaaaatatattcaatgttataaataaaactaattaatttggctaattaacttggtgttataaatgatatcaaatttttgtaaaaacttatttaatctaaataaatttgacttaaaaaatcaaaataatgtatagtataaaaccaaggaatatataagctagtagttgttcatctgatggccggatacgtggggatcatatgcagcacaagaaggcggcgaccggccggccgccggccaacacgatcgccggccggtgcatcccaagcggcgaccggccggcatgccggggtataattaaactggaggagtatatacttgattcaaatatttattatcgcatatatagaaaatataaagtgatatattcgtatacatgcatgcggtgcactaccgtcgtcgtcgttgagctatcatgctcacgtgtcatttcttgtcaactatagctcccatctataatctcatgatctcatctaaaatatatttatatccgtgtagctagcgtatgtatttttctacccatctactccctccgtttaattaggaatgtaaggtgttttgggttttttttcactaagttaaactatttcatatttaaccaagtttatggaaaaacatgacacctataacatcaaactaatttcatctgatatactgttaaatatatttttataattaattcatttgtccgatattaaaaatgttgctatattagttatagatttggtcaaatttaatgaaatttgacttagagaaaaactaaatcaccttacgttacgaaaaaaagataaattcatttgtcttcacttttgccgggtttgttctagctaactagaaaaaaaaaacatgcatgttaaccaatggattggaaatttatgtattgctgattatactgtatgagcccagattgtaccggtgtagatatactcaaaatggttaagaaagaaaagattaaaaaagtttccatggcgataaattatgtcctcaaagtttcagatgcatattaattaatatgacctcttgacacagctgacggacactgctaacgagacgacagagaagcgatgcatgtgccggtacatcggccgagatgcctcccgtaaatcatgatctactcatatgcatgcatattcatatattatcatgaccttacgtatgcatatactagggcaacttgtggagttgtggtacaactacctccggtgacaacgctcggattcagaggtatcatcaactacctggtttttcttggggtaaaaatggttgcatagatagctcagctcgctcgggtgtactgatacttgctgttgtttaagaaccgacacctacgtaagattttaggtgtctgttctaacctagcactaatatatactccctccgtcccctaatgtaatggattttgacattttgtttgcactgtttgactattcgtcttattcaaaaaattttggaattattatttattttatttgtgacttactttattatccaaagtactttaagcataacttttcgttgtttatatttgcacaaattttttaaataaaacgagtggtcaaatagtacaagcaaaatgttaaaatcctttatattaagagacagagggagtatatatatggggctgccagcacattttcggaagtatggtgtatgtgacgtacggtccaacagtataaccatcacctatgatcccttatagcggtgtgctgattttagataaggcactaatgactcgggtcattagttctgcatagttgcctagttggtaaccccacactcatatgatttttttgggcctaacattgatatgtagattctacaagaaaaaaaaatacaagtaccacacctacgattaaatctcataaattaattgtgcgctttaccacctacggagatttattattagaaaaatgttagttacatgctcagctgacagtataacctgggatgagctttaccgcttcctgatattaataaaaaaaatataagtaactgtgataagtctattacttaaaattagatagacagtttgcactcgattactacaaagaccctagcttcctacaaatgtactatgattcggtttgtagaatatatatcacgatagacattaatcatcatgaacatcatgttcgggcttgacaggaccaagagctgaccacgaccaatgcaaaaaaataataatgtattggccaaaatgctaataaattaataattaaacacaggaattctagagtaacaacaaaataatatattggccaaggttctaacaaattaataattaaacgcaggaattctagagtaacatatataaattagagcaacagcaagaacggtactaactaaccacgcgctgttatgacttttttaaaaaatatttagtactgatcactagtggcattaatgcgacaaactagtagctcctaaatgtaacaactgagatatatccacatgaaaatccaaattaatttttatatttctctatgcaggggaaatcgcctattagcttctatcaaagccaatttcaaggtttaaatgcaaattatatcgagtatatcagggtcaagaataagagtcctatcgaattttggtagtgagaaagcttgagcaatgcaaaattttggtttgatgataattataatgctgtgagatggttagatatctatcgatatgttttacccaaattttggtcgaacgaggttttaaagaagtgttcttgctaaacacatatatatccgaggagttcaagctactgcttgctttcgtatgctatatatatacctatcgaatttgataatattatttatttggttttcgggagatgaattatttattacatgcaagagaatattattcattataatactttggttgagtttgtttaatttgtttatgacagtggacattatctctgatctagttagagaaaattaacagaaaaccacttctaaagcaacgaaactagtatttatatatatatatatatatatacaccatgagaagttgacatatatagctataataattgatcgtgccgtgcactgagttaattgcttatgtcaatgcatggtcagaatagaaactaagtttagcaaggaacatgtggaaatatgttagtaactaatcagactatgactcaaaatttgatgtaattaagagaaatacttaacagcaagtttaatagtatatatatagtcaagtactagctcttaaaaattaatacgtaatttacaactaatttaatagcatacccatacaacagctacatatcaatatactataccattgatagatggcatatagtatctcattacacacaaagttttagaacatgtgttgtagttgactacaaatctactctcatctcctctctcctctacctaagcatagatctaatgtactccatccgttccaaatttatggattcaaaatttatcatgaaatagttgttattctagagtagtatttataattaatcaacttcgatccattcaattttctccctattctactccaactacgtaccttcttattcccagccatatatacattatttaataagagacatagtttttcttctcaagcttaatatatagtacaaacaatctagaatagtactccctccgtattttaatgtatgac

SEQ ID NO: 75385 - DNA, 1133 bp, Oryza sativa
agtacatagctcaatattagataacatttttttttccgatgcaggtgtgaccttatggagattcaatactcacccaatctcatgtcgtggccataggcaaccataaccttcgatcgttaagaaaacaaagacggcttgtgtgtggggaagaccctgctacttcacggttgcatgtgaagtggatgcagttcagttgtaaggctagcttaagttattatctatttggttcggtgatcagatcttacaggtgaaaaatgtcaagcacctcttctttccctttctcttgtttgtttggttattgtttctgttggtcaatgtaattccctagtatttttttcactttattattctctaatacttgtatgcttgcatagtcaaagcatgtccgatgtaagattgtttagtttgatgtaatgccagtggacatttctaaaaagatatttttggaaatcacattttcggtagaataacataaataagcaatcgaatggaaataatccagccgattaggaagaacggggccattgtaccacactctgtaggctgtaggcctgtagcctctgttccctaatcccagacaatctcggtcgttgattcccaatctaccggtggagacgccaccactgcacgccgagaaattcaggcgagaagcggaaaagcttatccctctcccatcgccgcggcggcctatccatctctctcccccgcacacgctctccctcccatggcgctctccctcaccaccgccttctcccacctctccctcccctccacctccaagttccacccgctccccctcctccacctccgcttcccctcctcctcctcctcccgccgcgccgcgcgcctcgcgctcgccgcctccgccgccgaggccgccgagcctgtcgaggtggaggaggcgcccgccgaggacggggcggatgaggtggtggccgtggaggacgagctgtccggaccggcgctgcgaaagtacgtgaagcagcggcttcccgggggcttcgcggcgcagcggatcaccgccacgggccgccgcaagacggccatcgcccgcgtcgtgctccaggagggcaccggaagggtgttcatcaacttccgcgatgccaggtgtgtgcccgtgccctgcgcgctta

SEQ ID NO: 75386 - DNA, 5828 bp, Oryza sativa
aacggcgtcatacattaaaatacggagggagcagtaatttttaaagctcgcttacatcatttgatgtattcgctcgaaaatgggaactagcaaaaatatagaatggactgagaatttgctaggctttcccggtcattataaacatcttttaggtcatgcgtgccaatttgatgaatgtatacacaacacatacttgtttactgaaacaatactaatatttttttacagcattctgggaattatttttgatggataataaatgaaatcaacatatctcgatcgtcactgtatgtacacattaaattaattagacaccttttaatcatcatcgtccttggtttgtttacatttgtcctattttatgaaatgtgctgcggtctcaccacaagtctacaactacaatcaccactactggcatttatctgaaaaagcaagacaagaatatataataagaaaataggaagaaaaatcggagttcatggtgtacggatcttctctcttcatcagtttcaggtacggataaattgcatctgaccaaggtgatcacagagagagaaaattaacaaaataataataattaaactaattaagaaggcagagtaaacggttgacttaaattaaaccggtcgttgatttggtatgtcaaagagctactgaatatttgattgcactagctggccaaagcaagaaatatgatagtatgtcggcaagatgaaactgcagttgaacatggacgaacagatttgcttggccgtcctaatctttgggtgcattcatctacccttgcagttaacttgttctaaagaataaatgtacatgtaggcatacatgattagcacacttaattatatatcatagtcttagctaattaatgtatattttccaccattaatcctatctttgacaagcttgagatggacagcaattcttgagaaatgtttggagatatatattgattctttcagaagatactgtggatgcagagacgaaatctttttggtctacggatcatgtatagatgtggcatgccaaccacatggagtggcgattcatccatgtagccaaatttcaagaaaacttgggactcttttaaataagattttgaccaacaaagtcaaatcctgaacacatcctacgtgcaacgaagcggtcaacgagaagatgggcctggactgggccttcagcgtgggctcaaacaaattgctgacacttggcaacaatgggcagtggtgactgtcagttctgtatgttctgcaactgatggaattcagaaaatgacagtattttactcacgaatcaaacacaaataggagtcaaaactaaattataaatgtaattactcttctgttgttggttgttaatctgcttggtgacaatatgcagggtttgtttttttctgcacaagatttggtgatctgcatgttgtgataatatgcagacaagaactgaacagaacaaacaagaagatatgataaaagtgcagtgatccattgcatgctcattaattagtgagtgacatgcttgacattggtatgaaagcgagtacgcatcactaaaattcactaattcctcaagcctcagggcgtactaatgtgttttcatggctgtatgctctcaaaaaaaagttttgctgatgtctaaaattactgcccatgtcaaagttgtttgtttgtttgttcacttcagattgacagagtggaagcagttgtagtaaaaaggaaaaaccatccctgacatgaaggttgaagcaaagtgtaagaacatttaaggcttagttatttttagattactagcaatgtacccgtgggttgcaacaggaaatataattcatttacaatatagaacgagctcctctaccggcgaatcgatggaccgcctttatgagtttggccctgggagtacgagtgcaaaatctagtactccttccattccatttcaggtgcagccatgattttccgtattcaactttaatagtccgtcttacttgaattttttttgaaaaaaattaaaaaaatattatccatatttttatctaataactatacaaatattaatcataaaaaaattcaaataagacagacgatcaaagttagacacggaaactcatggctacatttaaaatgggacggatttgattgcactagctggccaagcaagaaatatgatacagtatgtatgcaggattaaattgcagttgaacatggaagcacagatttgctaggccgtcctactctttgggtgtatcgatccatccttgcgttaacttcttcagaagaattaattaatgtgtatatatatatttatacatgattagcgcactcaattaatatgatagccctaactaatctatatttgcagtattaatcccatcattgacaacctagggtgtgtttgaggagaaggggattggggagatcggggagattgggaagatacgtaaaacgaggtgagccattagcacatgattaattgagtattaactattttaaacttcaaaaatggattaatatgattttttaaagcaactttcctatagaaatttttctgtaaaaaacgcaccgtttagcagtttgggaagtgtgcgcgtggaaaacgagatatttttctctctcaatcccccagattgcccaggaacgaacgaagccctagagatggatgaatcggagtgcaattcttgagatgtataaactatatatatagctcttatatattctttcagaagatactattgttgcagatacgtaatctttttggtctacggatcatacacatatgtatatgatacttggaacatggacattaatccaaatacataagctaaactcttacgtatgtatctgcatcaatagtatcatatggatcatacttcaaagtatcatacggatcatattaatttcaaagaagcttaggatattacgtacgtataattgatccaaatacgcacgccaaatacggatcatgtacagatgtgggctagtaagcaccacgcaggcccaaacaaagtcgtgacgatgggccgatcgaatcaatctgggccgcaaaggccacatcgaacggcgctcagaggcccaagggggttcggcgttgaaaactccgaacgccttcagttgtatgttctgcaaactgatggaattcagcagagtatcgagaaaaagtgatagtattacaattaaacaaaacgaatggtaagaaaagtagtaagtagtcttgtgttgtttggttgttaattagtctgtttggtgacaatatgcaagtatgcaacggtggtttcagtactaagatttgctgatctgcatgttttgatatgcagacaaagtactgaactgaaccacacaggaaacatatgagcaaaaaatgcagagctccagtgcatgagcgcatcagtgacagtgaatgactgaagtaggggggtgaaatcggtctacttcagcaacaacaggaggcccaatagaagtcgctgacacttgcaacaatgggccgatagaatgaaccggaggcccaagggggagtcggggtttaaaggaataagttcatatgaggtcccttaactttacaccgagttcgattttcgtccgtgaatcacaataccagatacaatagatccctcaactgtcaaaaccggtgtagatgaggtccctcagcggtttagatggcggctttgactgatgtggcgctgacgtggctagtttgacttagtcctcatcgtatgtggcggtgacgtggcacttggaagcaaaataaaaggtcggacccacgtgtcagtcattaaaaatagtgggacccaccctgctctctatctcccctgcgccgtcgtccttgtcccttctccctcccggccattcttcatccttcctcgagctccctagccggccggcgagcgcgcgcggagagggagaagggcgccagccatcgggtggggaggccggcgagcgtgcgtagagagggagtaggcggggaggccaacgagcggaacgggtaggccggcgagcgcgcggcggcaggcgagagagcggcggccggagctgcacgacctcgccccccctcctccggcgccgccgcatcgatctgcacgagttacggcgacggcgagctcacagccgcgggacacggtcagcgtggcgctgacgaggcccggaactcgagctcgcagtcgcagccgccgctgcccacttccccaatcccctccatatgcgtcaaagtttttgatattcatggcgttctgctcttgttctggtggattgattgattggtgtgcttgtgcggatgatttgtgcgaaggcgacgcgaagaacgcccacttgatgtctctggacgtcgccgcggagaggctgcggctgttcaaggccgacctgctcgactacggtagcgtggcggcggacatcgccggctgcgatgacgtcttccatgtggcctgccccgtgctcctctccgcccctaacccaggggcacacatatctcttttttcagcaaaataattccttttcttctccattgactggttcaaactgtagactgcagttactgaaaatcgacaaaaatcaacagtttctactaaaaatgatttgtcgaaactgttgatttctcaacaaccagtagtagctgaagtctgcagagttgtaattaaatcgtcatgttcttgtagctaaatgaattgatgttgctgtaggttcatacacttgctgctgctgtaacgggcacgacgaatgtgcggaaggcttgttcagaagaaaggttgggacttgggaggtttgtggtggtgtcatatgtctctgctgcaatggtaaatcccaactggcctgaaggcaaggctatagatgaagattgcaactcgtgcagatcgatgcggcggcgcagcaggagtcttcgtcggcagcggggccgaggtcgtgcagctccggccgccgctccttcctctcccgtcgtgcgcacgccggcctaccctccccgcccgatggctggcgccctccgcacttctccctaccggcgcccttctccctctccgcgcgctcgccggccagcaaggcagctcgaggaaggatgaagaatggctgggagggagaagggaaaggacgacggcacggtggagatagagagcagggtgggacccactgacatgtgggtccactattttttagactgacacatgggacccaccttttattttgcttccaaataccacgtcaccgccacataggaccaggattaagtcaaactagccacgtcagcgccacattagttaaaaccgccatctaaaccgctgagggacctcatctacaccggttttgatagttgagagacccattgcatctggtattgtgattcagggacaaatatcgaactcagtgtaaagttaagggaccttagatgaacttattccgggtttaaaactccaaacccctttgctggtagcaagcgcgccaccacggccgtacgtccccatgcctagcgccggccgacagcgcggcggcgcgccggcgatggatacatcagtggcacggcggtgcgtggcggcgattgtgctggcgtcggtggtgactggtgagcagtggatggaatggaaggcatggacatgttgtttatgaatttctggactgaagcatccagaacgcagtgtttacacccaaatttggcacttaggattaaaataggaaatattgctaaaatttggaagtctaccggtttcctccgaggtaggccggtctgaccgccgtgtgttgggcggtcagaccgccggttgagggccggtcagaccggcggtgtgtggccggtctgaccggcaggtccgtgtgctatcctgtttcgttggatttcgaggtttccttgctggg

SEQ ID NO: 75387 - DNA, 1071 bp, Oryza sativa
aatattcatggtatacttatggttacagatatgatccgcaagcgcacggatataccatttttttaatccaaagtgaagatatgataagagagtactatgctaataatttatatattacttgcgtacatcaaggtcgatgtaggggttaagtaattcaaaggttaggtgacacacagaagaaagaactatgatactctcactaaatataatccaagctaagtggaggaagaataagaaaataattcattcctatacttctaatatgcaaacatctttagtctacacttgttagtatacagtcatgcaaccaataccccctaacagtgccctcctggtgtttcgagagaccaccccgggttgccgagttccttacgacaatctgtaatggctgtccaaccggggctaaatacggaaaagtaccctccccaggaatttgtcttaggaatatatactatcatggaggaatacctgtactgagctgtcaccattagcgacccacctcgactgacccgtagcatatatgctcagatagggatacttaataatctagataccacgtctacattattaaatactactctatatcccccgagatgacatagagcaaccgagcaatcggacactaaacccacaccattgcacctctctgatagactagctacacaactatattgatacaagtataaaatgaagtcggtactcagataatataaatggaataaaataccgaagatgtataaagaaaaatattctattaattcaataagtcttacaaaagaagagaggaaagctactagagccatacccgaattctcctgaagacccgaggactaagaatactattctaattcctactccactagcactagtatactactaaacttgagagagggagagagctcttcttcttgagtgtgtggagagagtgaggatgtgaggtccttatatacggcagttatgacggttataagtatgcgaaatgtccattctgccccgcaactgccatcaggacatcatctagagcgtccaagccaaaacctggaatcaacggcagagatgggggtgccgaac

SEQ ID NO: 75388 - DNA, 14222 bp, Oryza sativa
  unsure (1)..(14222): unsure at all n locations
agttttctcttagtttgtccatctttgtctgtttgcgccgtaaaccgtccgccgccgctgcgagagtgcgacatctctttgtaggtttgtcctgaaaaccttccgttttgcccacgagacgggtagctatctagaaatcggttccactagccgatttagttatcaaattccatctaggtttagctctttgctagatcgaggtggttggcgactctaggattaccgcaaagcttaagatgctgtgatcgtgcttgtcaacttgttaaaaaagttgccaacacgcagcacttgagttttaggccgccagacctggggaaatgatgcccaggagcaggagaaaggaagcctcgaaacaggagctcatcgaagcagcgctcaccggcctcttccatgctagtatcatcttcatctagcccatcatgttggtccttggacactaggccttcgacgagccatcgcctgaccaagcatgtcctgctgacgctttcttcctctnnnnnnnnnnnnnnnnnnnncaggcagctcttgtagtgcacggacagcttgctgtagcagaaaagcatcactttcttggccacatccgctcattgtggagattatgggtatcccatatctacacggcgatggtattcgaactgggtacaggatacctaatgtagatagaatatcttgtctgtatcttgggtttgtttcttaacttgtgtatcaaggaaacaccctgagacttagtcggttacgactgtattttacctttatcttcatattccgttaggaatatggattatcttttgtaacccggactccttcccatatataaggggggtccgggcgcctctaggggcatatgctgatttttcccgaatcacacaatcaataatacactcggcggattcatccccggacaggagtagggtattacttcttttataagaatgcctgaacctgtataaatcctttgtctccaaacccatacacttttctaacttgatagccaccccctttcattattgccgaaatctagtttcgacagttggcgcgccaggtaggggtagcgtcaagcttttcgccgatcagtgcaatgggtcctttctccggcatcgacgacctcgtcttcccgcccgggcagacgtttcggttcggcagcctcgacttcatcaccgacaacttcggcaagatttctctcctcgactcggaatcaaaccagtcgggagagaaccggatttcggtcccgtttggattcccgaacgcggctgaaagctacttcaagaccatctcaaccgagtcggcttcaaaccactcggccgagattgcatcttctccaatgacaccagatcaagatgatggggcttacccaccggtcctgatgaagctccccgacgatttagcggccgtctccaccacgacagcgtcttcatcccgcaggcctaggcggaagtcggcttcaacaccgatttcgcctagcttcagggaagtcggcgttatcctccaaccactcggcacggtttcgacggatcagctagatgaccactacagccctcccaccgtcgactcgcgccccaccgacatcgtggagtacgacgaatttagttctcgctacaacgacttccacgacttcgacgacttcgacggaagcctagatgacgactacacccctctctactttggcgttttcatggccaataatgagacggaggagcaacgccaagcccgggagaccgaagagcgtcgccgactggaggaggagcaccaagcacaagaacaagaacggctacggcgtgagcagcaggaccgtgagcggatcgcgaaggaggctgaggaccgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgatcgcggcttcggtcccagttaactccgaaagcgtccacacgccgactggcagccgagtcccccacttccgatctcatgattaccgtcatccaagcctcagcatcaccggcgcaggatccaaccgcaggagcaggggccacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccctgaatcgtggcttaccgtctacggtctcgcaatccgcgcagcaggaggtgacaacaaggccatggcgaactatttaccagtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctctgacatcaccgacgacgtcatcatcgccgcgttcaccaaagggattcgtcacgaagaactagtcggcaagtttgggcgtaaacctcccagaacagtcaagctcatgtttgaaaaagccaacgagtacgccaaagccgaagacgccgtcaccgcatcgaagcaatcgggtcccagttggaaaccgaaaaatacgccggccacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggatgacggcgacaccccggctggttttcaagatcaccgcaaggagctcaaccatatctttggcggccccctagcttatgaatctaaacggaagcagaagttaactgaacgggagatcaacgctgttcagcccgacacgccccagtatcttcgatggtcagagattgcaatcaagtttgaccgctcggatcatcccgaccgagtggtccacccggggcggtaccccctggtactagacccagtggtccgtaacgtcaagcttcgcagaaccctcattgatggcggcagtgcactcaatatcctcttcgccaagactttggatgatatgcagatccctcgctccgagttaaaatcaagcaatgcgccttttcatggagtaattccaggattatccgcaactccactcggccagatcactcttccggtcacttttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctgaccctacggagcgacatcaagcaagctgtcacatgcgacaaggagagttgcgacatggcccaaacccgcgagatagcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagttgttagcagcaggcttcatcaaagaagtccttcatcccgactggctggcaaacccggttctagttcggaagaaaacagggcaatggcgcatgtgtgttgattacactgacctcaacaagtcctgccctaaagatccttttgggttgcctcgcattgaccaggtagttgactcaaccgccggctgcgagcttcttagttttctggattgctactcggggtatcatcagatccgactgaaggaatccgaatccgactgcttgaagacttcattcatcacgccttttggggcatactgctacgtcaccatgccgtttggattaaaaaacgcaggagcaacctatcagcgcatgatccagagatgcttttcaacacagatcggccgcaacgttgaagcctatgtggatgacgtagtcgtcaagaccaagcaaaaggatgatctgatcttggatctagaagaaaccttcgcgagcatccgcgccttcaggatgaaattaaaccctgaaaagtgcaccttcggagtaccgtcagggaagctgcttggttttatggtgtctcataggggcgtccaagccaacccggagaaagttaccgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatctcaaacaactcctcaccaagccgccggtcttagcttcaccacacccgcaggagccgttgttgctgtatgtatcagccacctcccaggtcgtgagcacagtcttggttgtcgaacgtgaggaagaaggccatgtccagaaagttcagcgaccaatctacttcgtcagcgaggtcctggccgactccaaagcgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcgggcactggagccggagtggttttaatttccccgactggagaaagactaagttatgtgctttggatacatttttcggcgtctcataacgtcgccgagtatgaggcgctccttcatgggctacggattgcaatttccctagggataaagcgtctaattgttcgtggtgattcacagctggttgtcaaccaagttatgaaagagtggtcctgcattgacgacaatatgatggcatatcgacaagaggtgcgcaaattggaagacaagttcgatggactcgagctcagtcacgttcttcgacacaacaatgaagccgccgacagacttgccaattttggatccaagcgcgagacggcgccctcagatgttttcgtcgaacacctttatacaccgaccgtacctcataaagataccactcaagatgcagacactcgtgacatagctatggttgaagccgactggcgagagcccttcatacgatttttaacttctcaagagctccctcaagacaaagatgaagccgagcggatttcaaggcggagcaaactttacgttttgcacgaatctgagttatacaagaaaagcccttcaggaattctgcaacgctgcgtttctttagaggaagggagacaattgctgaaagacatacattctgggatatgcggaaaccatgcggctgcgcgcaccattgtcggcaaagcttaccgccagggttttttctggcctactgcagtgtccgacgccgacaaaattgtgcgcacatgtgaaggttgccaattttttgccagacaaattcacttaccagctcaagagttgcaaactatcccgctgtcttggccgtttgcggtttgggggctcgacatggttggcccgtttaaaaaggcagtcggcggttacacgcatctctttgtggcctttgataaattttccaagtggattgaagctaaaccggttgtcacaatcacagcagataatgctcgcgacttcttcatccacattgtgcatagatttggagtgcccaatcggataatcactgataatggcacacaattcactggcggagtttttaaagacttttgtgaggactttggaatcaagatttgctatgcctccgtggcacaccccatgagcaatggacaggtggagcgagccaatggcatgatacttcaagggattaaagcacgtgtttttgaccggttaaaaccctatgccggcaaatgggtgcaacagttgccatcagtactttggtctttgcgaactacacccagtcgagccacaggccagtcaccttttttccttgtctatggggcagaagcaatgttgccgagtgaagttgaattcgaatctttgcgcttccgtaatttccgtgaagaacgctatgaagatgaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccgtttattatctctgaagttacccggccaggttcatatcgactcaagcgcgaagacggcactctcgtcgacaactcttggaacattgaacatcttcgtcgtttctacgcttaactttatcattgtatttccctattttgactgtcaaacatcaagttttcttcttgccgttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaaacttagcaaaaacttttaagaaatcaaaaactttgcaagaatcatcaagcacagcataaatacaccagtattgtacaaattgagcctccatatattacatttacactcagtcagaatcagtcctttcatcatcagagtcatcattactcggctggaggtcgttgttgcgaaattgctctacaacatcactcgcaattttgtcagccgcagtttgcgcactgctgataagatcaagggcggcttcttcacttgtcccgtctgcaaatccatcaatggtgtcgatttcaattctcgggtacaaggattttgtcatcgccaaggccatgccagctcccatacttccagctttcttgatgttcttgaaatatacttccggagcaacactcagcttatcaaatatttcggttgcgtcgagtgcactcggaccaccattattgaggaacatggcttggataattggtgcagcggcattggcgacgttatccctcgctccttcaagcctcttgatcttaccaaccaggacgtcaaactgagcttgagatttgatcttgcgatctacaaaacacatttatgatgagaatctgttgcattataaggagagaagctcaggttgtcagctggcgttaccttcgacttcctttaaggctgagtccctttgcgcagccagttctgtcttgtctctctccagggcttcaatttgcttcgccatctgttccatcctggcggcttgcgctgtttgaaattcagatggttaaggatacagttatgccagtttaaaccgatgaaacggatctagggattaccttttgacgaaccactcagctcatagtttgaatcctggagctgggcgattcggtcccttaactctttctctgtctttttggcgcactccttggcctcatgcagctggtccctaactgcttctagagttcccaaatgaggaaccagcttttccagagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatacgagggatttcttctccgtcatcacctgatggtcctgatgtgtttccaagacattagaccgataaactgaggttatttaaatcgccattgtttgagaagacaactaacctgaagatgtacctagctgagcgtgaggtgatctttgttctttacctgaagacccagctatcgagtcgttaccagcctctggtccttgtgaagtcgtcgtctgcgcttctacctcggggatctcttgatcagggcctgcgtccgactggtttccagtcgggggctcttgagttgttgccgtttcagttgttgccgactggtttccagtcggcggcaggtcactcggattggccctatctcccgaagcatgggcgccagtcggctggctttcagcagtcggctggttttcagtagttggctcggggtccttggatatattttgctctgtcatagccggatcagggtcttttccagatggatctatatcagatggtttcctgcagagtgttctttcagtattcagcatcattttcatgagcagaacatgccgaagcggaatcataccgagaggtttaatacctggaagatgttctgatctttggcattgcacggccagccagttttttcctgggcatggtacgctttgggggtttactaggcgagcccttatccccagatttatcatcgtcgccttcatcatcatcaagtaccagctttctcttgcgaggacctgtttgaccagtcaatttggaggactgaggttgcggatcttgtctgatcgttggccctccgcctccctgagcggtgtgttggcgaggagaccggcgctgagaaactggtggatctgacttcatcaatgcatattcctgaataagatgcttccatagttagtcaactcagcatgaagatacgactatgttctgatcacggtttgaaggtttcagatacatacctgcggaggcggattgaatgcgttgtatggcacaactggcagttggtgagagtagctgactacaattgcatttgagaagattttgtgcatcctctccttcatgattttgaaatccagggagtctggttcttcacggttgggatcatgtttgccgtcgaactcgaatgccgtgcgggatctttccttgagtggcgccagtcggcatttgatgaagtgccgagtgatttgctctccctgtaagccttgttgtttaagatttaacatacgatccaacaactccaaggcttgtgctgcttcatctccgattggaagagagttccaagtatcttggtacactggagggagacaagtgtacccgggaagagcaggctcgggattctgggcatagaaccagtttgcatgccatcctttgttcgaagttttgaagggcatcgagaaatatttttggctcagagtaccccttagttggaatcctgcccccccgactacacacggtttgttcttgtttggttggggcttgaggaagaagatccggcggaatagggcaaagtgaggtttgatccccaaaaaggcttcacatacatggacgaaattggcgatatgcactatggaattcgggtttaggtgatgcaagctgattccatagaaattcaagatcccacggaaaaattttgaggtcggaagagcaaagccgccgtagaagaaatgcgagaagactacgatctcatgtgtatcaggggtcgggaaagcctcaccgcatgctggccgccacccgatgatctccttggctgggagaacgccgtgcgccaccatctccttcaggttttcctccgtcacgtcggacggcgccaattggctttcgaagctttctctctcttccgccatcgatttttctcaaatgtgctgatttgattcgagggatggcttggaagaggtgaggaattgaggcggtggatcacgggaaggattttgatgcacttttcggaggtggatttggccggagttgtgaaccctagttcgccggcgcagcttttcactgtagcaaggagtggggaaaatggcgagagttccggcggggaagacgaagcgtcgcttggatatcggatttttcagttaagggtatcggaggtgctaatgggcctaggcctgaacagtatttcagcccaatacttttaacagtgtggcccattgtgttccttagggacttaggcatattttgctttggcaatattatgcgcacaacagtgttgcccaatgctgatcaaatcctttttatgcggtcatataattctttggaattattgcaatgcgaattaaaaaggtgcccgacagaaaggcgttatgctgtttttgcaagcttttttaggctaacaaaagctgtttgggttaactaggaatgacttgtttttattatagtcacttccttggtatgttatatacctattttcattatggtaaatagtcaaggcctaggctattcgacttatttattaccataatcttcataatacttgatgggtaatctttagagtttttattcggatacctgtcaagtatgttcattcgtgaaccttttagagtgtaaaccactcggatttcttttattgtggctaaaaagcagtcggctagcatgcctatttaggcgccgcgtacgcttttgtcatgtaatgcacaattgtgttattatattgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttgtctgtatcttgggtttgtttcttaacttgtgtatcaaggaaacaccctgagacttagtcggttacgactgtattttacctttatcttcatattccgttaggaatatggattatcttttgtaacccggactccttcccatatataaggggggtccgggcgcctctaggggcatatgctgatttttcccgaatcacacaatcaataatacactcggcggattcatccccggacaggagtagggtattacttcttttataagaaggcctgaacctgtataaatcctttgtctccaaacccatacacttttctagcttgatagccaccccctttcattattgccgaaatctagtttcgacactcattctctaagattattggacaagttctccagttctttggtcccatagggatgggcgtacagagaacgaagcagcatcttgatgatgtgagggtcatccagattccagcatcgtctttgatctctttctcactcactctcaatagctacttaatcactgcagtgctacctgtgaataatatattgtatgtgtatttggaaatgagctgaattcagcgaaattttggatgacaactagagttgatcgatgcaatatttatagagaacttttacggtacaatgtactaccagtatatactggcaatatataaaaagatatatttggaatttaatagaaaattagaaaaggcgtttcaatttatttctggatctcgtcgtgcggtggggaagagcattgatttgacaacaacgctcatgcggcggcgtgatctaacgagtagcgaggagaggttggaccgttggacccaggcgactgggctcaggaggttgatgttcacggcggtccggctcaccgtgcgctcgtccttctgccgagcctcacggcccatagctagacacggcggcgagctgattcagtgtagattcagttgcagagattataaaatatatacgactcaatagcagcggttgttttttcacacggtgtgttgttttgatttctttactgtgacccgactgattaaaaaaagacaagtttgccctttttaagtttatactgcagtatcattacgtagggagataaatcaatctacactgttagattgtttatactacaagtatatactggtagtatattgtaccgtaaaagttctctatgatctcccgaggtagagtccattgatcagcaaggctagctagcagctagtatatgggtagcgtgcaagctagctatatgctgaacaaaatgctaactaaagttcctacgtagatgaacaagctagcaatacgaaccgggaccaatgttagctagcaaaggaaaacgatgtaccaaagcgtaggcagggaggtcatcgagtcgaatattttccttttctttttccaaaggaacagtggatcgaataatctcaccagctgagcaagcaaccttgatctcatctacggccacgatcaacgtagtcactcactatatacgatttccggtgcgattaccgcagcagcatgcccaaagattctgatcaccagcaaagccaattcctgaaaggcttatcatatatacatatgtatctatatatatctcaatgctaattaggtatttttagtagctcctatggtaattagaaaaaactaactattaattaaatagatcgtattataagtagaccgtaaaataattaatacttaattaatcatacaccttatcttattttacgtatcttctcgatcttcgtctttttcagtaggtcaccgttgaagcccacgacctagatccagggcgatgccggccgtagtggcgatgggcgagaggcgacgacgatgaggcactggtggagaaccaatttttactcccggttggtaaccccctttagtcccggtttttcaaccgggagtagcaatccgggactaaagatggacatatttagtcccggttgaaataaccaggactaacgatcatctttagtcccagttggtaacaccaatcgagacaaaccggatggtcccctttgatttttttttctctttttattttctcccgaatcaagtggcatgcaaatccccaaatcaaaccccgaatcaagtggcatgcaaatccccaaatcaaaccccaaatccctaaatcaaagtaacatcccaaattcacatcaccaaatccacatcacaaatcttaaagttatttatacacataaatcaaatacatcacagattctaaaacaaatcaaatacatcacagatcaatacaataaatcacaaatttatacatatcagtgaatcacaaattaagaaaaaacaaacaaagccgctgccgccactcgccacggccgccgcctgcggccccgctccgcccgccgccggcccaacggatgggaaggggaggagggggaggaggaggaaggggaggaggtggaggagaggggatgaggaagagagggtagatctgatctgtaggaatggaggaggagaagggggagaggttcgatctgtgagttgcgattgtggaggagaggataagtgatagggattatatactacacgtacaattttagttctggttggtttcaattttagtcccagttggtaataccacccaggactaaagtgatgtctccaaccgagactaaagatcctcggcctcaaatattcatctgacaggggattaaccgggactaaagatcat

SEQ ID NO: 75389 - DNA, 5548 bp, Oryza sativa
taccaaatgttatcaatttatattacagcaaggacatatttctagctactgacctttactagtgctgttccaagataaacaacagccgcttttacacaagtgccaattgtgtcatactctgacctgcagaaaatgactgggcataagaaagcgaagaacaaaaatcctttgatatacaacattatttttatctatagattgatagacatctaactagtaaccactacccactaataagattcttaaaaacaaagccctccattcatcaatgatcgtctgcaaccctccatcaaaagtaaaaggccaagatctatgtgaccatccaaaaactctctgtcattagaacatacacagcagctctgtttccaactcttatcttcacaaacctccgccacttattatccattatgccagaagtacactgttaccacttatcaccaatacattttgaaacaaccacaacattgatcaaatagggatatgttaatgagacatcgagcttgctctgattagcataagaaaatttacatgctctgggggaacagggaatttaagatcaacatgggagcatggagtaggttgggtccaagggggaactccaacatgtacagcatggctttcaagagggacatgggacagaaatccaaatacccaatatttgcaagtctgaaaatgattgatattttattcaatggttcttatttctagtgtttgcacacgatagtatgcaacaccttattactagagtacatgtaaccaacgtttgatcaacaacaaccacaggaagagagttggaagttgacaggggccatgttgcacatgtatggcatctgcatcgccatcttcatcatctgctgctgcccgagtccagcacaaataacttgttgcatgctctgcatcatctggcaactggtgccacagtggcactgaggcatcatgccttgtagctgcatgcaacattgctgctgcaggagcgccattggctgcgacatgaacatggctgtggagctacccatgcccaacgtttgcatcatgtactgcctacacggatccatggtgcccatggctaatgttggtgggaaatactgcatagtggtgattgcagtagtggcacttgcagaaagagcaattaaggcaaacagggcaaagatcttgctggtgtatgctgccattgctgattctacaatactagtgttaaacaagattccagatggtgtagacaatattgttgaggatgatggaataatggttgcctaggggcctatttatacatgctggtagctgtgtaagccaggaaagagtttggcctttgcaaaaccacctagtggaggccacataagctggaaatcatgaggcatggaatttatttggacatttattcaaccaatacttttggaatatctacacaaagataattctgccagtgctttaatgcgtggaaagaaaatatgatgataaggttgtgccagattgctttggcattttgcagttttgtaaattatgagctggacaaagaaacttttgtgaacagaattcgtatgggacttgtagaatgtgttacacaagtcacagcttacacagataacaattaagagtttgagtcatcgccatatgtgaatgattgagtaggtaaacttggagctttgtaaatgtgccttaatagcatacatacatatgcagtttggcatgtatttggagttttgttaataagaattggaagtaaagaacattgttgtaaagggaaagaagtaaaggagaaacaaattttgggtccatcccaaaaaataaagcaaagattagagtttggccatactctttgctatcctactttccacatatctagttctttatcttacaaataaagagaaacgaggaagtaaacatatttcatgtaatcatattatgacaagacacatttcttaggcaggcactactgacaccatgcaagtatgaagttgcattattttcaattttaactgatattataattatccagtgcagcgatcactgcagggtgaattgggatggagaactatgcaatgtccatgttcagaatcttcatgtttttagtactagagtagtagagatgtaccaaacgtgatgtatagatctcaaaatttccatcctggattgaagaaagattcgaccccattccgaagccatacaacaactcacaaattgcaattgagttcaatgtggtctgccggtctagatgactagattgtgataaatctagggttaaggcttcatagaagatagaactgattcatatgctcatgtgtatgagtattgttcatcgcttgagtagataagttcaaggacaaatgattttcactgaacttggatggagaaaactgttgcacaaggtaagatcaatatattgctgaaatagaaaatatctatctgacatgctgccaggtaccaatgtgctatgaataaaccatcctagctacttatcttgctaacatattatatcacgaataccttcaatgtgatctcccctcagctagaatgaagttttctttcactgtcacgaagttactctactaatgagatgtatatggttggcaatttggcatgcattttccagtttcacaacaacatgttcatcataatatcaagtggcattagttagatcactttatatttgctgcatttgcctcataaaaattgtattcccagatcgtgatcccgtctagctctgaaaacgagctaaccgctcatctgaacttacttgatactcggaggtagacataaaccaatcagattcaattcgagcaacctagttcagaaaacagagcatccaaaccagaacgagcaacgcgatttcatgttctccaacaaacggtcacacgcggaaccaatctcgtgccaatccaaccgagttgagcaaaatccactgaaattgcactgactaaaccccatctcacaagccaaaaacacacagagaaccggcagcatcagggattcaagcacctccttccgctgacgacgcgacgaatctctgtccagaccgttcactacaagcagatctagcacgttcgtgatacggatctcgcggcgcaaggggagatggaggggggggggggagagggagtatacagcggggtggccgagtagtagacgacgtgggggccgaaggtgagggcggcgcagttgaggaagtggaacaccgtcatctcgtccccgccgccgccgccgccgtcgtcgtcgtctccggcgtctgagcaagcaacggcgaggtcggatcgcccgaggtgcgcgacgacttgggctggactgcttgagtgatcgagtcgcaccccatcgaggctaagtaaaagtatctcgggccacgtggatcagttaatgggcttcgcataatcactcatgggcttggagcgggaggatgatggcccataaaacaacatcccgcaagtcggtgacagtacaccatcccggcccaactaacaggccactgttagtcggttaggcttaggcagcaacgttgtttgatccagtgatgggtcacactcccacgtgggaatacaagtgtaaatattgaacataaatcgaaactttatttcatgattcttattctagccagtcgcacacgatagtatgcaacaatttactgttggagtacatgtaaccaaggtttggttaacaacaaccatagggagagagctggaagtaggcaggggccatgctacacatgtttggaagttgcatcgccatcttcatcatcatttgttgttggccaagtccaccacaaatagcatattgcatgttctgtatcatctggcaactagtaccatacccacactggcactgtggcatcatgccttgtagctgcatgcaacactattgttgcaggagagcaattggttgtggcatgaacattgttgcgtagctatctgtgcccgtcgtttgcatcatgtactgcctacacggatccatattgcccattgctattgttggttggagatatggcatggtggtgattgtagtagcggcgcttgcagaaagagcaagtaacgcaaagagggccaagatcttgtatgctgccattgttggcactacagtgctactatgatattgttgagggtgatggtatcgtggttgctgaggaacactatttatacatactaaaagtcgtgcgaggtaagtaatattttggcctttgcaaaaactacctaatggaggctagataagctataaatcatgaggcatgacatttatttggacaattgttcaactaatattttggaagaatacatggtagatactaagatgacgttgtagatatattcaaaaggctatcttttgccaatgctttaagaaatacgtggaaagaagttatgatgataaggctataccataaaagtttggcacttcataaaacttaatttgtagtatagttatttatcgaggtggatcaagaaacttttttcaacagaatttgtttgtgtcttacaaacatgttaatcaacaattcacatataaagtaccttttcaaagctttgtaaataggctttaataatagtatacagacatatgtagctaccatatatgtttggaattttgctaccatgtatttggagtgttgctaaagaaacatgagtgagtgaggttttttgaagggaaaagggataagctacttctgtgactacttgtttttatctttactcattacttgtgtatgtttattcctttatttttaaaaacagaaaagaaatttgagaaactcaaagtatttgtttattcaaattatgaaattaaattttatttaattattccagacactacaggaaatatggagtctttaaactgaaaatataactatatttttaactagtaagtaaagtcgtgtagggatgaccaattcttcttttggatcatcacatgtcaaattggaatggtggggtggtgaaatttagaatgcctgtcactcttgatgtgattagtaatggagacaccaaaaatgatgtctagattgcaaacatttcatcttagataggataaacatgttttgttcaattacaatctcattatggaagtgatacgacagctcacaaaattgcatgagttcaacgtgttctagacctctagattcttatatataaaggtggggttaatgtttcaaagaattatttcacatggtccttgtgtattgtgattgcttgagtagataaggttcaaggacgagtgagttttgactaaattaacatgataactagatgagcaggggcaaaaccacgttggccttctctgataagcatgacccaagttgctaagcttgttcaccattacatattacctctaaacaccaatttatgcttattatacatgtaatattatgtatatgggacaccggtaattttgttatagactcgtcactgtagatgggataaattgttgcactaattaagctactatttattagctagtattgtgtgtttcactagcatcaagttcatcatgatatttaagtggtcataacttaaataatttgagcatttatataagatgcgacatgattttcgagaaggacaagggctgcaggaat

SEQ ID NO: 75390 - DNA, 1676 bp, Oryza sativa
caatcaaccaaacagctgcatgtgtatctcctcaaccaggctatactcagcctggataagagagatggaccaggctagagggatgcgagcaaccaaacacacccttaagtttagcattatatacatgtaaactttttaatagacaagatgaacagatagaaaatgcaattaaaaaacaggaaaaaaacaatcattagtttcaaaaggtgtgcgcattgcacagcatcgatgcacagcatgtactcatgaatagacgaaaaaaatgaaaagaaaaaaaaaagaaaagagaaagaaagagcgccgtgttgatgagctttctccgcccacatcgccgacatccacagtgccgcgccgccgtccccaacacctgcagctcagctcacttgcagcgtcgcccctggctcgcttgcgctgccgctcaccatggagcttgctgcgcgcactccccgcggtcctagcatccaaatctggtggccgctcgtcgttcgcggcctcacccccaaaccatggtgttgccgccgctccagatctaccgcttaggagcttgtgggcaccggatccgtgcggtccagtcgctagagaaaggaggggtggagtttctggtggagaaggtggtggaggctacgacaagaagaggaggaaggcaagccccaggcaagtttttggtggagaagatggctgtgcggcgacgaagatggcgacgagccgagtagaggccaagcgagcaaatgagggggagtgaggtgaagggagcgcgacccctctcgccctcctgcatctacgcatccccgcgcctgcaccggcgcgtcacgccgcctgcacaagcgcagcctggatgggagcgaagctcaactcgggcgtttctcgcgggcctggctgcggaggccgttttgcacgtgtggatccaggccccgacgaccgtgcaggcaaccaaacagcctcctcttgcacccatacatgcgagccaccctccatgcatgtaaccaaacacgcccttagaaggaggtgtactaactgtcgaaggaggagctcatcttcctagtgccgacggtgcttgaggcttgagtccttgaggggcggcaccataggagccatctagctcggcagctctagcagcagaccaggtgaagggaagagagagatctaggcagcagcaggtctagttctagcagcatatcagggtggcggcttgagagagggcgacggcttctgagaatagtggtgacatgcagtggcggatttagtccatttctgtggggtcggctgaccccacagctttttgaaaaacatcttataaaccttgattttcatgtataaatctaaaaaaaattatagaaatgaccccacttaaatataaaccactagtaattgaccccacaggtataaaatcttggctccgccactggtgacatgccctcatgactaaaccctaaggagaatggacccagcttcacatgcagccaagacttgttgtgagatcaatataggtgctctaatcggacgattaatcgtgcctgatcgccaattaatcggacgatcaaatttctagtcaacctgattgaatgaatgcccatgatgggatgattaatcgtgattaattggacgatcagataagatttctttatagattcattaattaattgttctgaggtggatatcaatttgatagtagatca

SEQ ID NO: 75391 - DNA, 2348 bp, Oryza sativa
cgcgttcttggccacgccctccgccttaacggtgaaggacgtcggctccaggcagaacttcttcatgttgtgcttgccggccttgaaggcgaaggagtcgacgccgccctccaccgtcgggcactggttcgccgtgccggttcccttcacctccatgtacgtcttactctgaatctcgtcgaaggtaagcctcctcggcacgccctccgcgctggcgccctacaccggccggccaccacatgcacggcgttacatatatagtaattcgatcgtttccaccttggccttggccatggcgccatgcaacatactcctaaatcctaattaaggtcttaccgagacgagcagagctgaggtggcgagggcgaagccggcgagcttggcggcatcggcgcacttgttggcgacctcccggatgtcggactgcagggagcacgtgatcctgccggcggcaccggtgtcgacgccgaacgccctggcgacgtgcgaagacgggcgcgatggcagcgcggcggaggaggcccggccgccgagcttggccggctgcatcagggtggccgcggcttggagcgatgctgccatgtccgctcgctcgcctgctcagctctcagttggtgggtggtgtggccgtgtccgtgtgggttgtatcgtgaagggcgttttgtgagggcgggacagtgttatctatcgcagagcaaggggggcagaggaggataagaggattggataaggcgtggcctcccattggtggcttggggctatggtgatgctgagctggacgtcgacgtggcacgcccaggtgccactccttccccggcgtgtggtggtgggctctttcatttgtggggctggcgctgtgaagatcctacttccagccaacgaaggcttgccacgtcaggaatggaagagacaaacgaacctattctcttgaaggcacagggaacccaaagaaaatgctaaaaattaaagatctcgctcataagaccgacatttgtacgtgttagatgaaacaggaattataaaaaaaaaacattgggccttacatcgttgtagatggaaatggtcaacagctatttgtaaattttcctaactgaatcacattatatatatatatatccacaacaatagagtaatacttttctcatctatactcttctagaaatagacaaacaatagagtaatacttttctcatctatactctatggtggtggctgttggtatttgctacgcatactgataaatccgtaagcgcacaaataatgatgtagcattttctcttagagtattttaagggtatcaaaaataaagacgtgtgtgtactatctacaaacagaattcccccaaggacaacaattgatgataagattggcaagagaggattcatatggacttcactagttgacttaagttaaagatagaactctatcgtatgtttcgcaccggctatcccttaatctgttaggttgagtctggccttgagctatatgatatgcccgaacgtggagggatgcaaagtacgggcagggctgtcaccacctgctacccacctcactttgcgtggagcacacaatctctaaccttccacagaaacttccttctttatagagtcctagtactagagcagttgcaactaagcaacgaacccgcatcgatgagaatatttatcactcaagtaaactaagtaaaaaaaaactttactttgttgtgtgttgtgaagtgtgttgagctcctcctttcatagtgccaaatgatggttgtaatggtgattagtgaggttggtgcacacataacagccatagtcaatccaatggggagctgccacattgaaaggggtagccaggggcaccacggcttgttcagccgaactaggcctccgccttctggccaccgattttggacagttactgatacgtggactcttatgacggttaaagatggtttggccctatctcaaatcggttttgacagtcaggtgggccctttagttcttgtgctcgcgcttgattagtcagatgggccctttagtccttgtgctcgcgcttgattggccagagcttcatttttgtcagatgacggatgtattttttccttatttgacccgcatacttatatgtatcaaaactaatggaaatggttagtagtaaactcctaccactaagttttgatagtgtattttatttttttaacgcaggagttgatggttaaagtttatacttaacgtcaacaatggcagtgaatccgccaccacatcaactccattttattttttttatcaactactccttatgtactttatttttatctaagggacaagtgtatccataattcattcttatccattgcaaag

SEQ ID NO: 75392 - DNA, 8360 bp, Oryza sativa
  unsure (1)..(8360): unsure at all n locations
ctgcagcccattgaaaggctctgcacgttcatggctgatgcatctcccccctactcgatttcttcgtgggcagacctgtggcagcaattcgtcaccaacttccaaggaacttacaagcgccacgcgatcgaagacgacctacatgcgttgacatagaacccgggtgaatccttgagggattatgttcgacactttaatgagtgcagaaatacaatccccgaaatcaccgacgcttctgtaattcgcgctttcaagtccggtgtcagagattgctatactactcaggagttggcaatgaggcacgtcacgactacttggagattattcgaaattgtcgatcgatgcgctcatgctgacgacgcactgagacgcaagaacgacaaaccgaagaccagaggagagaagaaaccagccaaggacgcacctgagtcaagtaagaagaaaaatcgcaagagtgggaaaaggaaggctcaagcggaagttctcgcaacagaatacgtggaccctcccaagcgcccagacccacaaggcagcgacgcgaagaaaatatggtgccctatacacaagtcagatagacactctctagaagattgcctcgtcttcaaaaagtcgctcgcaaaacacatggcattggaaaaaggcaagcgagtacgtgtggtcgagaaggacgctgaggcggttactcaggaatcagactcagcatatccagactccgatcagcatatccagactccgatctccatgtttcgcacatcttcggaggttccacggcatactcctcaaagcgagaatacaagaaggtggaacgtgaagtctgttcgatgtggcaggaggctgcgcccaagatgaagtggtccgaacagaagatagtattctcagaagaggaccaccccaagactgctatcatcccagggcgatatctgatcgtggtagaacccactattcggaatatcaaggtcgcacgagttctgatcgacggcggcagctcaatcaaccttctcttcgccagtgccttggacgcgatggggatcccacgaagcaagttgacacccaccgatcaacccttccatggaatcactcctcagtcatcgtccaaaccattgggcaaaattacgttgcctgtgactttcggccaagcaaataacttccgaacggaacagatcacctttgatgtcgctgaattcgatacagcatacaatgccatcattgggagaattgcacttgcgaagttcatggccgcatctcactacacgtatcaagtgctcaagatgccaggaccgaagggaacaatcactattctagggaatactaagctggcaatacaatgcgacaagcggagccttgacatggtcgagcacacgcccagcccacccgccacagctgagccacccaagaaagtgagcaaaacaaacaagacgccgaaaccggacggcgcaatcaagatcgttccactctccagtgccaaccccgacaagaccgtcaagatcggggcatcactaggcgagaaataggaactcgcgcttatcaccttcctccgcgacaaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaagccatacaagaagaacttgacaaacttctcaaagccggttttatcagagaggtactccatccagagtggctagccaacccagtcatggtgtggaaggccaatgggaaatggataatgtgtgtcgatttcatcgacctcaacaaggcgtgtcccaaggatcacttccctcttcctcaaatagaccaactggtggactcaacagccggtttgtgagttgttgagctttctcgacgcttactccggttaccaccaaatcagcatggcgaaagaggacgacgagaagacagcattcatcacgccgttcggggtattctgctacgttaagatgccgttcggactaataaccgcaggaaacactttccagcgcacggtccaaggtgcacttagcgaccagctcgaaaacaatgtcgaagcctacgtcgatgacattgttgtcaagaccaagacaagcgactcattgattgacgatctgcgggaaacgttcgacaacctccgacaatatcgcctcatgctcaatccagagaagtgcacgttcggagtaccatcgggcaagctactcggcttcctcgtctctggcagaggaatagaagcaaatcccgggaagatcaaggcaatcgagaacatgaagtcgcctacaagactcaaggaagtacagaagctaatcggatgcatggcggcactaagcaggttcgtcgctaggatgggagaccgaggacaacctttcttcgctctgctgaaaaagcaagacaaatttgtatggacacaggaagccgaagaggcattcattgcactcaagcgctacctatcaaatccacctgtacttgttgccccccaacctaatgcagaattatttctctatattaccgccacgccatattccgttagcactgtcattgttgtcgagagagagaaggtgcaacgaccagtctactacgtcagcgaagctctccacgacgcaaagacaagatatccacagatccaaaaactgctctacgcggtaatcatgacatcaagaaagctacgccactacttccaagcccacagggtcacggtcgtatcctccttccctcttggtgaagtagtgagaaacaaagacgttgtcggccgcattgcaaaatgggtagtcgagctaagccagtttgannnnnnnnnnnnnnnnnnnnnnnnnnncaagtcccagctgtacttgccgacttcgtagccgattggcatatgcctgataacaggtcagataaccaaatccacaacgaaacgtggacaatggcgttcgacggcgcactcaatagccaaggagcaggggcaggattcatcttgacatcaccttcgagagatcaattcaagcatgcaattcacctcaacttcagggcgaccaataacacagccgagtacgaaggactactcgccgggataagagctacagctgcactcggagttaggcgactaattgtgaaaggggattccgaactagtcgcgaaccaggtgcataaagattacaagtgctctagccccgagttatccaagtatctcgcggaagtcaggaagctagaaaaaaggttcgatgggatcgaggtccgacatgtataccgtaaagacaacatcgaaccggatgatctagcacaacgtgcgtccagacgagagccacttgaacctgacacctttttggacatcctgacaaggccatcagtgaaagaggcaagcggcgaaggtagcccggtcgcccccaacatcagctcggggttacagaggcagaacacgccgttgccgatatcgagaccacagacgactggcgcaccccactcattaaattcataggcagtgaagagttgcccgaggacgacgcagaagccaagaaaatatcccgtaaagcaaaagtctactgtatgatcggcaacgatctatacaagaaggcaccaaacggggtactcctaaaatgcgtcttctccgacgacggcagacatctcctcctccacatatatgaagggatctgtgggtcacatgcagccgatcggacattagtcggaaaagcttttcgacaagggttcttctggccatccgccctcaaagacgcctgggacatggttcagcggtgtgaagcctatcaattccacagtaaacacacaaggctatcaccgcaagcactccagactatccctctcacttggccgttctcgtgctgggggctagatatactcgggccattcccacgaggacagggcggctacaggttcctattcgtggcgatcgacaaattcactaagcggattgaagcgacacccacgggggaaatcaaggccgacaatgccatcaaattcatcaaagggatattctgcagattcggattgccgcaccgtatcataacggacaacggctcccagttcatcagtgccgatttccaggattactgcattaggctgggagtcaagatctgcttcgcctcggtttctcaccctcagagcaatggacaagtcgagagggcaaacggcatagtactacaaggaatcaagacccgcgtctacgacaggctcatgtcacatgacaagaagtgggtcgaggaacttccatcagtactatgggtcgtgcgtaccacaccgacaacgtccaacaagtagacacccttcttccttatgtacggctcagaggccatgctccccaccgagctacgacatcacagtacacgagtacagaagtattccaatgaggatcaggaggagcagcgacacgacgatgtaaatctactcgaggaacatcgtgaatgaattgctgttcgagcagccagctaccaaaagggccttcgccgttaccacgagaaaagcatccgagcacgcacgctttcgatcggcgactacgtcctccgatgggttcaaagccaagcagggcgaaacaagctctcacccaaatgggaaggaccgtacacgatcacacaagttctgcggctaggtgcattcaaaattgcagacggcgatggtcgcgagttggcaaattcctggaacattgatcaattacgtaaattctatgtataagtcaatagtatccatacttgtaagacatcttacagcttcaataaagcctatttttcaggtccagaccacaatcaaagtgttccttcccgatgatcccttacccaaatgacacctagcgttgaaacctatcctcatgtccctttacgccgtcttgacaaggcctccgaggaacctaagggaacttcggctggggacgcccagagccgataaggccttgtcggatcctgttgagacgaaagaccatgtaagatctggtcgtgtaagagttctcgccgtgcgtattaaccaagccgtgtaaccggaaataaattttccaacttcacggctgggggctaggatcagtgctggttcaaccgaggcaggtcaaaggtccaaaagtcttatctcccgagaagaattctccgatgacaaggctgggggctagggagagtgtataacacaaacgactaattgaagtcgcgaagtgagaagacactcatacacgctaaatccagagtaagaaagcttagttagatagatttcttctctatttcacaagtacttcttacatttccatcaaaatccaaaattatattacactttttccctaagacatttgtcacaggacacggagactaccaggaaggccaacgccagtgattgactggaagaccttctccgccagcagcgccatcgacttcgctagaccatctatctccgtaggagttctccgagaacgagaaaacccttcgcggaggaactcgaggtgcagctgcggacgatgatctcgtatgcaagccaacacatgccccccggcatatcggcttgaccgacgacactcctgcttcaaggcttcgtcgatacgttgaccgatgccttcgagctgggtgcaggcgccattcagccacgagatatatccggccgccgattcctcaggatccccacggggtactcggaggtctctacagactctggacatggacgtgcagcaactctttagatatgagttgaaccacacctcacgaccccggagtgtctctacggcctgatccttcttcacttccagcatagtcctctcgagttccgcgacctcaaacttcatcctccaatactggatgcaacgatcctggtctgcgcagcatggaaacgattaagtcaagctgctcttctctcccgagaatacaacaaatcaagtcgacccagatggaagcgtaaaggaaatgataacaaagacaaccaacctaagggagtcgctgccatgctcgtttccacaggtgaattttgagctacatcgccctccggcgcatgcggctcgaacgcaagtaacggaacgaccactggcaactcaggctgcccgtgctgctggacatcctcgacatcaacatctctacaaacgacaacaaagtactcaagatcaaaatgctaaagaaagctaaggcgataactgcacacacaaaggcggttggaaccaataagagttttacaaagcatggctaaagagtacaagagagctaagatcctacgcttcaatagcgggaggacggactccccaggtcgccgacctcctccatcacatccttgctcgcatcgctagccgccccctgatccaagatcttccgcagatcgagttcaggatgtgccagcctcacacacgcaaggacatggcacaccccggtatagatcccgttgaacgtctcctctccgaccctggccgcgtgcttggaggggatcgcctccatcgccgttgccagttccgcaagcgaagacgtcaacgagaactcgtcgggattcgccgggatggtggccttgacgccacactccccggcgagctggtgcaggccggtgtaggtgacccacagtgagccacagatctccgacaagtggttctcaagctccgacatacggtgctcgagcccttgccgttgtcgctcattgccagccaccagctcccgcatcttctggaggtcctcgcgaacctccgctaaatcgcgcgccagccgatcggcgcgctcattcgccgacgatgccgccttcgcctccgcgatctcgcggccaataccgtgagcaccagcctcgaggaggcgccccatctcgacctggagctcctcccaggtgagaacggcagccagcagaccccgaccagccgcaagatcaatagctgggccgctaggtgtcgcctcgcggctcctgggcgcgaccacgacatccgtcgaggccatggcgtgtgacgcgctggaggtccctccagacccgtcttgcgccgccttcgcccgcgccgccctgcaaaaagccgcaactgaaacaggctacaaaaatttgatgaagagacaagacctcaaagtcatccacttacttctcgccaagcgtcattagccgctgccgtcgtggaggcgggggagacgcgtccgaggcctggagtacaaccgatatgatgtgaggtggaagttttccgactacacgatcaaagggcaggagaacttaccgagggggtgggcgtcttccgacggtgtccgaccacagaggagaatctcctcctctttttcggaacattgccgccactcgttgtggcagcggcagcggcagcgtcagacgcctccttggcgactttctccctcagcgacgccgccacctgatggtccacaagtggcccgatgatatcagtcagagggagagcctacgcttcatgaagtcataatgcgatcccggaagaaaaatgcaaaaggaccgctgagcacacttacattgatggtagcgtcgcgctcggctgcccctttctcgcaaggggggacggggacgttgctcgccgttgtcgggccactgatcatcagttagccgacgcggcgctccacggtggcgctgtccaagcctgtagatcgagaccagaatccgataagccgggaacaacacgcgcataagggagtcaatttaactaaaaaggaaaataccccgaggacaaacccgggtcgcgtcctctggctcagaataatcaaaggctggatgggctcgagcctgaagtggctggatccgcctaccgatgaagtcggcagcgacttcataccccgacaacccccgttctcggaggtcgtcaacgatatcgatgaaagattggagggatagggtcaaggcgggtttggtggcccaagtggaatcttgtctggttgctcctcaggaacaacgaagaccggatccgaatcctctatctgaagatagaaccacctcccccgccatttgctgcgagatgaggggaactggaaggggatgtgtcgcgacttcaggccatcccgaagtcggaaaccaacacacccggacacctttttaggttccatccagcgtaactcatagtaaaagaggaagaggtcaagaaacggctctaccccaatgtaggctccatccttcccgctttagtcgtatcacgcgacacgcctcacagccgttcgatcatgcctgtcgtcctgacgtacatccgcgtggtcgcgctctaatggctcaatgagaaggatcaacgtagtgcctgctgccttttttttaatagatatgtatgtctttttcctcttcaaataaagttttctctcaaattacttatccgatctataatccgattataccattatgttcattacaattaaatcttcacaacaagatcttacatgattatattatgatgaaaaaatatttatattt

SEQ ID NO: 75393 - DNA, 6423 bp, Oryza sativa
  unsure (1)..(6423): unsure at all n locations
tgtaatatagagcatctgttctaacatttgtacacacagcagaacaaaatcaacagatatcccaaatagtttatgtgcgtgccctgaggcatggtagtaaatttgatgtttattctaggaagaagaatgtattatatccataatcattactagtgggttactgggttgtcaaggcatttacagtttacaatgatctacggagtcaacgcttgttattacaatgagattttttttaatcacataagggcaaaactgtaagcatggttctctgcatacgtgggtcttcatatagaagggctacgcctagacccaattttagaagctgaaatgtccatataggtatggcgataacgcagcaaaaagcaaatatcaaacttgaaaaatagatatattccaaatttcaatatttgagttgaagtacccatgaagctccatttctgcagcagacaggaattgagagaatctagtagcaacatctgcaacgctctcgccaccatctggtgccattaagggatctacttcatctactgcccatacttctgcatactagcacatcatatcagacttagtaagttaaataaaagataagatcataagaatgtgaaaaagatgaacatgtgcttatgtggtgtggacgtgtgggattttggaaaagctaaaacctctgaaatagatatgcatgaccagtaatgcagttagggaccatattgccatttatttggaaagaaaaactccttctggagattaagatcttattatgattcattttagtgtccaacaaaaactgagctgaaaagaaggaaatggccttgtttttcttcttgttcattctgtaatcgtgaaaaagagatgaaacatctgtttcccgcatgtgaggatgaatagatttgtggtgggttgcaaccttgcgtgttgccactaacagtagacccactgatttgtggtagtctctgctggatgaatcattacttatcattataagaaatcatatgtaatttgcaatctaacataattccatagctacattattaaaaaccacatgcacaaatatcaaattgtacttaaaagatccagaagttccagaggtgctctgtgacggacccgaagccatgacgagataagataaccactgccgggaggatagctgggcggagtcggctgttagggacgaggggaattagactgggaagaagaacgtggggagagagattagactaattgatattagttgcttaatccaaatgatgatacaatccatccttatataaatggagggaaggacccanactaatcttatccaaccgactctaacccactgagctaccgtgtgtgtacgaggtgaggatgggatagcantttctcaaccggtaccttgggcctcgttctcatggcccaatgccaatgacatgctcgcaggtggcagattcactattaccaccattaggttcacttctttaataatagagattgatgttcatgtcaaacgtggtaaataaattatattcatctgaaaaggataattagacttttttgcaatgacaatgtaacaatgaacctctttctagtggtacagaccacagaggcaatcaatcctcgaatatccgtagaaaggctcagttaataacaacagattagagaactataatttgaaaattggcttggaagaagtcagccaccatttctttgcttacaacaagaatgatcttttcatcaattttaatagatgtaatttttttattcttttaatggaggatgtatttgttacataacatgtttttgcacaatttcttatagcttcatatgacaagctcggtctgtgaaaaccgctaaattttggagttagtttgaataagacaaacaaggagggcttgtttctaaaatcattcttttgggaaaaattgcttagagcttcatgaaagttccctaacttttgtcattagcttcaataagataaaagaacacaaagaaattcgagaatatcgggctttttcttgttctgctcagacaaacatgggaaagaaagtctgggcatttcttgttctgttcgttagaagatggcatttcgcaaaaattacagctaatataatgaggaaggaaaattattctgattcaaatgagttcctgtatttttttaaaaaaaaatcatgccagtgctattagttaaaataggtctcagtttgtaccaccaactgtaagtatgcttagttgtttatttatatatcgaattagagtctgcacagtttgatagatcagcaaaacacaccttctcatgtgaaagcaattcatgcgatggcccaaaatagcgttcccgaagttcaacagctggctgcaaagaaattattattaccttaagaaagcagaatagaaatgtaaaaggtgtttcaaaaggaaactccacactgcttttcacgtttgaatagctcaggaaacaaacatttggcaaagcaaaaaaattggacaatgttttggagttaatacatttcaaatttgtaaatcatacatttgaaggggatgattatagttattgaatggtagaagttagttggcatgcctctgttaggttcacaggtcttctctcctaccagattatttacaggtcttgctagctgtaaacttgttctaaagaatgacaagtttaaacagggtttactatgacttatgtaaacatgcccagggaaaaaaagggaaaacaaagaattgcataattgtttagagtgaattaaacaaaagactacatttgttcattttaacttttgcattaataagaactaagaagtgccagcgcatcacttaactccagcgaacagaagcaggtactcctgggaagtatcacattttaaatatcacacatggaaatatcagttgcatgtcttttttcatccttccatacaaaattgtctgcggcctggccctttttcaatctttatgcacgcaagttggacaataaatcagtaactaattataaaatcttactacacattcatgattatcatagataaaagaatccaaagcctatagggaaagttacaagttacaactcgaataaattccatgcgaaattacttgttcctaaacgttagaatatctatgctcacaaataactgcacaataaacagtgacagattttatatgcaggaccaaaccactcacaatgcagctgggagtatcaaaggggacaccaagcactctagcaacctctctggcagtctccatggtccgtgagaatggggaatatcggatctgaacagaatccagtggcacacccaattcctcaagctcctgcacgcaatcagtcccccaaaatcactatggcacatcctctccaagagctcatggagacacgactaatgcacaccaaatcggataccttacggagcgattcgccggccaagcgcgcctgctcgacgccctgcggcgccagcccaaactccggcttcgtgccgttctcctgcgaggattggagcagttagaaggaaagatccgaatcaaactaaactgctaactggacacgaagttcttggaggcaagaaattgaagaagggtgaagacagcgaggtgggatgcacggatcggtaccagggaggagacgatgatgccgcgctcgttggggacgctgcggccatggcggaggatccagtacctgttgcggaaggagggcgccggcgccggcggcgagctgctgccggagtcatccattcccccccaaatcaaagcacgtagtgacacccgctccaatcaaagagcggagtttagagccaaacgtttttcttttcttttttaatgttttcgctatgcaatggggatcaaattcctcattttccatagtactagctaattcttagctaattatgcgctaatgatctttctcgttttgcttgcgtacgaagatttcatcccaatcgaacaaatgaacacagcattaggcctagctcacctgtttggatgagtttaagattatgagaaacagctggcaaatagtcagcttctaagaatctggaatccagcttttagtttctagttcattttctggattctacaactacagcttttcataatctagataaaaactggactacaactacaactacaattatagtttctaattgtgggagaagctgcagaacccccaaacagcaccctattcctcaactccaaactttaactttgtcgttttccattagcacgctttttaatcatgtgcaacgaggtttcttgtaaaactcgttttacatgcaacaaaaatccatccccaaactggagatcgaatgtggttttttatgttgaaaaacacacccactgtttatcattcccaattgttctggataaagattttttatcaaataactaaaatgctcttaggatcgaataaatcaatactagctctcctgaacccttaggatgtgttgcacattccccttgccaaacctatgcagaaagctggtggtagtgagtccaacaacagcagcagcatccacatctgacgatgacgaatttttcgtctacaatagcgaccatattccacacaagcattcatgacccctagctgcatgacaacgatggtagcggtggcgattatattgcagtaaccgtggtgacttacactagcagcatatctccctcgttgtgcacttctccttacaccaaagccatgaggcatatgttagggttatgggtgaggtataccctctacccttcgatatgcgtcacatatcgatatggtatgcttgcgcgtatacggacgttttcggcataagttaaggaattacattatggagtccacagatgtaaggagtcctactcggatagaactgggtcgtcattgtatcatgtcgggtccgacgtctccgagtcctacttggagaccagttgacctgcggtataaaaggaaccccccgggaggaactaaggcatcgaatcttaccgccaacacatccaccacagcctacgaagccggagcttacaggaaccaagtcgccgggtgatctagtcgaatcaactcggctacgatctcgtcggtatcgtcgagttccattattccttttgtaatctgtggtttccatcatataatcccatatcaactggattagggctatgacctatcaaggggcctgaaccagtataatctttgttttctgcctgcttgatgtcgtattacgtagatcctcgtaccagcgtaccccaataccctctatatccggtctacgggtatcccccgtcgacagtggcgcgccaggtagggggacttggtgctcaaggttctactactatgacatctagcttcgtcgacaacagcgtcaacaccaacctcaaccaaggagttcctacttcaacaacactggtgtggactcaagtcggtgaaatcgtctttccggtttacaccacagtgctgatctcagctggtccgccaatggccgaaaatgagaacgcagtggctacaacccgggacgactccatgtcgaaggatcctcccgccgaagcagagatcggaacgtcgacgacatccgagcccgagaaggatcctagtgcggccaagccttgtctttccgacaggaatcacgagccgacgaggattacttccgaggtgacaaggtcctggtgtcctatccacaaaaccagaaaacacaccttgcaagcctgctgggtttttctcaacgtctatgctgaaattcgtgcatgcaaagagtgtggaattcagcgtacctctccaactcgtgatgtctattgtcctattcacaagacaaagaatcacgacctctcgagctgcaaggtctttctcagcgccatgaagatgccacctcctaaggtccagcagtcacgcatccccctcagggatgaggacaaggaacaaggagcgacgccgatttcagatcgatttgttggggtaatcgacatcgatccccacgaaccatcagtcttgcacctgctcgaagactatggttcatcgacaacgagtatgccgcgtgaggtattggctattgacgatgtcggcacgtcagcacgcaccaattcggaagcggagaatcaagtgactacaccggcccagcatatcagagccgtcaacgaaatattgagggaaactccctacgaccccgttctgaacaacgatctcgcacgatggacagaacggttacgggagtcagtgaccaacctcagcaacgcgttcgaagaggccgctgctgcagcacacccggaacagccaccaactggcgatgctaatggtgaaaatcctgaacaccgggaatcgcctcatcgagccacccctccacctcgcggcaccggtgatctccgcgatcacctgaatggccgccgagaggtgcgacgcacacgagacaacgagaaccattctcgacatcgcgtctcttcacggcgtcacgataacgaagatcgaggaggccgttcgagcgaagaccgaggccatgataa

SEQ ID NO: 75394 - DNA, 5839 bp, Oryza sativa
  unsure (1)..(5839): unsure at all n locations
gtggcagcgcacgccagatcttctccaatggtgagggtggtggcgatgacttctctggtggccaagcccacgccggcggcaaccgcgagggcaacgacggctggactggcggcaagaacgaaagagggcacggccgctggactgggggtggtggaggtggcggcgcccgccatgggtagccaaccctagctggaggctgggccttgggtttgttttaggaataagttcatctaaggtcccttaacttgtcaatgaatccgattttcgtccttcaacaccaaaaccagatacaacaggtccctcaactatcaaaaccggtgcagattaggtcactcgtggtttcgatggcggttttggctgacgtggcgcctacgtggctaatttgactcggtctcgatctgacatggcattgacgtggcgcttacgtagcaattatacctcgaaaaataataaaaaccacgggcccacatgtcagcttaaaaaaatgctggggcccacgtgggccccacatgtcattccctctcccctctcggctctccctcttcttcctcactcccgccgcctacgagctccgacgacaacggcggccgaagcatgccggagcacgggcgcacgtacaaggacgccaccgagaaggctcgccgcttccgcgtgttgaaggcgccattttcctttcctattgatcacagtaagtggtcacgggaaaactgtgagaaaaattcctttttgatgtcgattccaggggaagacaatcaagcaacaaagagaaagacaagaacgggggttggatgaagaagaagcaaaacgagcctcctttccacacaagctcgcggtggctggccgccgtcctctccagctcgctccgccaccatccagccaagcgcgctcgtccaccatctgcggagggccggagctcatcagtgggttgccgccgccactgtttcaactaattttgcctgccttttgagattgggaaattagttcagcggtaaagaaataaaggggaaaacagatgggataaacacggtacacgtagatgataagtagataagtacggtacagaggggggccgcctctcctcgcccggccgctgcgcgccgcggaggagggctccctgncnncnnctgcgcgggnggcctcctcnctgcccccctcctcatggtcctcctcctccncctcccgaagtgacacggccgacgggtcaggctcccggcggaaggggtcgggcacctcgagggagaatgcgaggcgttcggcacggatgggtggctccggctacgtcggcgggagaagcgacaacgtcggcagcagcagcgaggcatcgggcatcgggcgctcggaagccatgggggatgggagcgagcagggctagtgggtcaccaccggaggcatggcggcggattgggcgagaggtcgccggttcggcgaggtcaatggaggaggacggtggcatgagcaccgacgcccaactcctcttcaccggcccccgcagtcgccagagccatgcctccgtcgcgagagaggagaggggagagagagttgatgagaggggatggggagagaggaagaagggggttgagaatgacatgtggggcccgcgtgggccccaccattttttattaatttctttgtaaaactgacatgtgggtcccacaaggtttattattatttttgattgaattgccacgtaaacgccacatcggtaccacgtcagatcgagaccgagtcaaattagccacataggcgccacatcaggcaaaaccgccatctaaaccgccgagggacctaatctgcaccggttttgatagttgaggtacctgttatatctggttttgcggttgaaggacgaaaatcggatttgttgacaagttaagggaccttagatgaacttattcctttgttttaacccttggctagccaagcaaccggcctagcgcccctcggctggtcttcttgggctggctccggtggcccactactcccaggcaaataccaccttcgctaggctatctatgtcacatacatcaactggctagcccaactgggagcaagctgacctcgttgcataaccagatggcattttttgcctatgttggatataatttggcttggagagtcatttgaccactctgttagagttgctcataaataatacaattttttaagaaaacacactttttacctttttagagttgtgaagtaaaataatccggtgaaatagcccaaaaaaggaacacatatgtatccctctaattaagaaaattgtcagatctcttgtcccatgggttcagatttagtcggctcgtgctattacaacttgaagtttattgtggtcatgattcattttgtattctagtattgcagattttctagtgccacggatcacagctggcgaactgtgagctcaacacaacttcatgaacaaagctatctttgagatattttctttcttgcgggaattttatctggtgccaacacagcgcatatgtatccatcatcaggtgtacctgggaatatcttgcatgaaccttgtggatctgtctgtatatgtactatgcattttcaacgctacaatcgggtaaccagtttcttattgtccaataataccgtgctgatatatactccgtatattttatctgccatgcatgtctaagcattgacggtgactttttttctgtgattatcatgggtccagctccaccgaaaccttgaaaccttgttcagttaatcccctaagaaacttgaaaagaattaagagaaaagacgtggacttaatcccctcgatcttgtccgatctctttcttgtgaggattaaccgaaaaatcctgaaacggtgaaaatctcctaacggtaggaagcaatgaagaaaaacgcaagcacccgcacaaaggcttcatttataggaaccataggtgactgagatttctaaaagtttttggaaatatagtcataattccaaatattttaatccataaatataatcataataaacatgacttgtgataaacatgacatgtgaaaaagagagtgattctaccatggtggtacacatgaatatgctaccagtaacaatagcatctaagaacacatttaacaccgagatgagaagaatatacctagagaacgctccgaatccggaggcgacagtgttgttggttttgtcgccgtgttgccattgtagttttctctcctctattgccgttgttcccttcgttgccggtgacgaagaggaagaatagcctgatgcagatgaaacaatgccgaaagcagtcacgtgaagaacgcactccgcaaaaacatgatcgcctacctacccttgcaggtacttgtaagatcgcacggcaagaattaaactaaccaaaatggaggtgaatgattgaagtatccaaatccaaaacttttagcgaaattaaaagttaccctattattgatggagatcgatctgaccggagtagatctgtcggtctgaccggtgtagttgttccggtctaaccgcctgatgtactgttgttgcttgtcgccaccaccggtctgaccgccatggagccgccgatctaaccgggtcgatgccatcggtctgaccgctgatatctcgccgattggaccaccgcacctgagaaaacacaaatcgaaaagtgggagctcaccgtggggcagcggccaagagggctcggtggtgaggaacggtgacggtgggctcctcggggtgtggacaacggcggcagctccacggcatctcgcgggtgcgaagcggcggacggccaccggatggaccttgacaggaagaagagggctccggctgtggatggtgaaggcgaagaggcggccgaggcgcggcacggcatggcaaagccgttggtgctggcagcacggccgggcgaggcttctctcgccagtggggaacggctagaggcggtgaaggaggcgacggcttgggtagcgcggtgaaggcttgctctttttattatgcccttggcttgctttgcactcgagatccactttgagccttgttctttttattatgcccaaactttgtgtgtctgtgtttgagttagggatttgagttcttgtgagtgcttggtgttgattgcgtgaagatttgttcaacacttgtttcttgcttaggatattcttgcttcatcttttactcttggaggtcgaggattcctaaacagcgaggtcattcttgagccaccgatctacgtgtggttggccaggagaagtttgttaaggttggtatcgattctctagatcagcaagtaaatttatagggtgcactagatcaaggagagatggtgacactgagtttatacaggttcaggccctcagaagagtagattggatctgtatagatgtatgcgcggtacggcgtatggagtagcacgtagtgtccaaggattacccgcgctagggtttccagctcctatatagacccggggaggctgactaaagtcagtaggatatcctttataatctgggtacatgtcgcctatttacatgagataagacttgtattcttatctttaatccccttgcgaaattacatcatgcggcatgggcctaaacctagtccgcccaccccatgctacacaacccaaacgcctaaccttcggtacctaggtaccgtgtaccccgtagttggatcttgcctccaaaagataagagaccactagtggaagaagtagtgctttgtgtaacctctcgaggaaagggactcggctctttgtgagatcctcaacgaagattagaatcccctcaaggattcgaacttcgggaacaactcatcttgcaagaacttctgtgacatccttttccctctcccttccactatctttgcttgcttgcttgtttgagcttgatgttcttggttgtgactagctagatccattttgctagtgagtttgtcgctgctatgctatttttggaaatatccgaagctccttcggatatatccgaaattccagcttccgcatttacttgagtttaatttagcctattaaccccacactataggcctaagtgaccctttcaacaaacacccatttgcttaaagaacatcagactccaactagcataaaaagcagtcaccaaattgtgacgcaaccacacaactggatcggcaaaattgagaatgtgggaaccaagatcagcctggatggtgaaggttactactagcatatcaggctgttagccatagccagtccaattgcagcctatggccagtcggatgcagaaccaggaaatctatgcattggttaaagaatagaagaactggggtaacagtaacacaatgattccaactaaagaacagaatattttatgggcaaaataaacatccttctgctgttggatcactgccgagttgtaaaaaaatacacccaactgaattttgctacttcataaattaattgtctactaaataaaaacataaaatcatatctgcagcaagtcacacaagtcggcgcagctccccagtgaggagtgcgaactgacggtgctgtgacaacacggatagtgttatcatgcctctctttttaaggtcacttacctcatcaagggaagaagggttctcctttgtttctttgagtactgcttgaaagatctgtagtgggtccccatgactgacaataagaattgcagagctgcatggaattgaacatacaagtcaactccacataatactccctaacacagtatatggaaatgtgtgttgaaaaaaatactaagcagcaactggatgtggaacaatggtgattatgtctaatttagttgttctattgtgccaggaatagtactcatgtctacgagagctatgggcacccctcctcaagcttgtaaa

SEQ ID NO: 75395 - DNA, 10004 bp, Oryza sativa
caagaattgcaatattacttatatatgtgatacgaaagtatatatagttgagaataaagacttttggatatgaattttataaatttaattttatgtaaaaaatagaaaggcaaaacaaaaagaaagaaacacattagccaatggctatctctcgatcggcatggatgatgggactgggcgattggatgtctcgcgctagaaagtgatccgcccctgcgcgccacaaggttgcctctttcggaaccagctgaccatacccttcccatagtttgactttttaagattttatcatagttaactagaaagtgtcttttcgctacggtgtattaaaactaaaaatattttatttttaaccgaagttactttcacactgctttggtacttttgctcgttagaaaaagtctcaaatgatagagagtaatatagtagctaataataaattattattcaatagtgcgttgcaacatgaaaaactaatgttattaacttagtaaagtaacagaaaaagaagcatccacgttatctcttatggtctagatttctcatattagttggagtaaaatataaaaaatgaggagaactcattgtagacaatgtgatgaggacacaaactagcttggatataaccatgattaacttatgtattaattaatcaaaggtgcatatgttctatattagatttacttgttatatatttgaacaagcgttgctacataatgtgtttcgtgtgttttcgtttgcagaggtacttgcttgggtgaaagaaaagagaccgagcgtaatgaatgcatggatgattaaagaagttgattggggaccaaaccaagattttctcaagtccacttccatctcaccacatcacttttggtccatagaagacaagagataaagttctacacgttttggattcggattcgggcctcctgacagcatcaacttcaaacggacctagtctctgatctagaaggaatttcggggccatgagtacttgttggaaatcttatggagtctactttcaaatggttttggttccacgtcaaaattcctaccgagctgtcggaaatctacaaaacaaagccacgtatcttatccagtttgaatctgatttgagttttgggtcttgtaattatgtcgtgggcttaacccaagggggtgtgcgccctagggcaaacctaggacgtccctaatcatatttattcagtagctgtcatcgtttagagttaggtttgcttagattaatctgtcaagaacagtttcgccgctagatcagtttgtggaaccccaaattcgaatgcttaatcattcatatgcaatttggttgcaatctatcttgcttttgcttgtgttcttcgattcgcatgcaggaattagccttctcggcgaggtcaaccgagttttggcacggttgataaccagaggagatgtgatgctgtgattgcggggctcagtagcgtgttcgttcaaaagccggatcgagttgtgtcacgactccgcccaaatcgactgtttatcaatacctatcggaacatcgggacctattccccatcacaatgactcattcattttgttttttttaaaaaaatcacgctatccaattggatatatgcataaaacaaatcttttgccaaaaaaaaaactaaactgaataaattaatctatctatataaataatacaacttaatataaagtataaattataaattaaataatattggatgaggagtctagaatattctccaaaagagcctagagtgcatataggaatataatttagaaaaagaattaaaattcaaaataaaaaaatattgaaagaagagtttagagtccatatagaaaactaattagaacaataaaaaataggaatattggaagaagaatagagtccatataaaattaaaaaataattaatattatttaattttagtctacatttaaattctatatcatgacaaataaatatttacatttttagtcgacaaataaatccatatcatgagaaaaatctatccaaaattttagtttattcaatttagttggaattaaattaataagcagtcataaacaattaaaatggtattaatgtccctcgcaaaaaaaatggtattaatgctatttctgataatagaaagatgcttaaaattactaagagagaaaacattgattttaattgcggctcatttagaggcccaacagtccggtggcccgatgcgggagaagacgcagccgtccgatcgaatggacggtccagattgatcccagccaagataaatatctgtagccaaaaccataaccctaaaattcattccaccctccgcgcccacgatcccttctctctctcttgatcgaaaagcgatggcggcggttccggcgcccgccctcctccctaccacgagcggctgcggcggtgcccttccccctctccccgcgagcggcggcggcggctccctccgacctgtctcgctttcctcgccggcggccgctccctttgtcctgtctcgcctcctcgctccctcctcctctcctcctcgcctccctcccgcggtggcgcgggttgacggcggtcgcgggcgaatccgagggtggtggcggcggctccctccatcccctctagccttcctcctgtggcagatccgccggcggcggcggcctccgcaggcggatcaagcggcggtggctccctccgccccctctcgccaagtcccgcggtcgatccgacggtggtggcggcgttggcggcgtccgcgggtggatccattaacagtggcggtgggcagatccggtagcggcggctccctccgccgcctctcttctccctccggcggcggtggtggtgtcggcggcggccgcggatggacccagtggcggtagcaacggccgagggcagcggtggcaacggccgagggccacggtggcgatggccgagggcggatccggtggcaggcgagtgaagtttgtggtgtatattgttgttcttcttggatgattattttgtgattttgtgatgattgtggttgattttttgggggcaaagattggttaggttttgttcttttccttgcggtgtgtgcatctgattcggttgtgccgattttggaaagtgtttccttatccaattcggattcgggggctgcgaaggcgcaccgccgacggacttgcgacgaacagaaaattacgaatattttaattagttaagattaagatttttattatttgcttttaaattgttaatgacacatgcataaggttttacttataaattatttttttccagcaaatttggaaacttcctccacgcaaagccgtagcgaaattctcacctcaagatggccctcaccgtcggccacctccagccgccactcgccggagccggagccaaaagcgtcgccattcccggcccactcatcccacgccgccacatcctccttgccgacgccgacgtactccatccccgccacccggtggccgaacctgacgcagtcgagcaccccgaagcggcgcgcgtaggcgccgaggtagtccatcacctggcggtggtccgggaacacctccgtcaccgtctccggccacgggaagtcggagtactggtacatgggccgcggagtctgcagcgcggtgccctccagcgtccacgcccacacgccacccacgccggtgtccgcctcgaacaccaccggccggcagccgcgctccagcagttgcttgcacgcggccaggccgctcacgccggcgccgacgatgaccacccgcttcttctccatgatggctagtgggctaggaaagtgcgagctgtgtgagttgtttggagtctgatgagcgaggtggtatttatagttggtcagtgctatacttcctcgaaatatatcttttgaccatgtcatctaatcataatatatataatggataaaaatatttttactgttttttaaaagttatatatatgtagtgttaatacctttaaactatattttaaaagttatcgatgatcaaagttacaaaagtttgatctcaactttatctaaaccatcaataattataaaaccagaggtatgtcattaactgtttaattatatattttttataatgatgcattatgcactaaattgtttatggaacatgaattgcttaatgtgctatttttttatatggcgttactgagtattaaataataatggcatgtttgttatatgtacttataaatcattcttattatttttaatttgttaaacttatcagtggtgctaatacgcatgctgcgcaccgaatgctagttcgagcgcgcacaacattccctccgtccggttttcccgttgttttaccacccaacctttccgccgcaatccacctttccttcgtccgttttttttctttttttcacccccaccttccgtgtttcttttttctcttttccatctcatctatgcttcattaaaagagctgataaaatattaaccatccatattttctcattttctcgttccttctctccagatttgttatgcttcattaaaagagctgataaaatattaaccatccatattttctcattttctcgttccttctctccagattttttatgtattcttattttagtaaaatatttaccatctagtttttctactgtctcttcaagtttcaaaagtaagaaatttatgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccactggaatttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagctttggaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggatcaattacccaattaaatctaacaatttactctactgagttttccatttattcccagtatcccacctctgcaccttcaaaagtaacaaatttactcacataaatgcccccttcaaaagtaacaaatttacttgcatgaatgcccccgcatcgttcggcactattcctagatggtcataaaaaaaatactaccagcttacaacgctagtaattcttttaccagtgttataaataagagagaatcccttatatgccactgagtataggccgggcatggctaacaactcagagagggcaaatatgtcttttttacttaagagttaacggtcaacacacggtcaaccgacgggagtggcatgagagagtgcgcaaattcggaccaattgcatataagggaagagccaattttcagtggcatataagggatcagacagattttcaatggcataaaagggattatctctataaatatttagactttatagtctgcacgtaaaataattaccaccttcctcttaatttagcctatggtctagtagccaccatgtagtaataatataggagtaaaaactgatagtaagagtattgttaatatgaataacaaaatgaacaaataagtaaaaaatttacaggctcaatcacacacgagtgataaaattactcacaggtgaatcaaactagaaaagaacaaaatggtctagcaaaaaaaaaccatcatgaagttggggtcctgatggctttgctagatcttgtgataaggatgtagaggttgatctgtgtcttatgacagatggtggagagggcaaccgggtggcgagcgacagtcagcgataaaatcatagaaggatgtagcggcgtggtatagagatgagcttggcgatgtgcattagcaaccatccatcatctagcaaacagaaaaaaaatatgcaaaaacattcttgtttatgtcatagagatgatgagcaaaagaaaaacatcctggttgccctctccaccacataccaacctccccatctttgttgcaagatccagcaaagctaccatgatctcagcttcacggtggattttttctagaccatttttatttttctaatttgattcatttgtgagtaattttatcactcgtgtgtgattgaacctgtaaatttttcattcctatgggcattgtgtagtagtatcgcgtcaataaagacaacaactcttaaaagcatgatagtgacgacaacagttaggctaaccgtacgctgcaatctggaaagccactgtagatagagcatgaaaatcgccaatccacgatgtagtaaaagttttactagcatcaataattacatctcataaacatgcatatgtcggatgagtacatgcagatggtccttttagaaaatacatatgttagcctaatcatgacttgtacatgttttgagtcttgcatatagggatcacgtcatgtgttagacgtgtcatgtggcaggagattgaacgtgaagtgttcacgttgattacgcagttagaaacgtactgcatacatgagccaagtagttagctagttagttagcacttagcacatacatgtgttgcttgtcttataggagaataagtcttcaagttgttggacaggaggccttttgacttagtacagggacgtatagctacgaactggaggccccagtgcgaaatgcatgatagaaccctaaaattttacgaattttacatgtaaattctcacggtcctgttatcgcgatcaatgtgatatgattcatagaacaacaggggagacaaaatgatggccaactatttctagttacaactattatgctcttctacttttagttttgtgtcatagtcctgaccttttgcaggcttaagcattctatttataccactaattaaatagacttagtgctccatgcaattaaaattaatttggggggccttgaatagtcgcacactcccgcacatgctaatgtacggccctgcttagtggctatgcatgtgtggatcgtgcggccgtgtgcgagagactcggccaccacgactttggccggcgtgtatgtcacgtcgatgcctgggtctttataagcattctgtaagtgttcgtttctgagcgaagagagagctacagagaaaaaggaaaggaattagttgccgagaaaaacttgtgtgcgcgctgcgcgcatgtgcacttctgtgtactccagtgagcagtggcagatgtgtatatcggtgtcctaccatactaattatacttaggcggctatagcattataatatattggataagaagtttaatcataggttttgctaaaagtcatcgttgtcgcctgacaccaacgctaatactgtagatccctccctgagtgagcttctctgtgagtgtgtttactgctctgtgagtgtgtgctgctcacgtgagtttgatccttggccaaagctatcaacataggtgccacaacttgtaaaacaagcggtaggacctacagaaagatagcactctccagtcccataatgctcaaaagcgtgtattcccattatgctcaatatttcagcataacttatcatgacaaattttcttgttacacctttttttttttgcacatttttgtgaaaagagaaaggataacttgctgaagatgatatatcttccatggcatagtatctacctccggtggcaggaacgaaaagaaaaattgaactccgcttaggcctaactgcaaattggtaagagatcgtacaaatttaggctttaagagttactcgttaccgattccaaatcctgcaatcaaagaaactatgattacaaaataaaattatgttcccttattcctattggttgaaaaataatgtttgacagatcaaaacaactcaaaaccaaaacatgcttcgtgacagtagatcaacctatcgacagtatcatgaaattaagtagatgcatcaaaaacgcttttttttccttaaaaaatgcatttttttaatgatttccacaggttgcacaacttttataatgccaagtgccaaaggaaattctgaaggagtctgtaactagttcattatgcagtccagcaggtgcgatgaggaaattctgaaggagtctgtgattagagttccagttaatttggttggcccggcaaaaaaggatttttgatatcccctaactaaaacaaacttacacatttgttcctgctaacttataaaaaaaattcctgtacacttccctctttactgagaaacacgaactgagctcctgttctgcggcgtggtggcaggaccgctaggggattggctccgggaaaccatagtatagaaaccatatacagatgcaggtcaggtaacgacagccaggagcaataatcatagtatagaaaccatacatatgcaggagtcatacgaacatcaataatcatcactgcacatttctaattgtgaagaacaagtgcaaaatatatggtcatatcaatcacacaggattttaattcttttccccactatatattgatgttaccacttttaatcatggcatacaacctggagtttaattcttggaagtagttgcgctgtgaaacagcttcaatgtcctctaattaaatgatccctgtttagctaacttaaacagtttactggagtacctagatttatgtcagactttatacatcctaactcccaagtaaatggaacttctaaggaaacatcaagtcttatgtcagactttatacattcatgtgacactcaaccaatacaggcttaatgattggtatcttatttgaaggttagagaaggaaaatgcaaatacgcttgcaaagagggtatttggactataataggattatttatttataggttgtttatctcctagacctttactctcctagatagttaatcccccagacctttggtctaatataactcattagcattgattgcaattcagctatatatatgagagatcacctccccacattgtgtgtgaggcatctattccacttcttctacatggtattcgagtttaggctcttaccttcgtagctagaaacaggctgactgttgcatctgtagctggatctttggatcagtcgccgacaccgtccttgacctcgccatggagcaggatcagaccgctcaagagctttgggtcgccatggaagacatgttccgagctaacaaagaacgctgagcaatcttcctcagcaccaatttcactccatgattcaaggcgactcctccattaccgattactgcagaagatgaagaccgctaccgacgcccttcgcgacatcgaccacgccgtctccaactcctaacttgtg

SEQ ID NO: 75396 - DNA, 1299 bp, Oryza sativa
atgtatttaatttgtgtgtagtttttaggatttgtgatggatttgatttgtgatgttgatttgggatgtgcatctcattcgattcgggagaaaatacatagattaacactagccattagcaaatcaacaacaaaataataataaaaaaaatctcgaggaactgtcgcttcccctctttagtcccggttggtagattccctctctttactcccggttggtgttaccaaccgggactattatttgaaccgggactaaagatagcgatctttagtcccggattcgtagtcccggttggaaaaccgggactaaaggggggttatcaaccgggactacaaacggtttctccaccagtgtgagatgcacacgatagtatgcatcatacacttgttatttgactatacaagtaattgaaattcgatcaacaacaaccataaggaaagagttgaaagttggcgggtgccatgttgcacacatatggcagttgcatcaccatcttcatcatcatttgttgttgcccgagtccaccacaaatagcattttgcatgttctgcatcatttgacaactagcaccacaatggcactgtggtatcatgccttgtagttgcatgcaacattgttgttgcaggagagcaattggttgtgacatgaacatggttgcgtagctacccatgcccaaagtttgcatcatgtacagcttacagggattcatggtgcccattgctagtgttgatggaagtatggtatagtggtggtgattgcggtagctgcacttgcagaaagagctagcaaagcaaagacaaccaagatcttgtatgatgccattgttgacagcgtatgggagatgcttaacaagattactagatggtgtaaatgtagaagattatatgttgagggtgatgagataacaattgctctaggggattatttataggtaatagcaatattacacgccaaaaaggatttgatttttgcaaaactacctggtggaggtcaagtaagctagaaacaatgagtcatgaggtgtatttggacatttgttcaaccaatattttggaagaacgtggcgagatgatgctgtagatataaaggtgtttgatcaatggtgcattggtgctttattgagaattgcgtggaaacaaattctgatgataaagatataccatattggctcggcactatgttaaactaaatttgtattctaacaatattcttttagatgggtgaagtagtattttgattataagcatatatataatttgtccaattttaagagcgtgttacataagtcacgacttacat

SEQ ID NO: 75397 - DNA, 4526 bp, Oryza sativa
  unsure (1)..(4526): unsure at all n locations
ttagtttattctggtcctttcaggtttgttcatacttcataggcacttagtgtttttctaggtttgctatgttgcattctgggatgaagtcactcgtgcagctcaagaggaggaagggaacaagattggtgaaaacctcatgattggcctttggcggattattcttgtgagagatcttcctttctcagatcaacgattgaatgggaaaattcccaaggtatcatttgaaaactatgtgtaaattatcttcttagctgcaggataatattggctcaactcttcatattcagttttttttttcatattctggtagtccgtgaaaagaaagattctgagggagcttatcgtaggaatatcttagttttgatgatgtcaatgtaggatattcattttgcaaagctgatttccgttttggtgattttttttttctcttcagctgataagtcatcgccttttccctatggcaagatactcaatttgggtggattcaaaatctcagtttcggagagatccacttggagtccttgaagcccttctgtggcgttcaaactcttctttagcattatctgaacatggagctaggagtagtttgtatgatgaaggtaaagcaattgttaagaagcacaaggcaactccggaagaagttaaaatacaattggatcaataccgacaagatggcattccagatgaaaaacgattcaatggaaagaaaggttcgcttctagtcttcttttggtgtgcctatttttatttccttcttacagttgtaccatgtcttgcatttgtataatattccaattttgattggcactgatctaatgtttttttttccaatttggtttttttagttcacatatcgatatacagcaacttctacatggctatgtagctatttttttttttcgttggatcaccatctttaaacactactcacactcaactaagtcttaattcaatactaatcaccttcagaattcagattcttaggttatgttcttcctcatgtcccagttagtgatctttctatcgtgtaacataagatggtttgccattcatatactttagttcattttgtgaaagagctccacccagctctactcccagttttggtggagctgaaactgtttggctgaactccagctccaggaggggtggagctggagctgtgccaaacaggccctttatgtgagaagtcatttctatagcatttacagtgtgggccaggaaattaaaatgctggggctcacttaaataagtagaataacagccggtgttgtagataactttggttggtgttactgcacagctgtagttgtgcaaaaagcataagctataaagttggccaggctgcatgcgtttagcataaaagcgagctcctttctgcacttgaaccagtgtccagtccagtgaggcagtgatacaggacacggcatgtctaaagcccagttaccccacaggtgggctaagtagaaccagaaccaccgcccaaagtaacataatgtttcgcctcaaatcatacttgtccgaaatgaacagatatgtccttgcaattgcaagtggtcctctgaactgataagttagttaatgaattttctgcccttttttacagctctcgcagaagcttcagttattgtgagggatcatgcccctttgaccaacctcttcatgtgcctttggttcaacgaagtggttaggttcacgtcccgggatcagctgagcttcccttatgtgctgaggcgtctaaggatgcctggtgtccacctgttcccggtgtgcgcccgcaaagaccttgttaacagcttcgggcataggcgcaaggcgaagcctcttgccagggagcgaagatgagcttctgaaacttactctacactgcaattttggtaatgcaaagcatcgatcagattaaccagcttagtctgcagttgttatcccattcatgaactcttgtgtagatgagtagatgatgctaacgtagacaaaggagcacgcactcattcgaggtgcgtatctgctgctagtgtttataagtaagagaaatggttgtaaccatagtcgtagaaatgttccgatagaagaattcgtttcttgcaagttgcaatacgatactgttcattgtttggcacttgcaaacgtcgactgtagtagctctgttgtttatgcagatacagccgttggaggatttccggtcgattttgtccaaatgtgttcgccgagacagggttcaataaataccctgaactttacacatacctttcgggatagtggagtactgtactactactgcatgtacctacctatactcatcaagcgtctctctgcccaacatggtggtgtatatgcaaaagtgagaggctgacatgagggaggggtacaccgtcactgcgtgccaggacgcatttatcatcttcatttacccgtgtgtatctgaactgaagaaggttggtaggcgaagtgaatgcctctgtgttctgtgtgtagtgtgtgcccgtctatggaatgggcgtgcagggagccagagagcgtctgctcgctttgccaaacgcttccaggcaaaaacttctgctggaccatggcgataaacttctgcaggaccatgacgttcttctgattgagacaatgtcctgttcttgttactgtactcggtggagcagacgtaacagtggacgttttgatgagctacagttgagagatcgtgttcggtgttccgtcctcccttccgaggaggcacatttgcaaatgatttgacgcttcctattgccacatttgggaacgtgatagtgatacttcatactactaattcatacttcatactactaaggctgtgtttagatccaaagttccttttccatcacatcaacctgtcatacacaaacttttcagtcatattatctccaatttcaactaaaatctaaactttgcgctgaactaaacacagcctaattcatacacttggagtacagcagtagtagtagtacaaattgcaccaaaagcagttcaattcctcagctttgacttttgacgcctttctttttattagtattagtatttcttttgccgtcaactagtgtcatgggtgatcatgattcatgaaaggatgaactcaaaggaagtcgccggtgggcgctggtggccgtcgaatccaatgccgctttggagagttctctcgcactgtaccaagtgccaccaccacgtatccgaagcgtcggcatcccaagtcccagagcccacgcacgcacgatcctgtttactaccagcaaatttatccacaaaacgctcgtctttctggcacaaaagatggctgcgaaactcggcctttcgccgcttttcccctctctttttcctgccattttcttccgttgcgtcttgcgtgcagcagcagcagcagcagcaaagccacacaaggtatctggctttccctttggctcttctcgtgtaacctttctctttagatttctttctcttctcgcgtttctctgtctcaatcgccgtgtaaaaaatgagtaaaaagattagccgcacgtagcagcactgacccttcgctccgcttttgctacgggagaagcgaagcaagcccaggattcgcggccggtgtgcgtgtgtgagatacgccgtgttcttctcgcagtcgcaggcaggagtagattatgctggcggtttggtcactttaaagcaaagcgacgtgtgtttgtgttggtaattgtgatgggtttggaggctttctgtcatcaaagcgtatggttttctgcgtcaaatcttccttctgacacggttttttttactttggagtacagtaactgcttatgtacagtaaaatatttggggatgagatgttcattggtgcagcttgcttgaaaaccaagtactgtactgttttttctgcgtcgagaaaccggttagcattaatgacagcatactcagatgacaaatgcattcatatttttcagcacttctgtctccccttgatactgtagctgttcaagggtgagttgggtaggttactgttcttgagacttcacaagatctggtgaccaggtcatgacacattgacactaaatacattcgtgagctggtttatttacaccttaaaggcacatgctcctattacatgatggaactcttcatgaacgtaggccccgtttggcacagctccagctcccaactcctacttacctagagntggagctgtgccaaacggtacaaattctttgttttttggagcggagttggcagagcagctccacaaatttgtactacggggatggagctgggtttttgctgctccacagctccactccacttcaaaagacccactacccttttaaattttgatgtatttacacagaaatgccattgaactacccctaaactcctcctcctcctcccatcctctctctcctctcccatcttctccggcaagattcggcggcaaccggcggcgggcaggctggcggcggcggagcacgggctcggcggcggcgtgcgggctagcggcggcgcgcgggctcggcggaggcgtgcgaggtcgg

SEQ ID NO: 75398 - DNA, 5548 bp, Oryza sativa
gacaacacacccagcagcgagtccaccgcgccgttcgtcaggtgcgccattgtcgtaggatgcaattatcttatgatatatctctctatcttgatcttttttttgaggagaacgacggtaggagatctgccggaatttaatattagaagagaaaaattacaaagtagcacagatgtacagaggttacaagcaaaggaaaggagagagaattacagctgcaggaaaagctaaaaacaattcaagctgatcttgatcttgatcttgatctttcttctatgtactactagctggtgaatacttgggcaatatttgtatatagagtagagggaccaaattaaagtggttgatagactgtagcgtgcaaattaaggcttagcctttgtggatgctgaacaagatggtagagcttatacacgtgtacagatcgaaccagatgcaaatgctacagcaccggctagcaaggaaaacaaagcataggcgggaggtcagaatatttacttttcttttcttcttttgcaaagcaacgtatattataaccctgtggatcgaacgaacgaatttttttttttttgaaacgaaaagcggcaaaagacttgccgaatgtattaaaggaaatataaggtcagaatacataaacagaaacgcaaagaccgtctaacggtcgaacgaagaggcttgccaactaggcaaaaaacctcatgatacaagcgacttaaagaacaacagcatttaacatctggacaaattaatttggcttatattttccttgattaaggaggccacctggttctcgtcttgtgaagagtgacataaaattcttctgtttcgttctagccaaatattccaccacgttattgcaaggtctttaagaattagcttccttgtagctataggccttagcttgcataatgattcccaccaatttttgaaggtgcaagatgagctctgaagggtataggcagtatgtccttgccaaaggcaaattttgttccataccatagctgtgaaagggcattctttggctagatgagtagcatcttcgaacgaacgaatcgaatctgtcagtccaatccccttgaacaagctaagcgacctggatgatccatggcatgcaaaactttttagataatggaaagtttttattgaactcagttaattatattaatgtgatacaataattttgaaaatacttccgatctctacgtaactgagatgcacacaaccgaacatacaaaaccacactaaaaaacaagaatgacatggagtattgaggaccataaatccaaagactaaatcaccgcccatggcatgcatgtcaatatattagaaagaaaagagtttttgtcacacaatacaatcggccagacaagcctataccgagaggaggggaacaaaggtacaaataagaaaaatataagagaaaattacttcggaaaaaaaacaactctaaacaatgagagggtgtaggcggagccacactataatcaaaattcaatggcctaggctcgagaggttggtctggcgtttcactgtaatggattctcctcaaggagctccagcttgacgaccaatgtgacatggagaagattgcgcaatcgcataaaaacaaggtgaaaacggtatggaaatctttccgatagtattgataccatttccatataactaatacttcctccatcccataataattgcattcttaggaaattagagacaatttaacaacaaacacaatttaccacaatagccctatttaataattacattgtatacgcttatttcatatttatacttgattaaaaggaaggttgagcaatacattccatatgtaaacttaattaaaaagaaggttgtgggtatacatcggttaaattaaaacatgcccccaactgaagctcccacagcgatttggagtcgcgtgttcgatcgccgcgatatccacgttgcccccgaatgctcaggcagccggatttcgcaagcgctcgtggctccgcatcgactctggtcgtttttcaaaaaaaacccttagtattattgataatttgatgcaagtccccaatcgtacatttctaggttatgcagtcttatccaaaagaccttcaaaatatgaaatatcttatgctaagaagacaaaattcggaaaattggactgcgctctgaaaaacgtaaagtgagggatcattttgcaaaaatgaacatccccctccccctctcccaaactagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccgacacggcacggcacagctactgtagcggcacggcacggcacggcccgcggcacggcacggcccgttagcgggccagcggcgcactgacaaggcgagcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcaaaaatttgtttatgtcggtttaaattttcagaatggatccgaactttccataccagtcgccgtcgttcaccttgggtgatttcgaccccaactacatgtcggggtttgacgatacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccggtgtgtggcaaaacttcgacgagataaaggaaacatgccccgatggaagggaggtatcgaaagcccgttgtagaatatgtaggcaaattttatctgcttgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctacctttgtcacaagtttattatccaactgctaatataattttgcacaaccttcttgaaattgctaatttatttaaagaatacgaaaatgatgacgttctaactaaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgagagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaagtcattactatttttaacaaattcttttgcaatattttcgcaagtgtagatttatctttaaattatttcaaaataatgaatcacaatctatatttttaaatttttcaacacaacaaaaaaaataccattttttcttttttttaacattagcaaatcattacttttttaaaaaacttttatttccattttttaaataccattttttcattttttaacattagtaaatcattacttttttttaaacattttatttccatttttaattttttttccttatacatttcctttggttttttttttaaaaaaaacactgtgcactggg

SEQ ID NO: 75399 - DNA, 4795 bp, Oryza sativa
gcgacgcgggggctggccgctggcggcggcgcgggggctggccggctgacggcggcgtgccgcttggcggcggggattcttttttttttctttttttttcagatctggagctaaaagtttgccaaacacttttgatgggtctgtaactccaataggagctagctccaactggagtaggagtttggagctgggagttggagtttggagccctaccaaacggggccgtagtactatgcactcgtagtagtagtaatggccaagaacacctaacacagcaacagtgcaatgcactcgtcggtaaaaagctgaaaagaggctgtgaaagttagaccaccgtggtgattaatcatcagctaatggtagcatctttgcatcaaagagtatatccaacagtatccaactatcagtagtatccatggtggtcgtggacctttgctcccaaaaaaagacattggattcgcgtgtcttttgaccttgcaataaagaacacaacaacacccgggctcgctggccaagaccaagagagcagaagcagagaccttgggttttggagagacccaaaaaaatgagatggacggacggatggataccgatggatttgatagaaagaaagagctgtctctgcagtgcacacacacatgcatcttttgggatctcaagaagatccatgcatgcaatgcaacgatgcagcaaatgagatgcatttgcatgtgccagtggcaagcaagcaaaggggcaaagcatagtctactccatctccatgtgacatttgacattggaaatcaagattccaagctccatcacacacgccctgtgactacgagcatgtctgtctggactgccagtcttgttcttgtcggtaaagcaaaaatgaatcttttttttcaacactctcaatcttgctgtttgcacagtgatttaacttaatcactgatgagagtagtagaagtactagtagtactccctccgtctactaatataagggattttgacattttgcttgtactgtttgagcattcgtcttatttcaaaaaaaattggaattattatttatttttttgacttactttattattcaaagtattttaagcacaacttttcgttttttatatttgcacaaattttttgagtaaaacgagtggtcaaacagtgtaagtaaattgttaaaatttcttatattatagaacggagggagtatcaaaatctcttatattatgggatagagggagtactatagtgggaatagggtgaacagtaatgtaacatgaaaatgcttactcaggattttggtgcagggtgagatgtgattaatactttaatcatcatgtgatgcagtggccaatcatggatggattgacttggacatgccatgtggtggcttgtgaaaagatggcaggagcaccaatccatcaattcacaacccaaggaagagcaagaggagcagtgagtgatgtacactctgcaatagctgaccctggagaagctgggccttcttccatggtggcagccattgccggatggggagcaaagcaatgctggttttgtcctcgtgtacattagggatgggcagtttgtaataacgtgatggtactgtgtccaaagctgcagattggccatggtattggcatggcatggcatggcattgtgtgtgcctaatttaagaagcgcatggaaatcaaaccaaaatttggcacggttcaattgttcaaaacttgtctgccgtctggatgtcatataaaacagggcacaccagtattttcattcaagtggtaggcaacaagaacatggcatgtaaagggagttagtagagcgttctctattttatatatatggccggacacaatgagatgatctcgtggccatctgttatagtactaaccatttgttagatactctgcgagatgaaagttattggttctcatgtgtagcaatcataagacattctgcacactattcctctttgcattaatctatctattatattattaagacaaccttgaaagaagacattacgtttgttgtgggggctataaattctcacattaatcggagaaagagagaaaaattctaaaccgttagatcgtagtggatctaaattataacggtgtagattgatagctatatatatgtagtgcaattgtagtttttaaattataataagttgtagatgaaatatagtaatctactactcatatttggaatcaggcagattagaatcggaatttttttctttaatgaaaccgttaaggagtaggattgcagccgcgtgaatttttcctgttctttaatgaaaccgttaaagagtagaattgcagctgtgcaggagctaagtgctgaccggcccttcatgctctgctcctgtgcttattagaactctagatttactgtgaaaagcagaggctcatggcaaactaatcaggagtaaacacacaagccattgttggaccatgcatcttccgagttaccagttggcatctggccaaagcacatcttcacacattaagctttatatattacttgctaaaataattttaggacatcatcttttcacttatgcttatacttatcagccaaaatttaaattttcaactttaaatataaagctgatttaaagattttttttcatcgaagtgtatttttcagcttttgcttttaaacaaccttgaaaatataaaaattttattcacaaattactttttttttgcaaatatgtcgttaacgatggaaccgttaattgtttgttaatcttaaaacatgtatatatgtgaaagcatcctatcaatccacaggtcagattaaaaagggacaatgaggatatacattatgttaacagaagcaaaaaatatcaccaagtttgatttggagttctagaaatatcatattaacaaaagaaaacaataactatttacactattagattatgacagatctagattataatggtacagattaattgtactatacgaagaaaatctacacacctaccaatgtattgcatataaaagaaatagcagattctaaaaccacacaattatatgacaattcgatttaacatgcctaataaagaatagtagcggtagacattcgagtggagtggtagcataggaataggaagtggagggacaatagggaatataattttgaataatataactttgtttcgacgctagccatacaattgtgcgggccgctcaaccttaaaaggagtcaccatattcatcatggtggctaaaaattcttatattaataggagaaaaaggaagaaaagaactcaactaataatatactaaagactacaaggtccaattttcaaaggtttggaacttctaaaaagtaaaaaaaaactaataataatcatgttcgattttaaaatctcaatgacaataaaaaaggaggcagtgggcgagccatagaggagtacaatggcaaaaccgctgatggtttggcgggacttctagaaagtaaaaaaatgaacccggacgataattatgttcaaattttaaaaacccaatgacaataaaaagaaaagacaatgaatgggccatagaggagtataatggcagcgtttgacgagacttctaaaatttataaaaagaaacccaacaagacaataaactctaaaaattatttgatccaatttttaaaggttccaaggagaataaataaaaatagtggtagatcgagcaagtaaataaagaagaagatgacaaaagtaagggatagcaactgatgtaacgtttaaaaactatataactataaacacagggatgataaggtttggtctttcaaagtcttaagacaacgagatagctatttaataaattttaagtaaaatcatactaaaaatatatgattttgtttaggtgctagccgcgcaattgcgcaggccacccagctagttagcttgaattgacagtgcttctcatatctttaattaacatcgtctgagttgtgcaagctatcgttaaataagttatcgatcggggatgtcacacgccacggcacgcatgtggagccatgaccttgaaccctaagaacggtgtgaaatgcctacttgaaatctactatgttcattttttaggtttctcgttataaaagtgatttttagataagatttatactaagtgatgaaagagtagtaatttgcataagatgatggactgggtttttcaccttttggttcttttagaaaacttattctataaatagaccaataaaaaaacttattttaaaagtggactttttcatggcgccggtccaacatgacggcatctatgatcgttggcatcgtccccctcatccctagttggaagctaaataatttaaagagagacaacaccaatatcgttgacaccgagggtttatttgtacttttttttaaaaaaaactatttgtaataaaaaaatatttataaacagatcaaccttcaaattagtgacttactctattagcatcgttatattggaccacaacattaatgaagttggcgccgtgaaatgtttaattcctaaaataagtttttttagtctatttgtagaataaatttttaaaaaagaccaaaagatggaaaatcaaagaaggatggacaacacatccaattcatcgtactccaagtaatagtaaatgcttgttttttctacagagtctcagtacaaaatcacttgttagcgattgtttagtttggtaaagtaacaaatgtccgactgtccgattcaacatgaatactcaaatttacggctagttatcttttttccacacgaatgctaggagacgggataccgttgccctaacagga

SEQ ID NO: 75400 - DNA, 21294 bp, Oryza sativa
  unsure (1)..(21294): unsure at all n locations
gtgcccgtgccggcccgggccgtgccgccgttttggacacctatatcccaaaccctagccgccagcccactcgctgcccctccccctctctcgctttctccccctctccaggcggcgaccgggcctcgctcgattttccctgccggcgacaacctctcccgcgcgccctccgctgctctccgtcatctcctcctctcgaccctgccactccgtcgctgcagcaccatggtggagactcaccaaagcacccccactgccgcctccaagtactcctccctgtccccttcctcctccgccgccaagcagcggcgcccgcgcccgcaaagagcgccggttcgtgcgaggatgcgttggcggccaagagaggtgacgattttttttgtcttttcagcgcgtgagttggtggcatgggcttgggattgagctattaggttttgatgctttgttgcaaatcaaggaggagatagctggcggtcacagcggcggagtgaatctgcctggaacttgttcgttcttaatggcattctcaacagcactgcatagccaggggatcttgcttagatccgcttgtgctttgacgccggtctgctggtctttggttaaaaaatgccaggtctactttcttccctttcccttacctcttatgattctcttatgctttgtagctacaatggagcaatcgatttggtaaaaaatgtcagtcagtgcaagctacagggcttggccttgtgttgctggagcagaggttggcagcctaccactgctgtgttgtgtgctgcaacatttaatcaacaaacaagtactaataatctactatttatcttatgtgaactcctattatctatgctaatgttttttggttgcacaattggaactgtcaaaaatggggaagatgtgttggttgctgttctaatactatctgatcatcttcttctacaatgagaaaaaaaatgaagctggcattgcaactcttgcaatataaatcagggcaaccgtgcagccttcatatatcataatgtgtttccaaatttcgaataatatgtttcacataactgattatgatggctaggagaaatttggttctttctccagatgacgcagtaacgaagtaatgacctgataagcatgtatacaacagccaagcagaaaattgtatgtcattgttcacaagaactgatttggcaagcattttgtggaccttagaacttatatcacatttttgccttgctgcatctaacctgctccgtagaatcatttagccaatggtctgacttgtgctctctgctttctttgatgcctcaggaacattgtgctgacaaagtgacaattagtctagactgtagtcttggcctgaaacatatttccctgcaggcttagaatgcagattacaacccataacgtatatttgcaactgttgatacttgatttggtttacttctagaacataacctggaatttcttattaactgtaccgtcacccttttttacaaattgggtggaaagtgcttggctgcaaactaattgatcttattgttatgtgaaaggctgcagattctttatgcatggtcaagcagctgatagcaatgaaagtaaaagcagcgggagatgcaagtttttcttgactggcaggtagctgatgtttttctctcttcctctaataacctgaatccattaaaaaaagaaaacataatttctcttactatagttgtttattttacttgccaaaggtcctaaccacaataaaagaagtcgatagctagctacctcttgtttggctggtagtggtgttccctgagtaatgcaggcatgattgcgattgtaggagccttagggattgttcacttcatcgccgcttgcaaccctacaaattttttttgttcccaaattttgctaatttaacaagctaaatatgttcttactatctctaccctaccaaaattacctattttcttattttcaaattttggcccaactagctcctaccatttctaactttcatttcttactaatttaattaacactatgattatgttggactactaccatttctaactttcatctcttattaattaacattatgattatgttggaaatacatacctgtttaacatgtagttgccaggtcaacaatgatgcctttgttttaaagattctagattcgaaccgaagctacatcaagttacaaactaggcctcttgcagtatatgatcaagaataagttccactttcatgacatcaaatttgtatttcaactggggaaagtatttcatctatgcgaccaatgaggcatatatctatgcttttgacttcaaattcaacctgctaaagattcattggattgacttgagcatcaaaattagtgtaattagcaaagcattgctgagaatcattcatgttatatattttgcaccaaaatttgtatcatgttattgcttactattataatgaagcggttgtcctaagtgacattgagaatcagtgttatttgtaataacaactagatcatatccatggtgcttcttgttacaagaaattgatgatcaatttttattaactacatgtttgattttaagccgctgacattgtgtctatgcacagcttggtattacagtaatgtgataagtctaatttcattcactaccggagaattttgtaataattttttatacatttttttgattcacgatttcaattgaaatgaattgaaacatttggatttaatattgatagggcgcacaacgtgcgtcaaaatgtctagttctatttgttgtatcccatcttatcagaaatacaatctttttgggacaaaatttgaagggtagaaatacaattattatgggacggaggtagtataataaaaaaaaattnagcggtgttttacccgacttattacctttgataaaaaataagtttactaattatgtcagcgtcgcatttaagtaacacaaaataattaattcacaaatataaaaattcccgacatttcctaattaaggacatcccaatgccctttctgcaacacattcgagcagtacgtgtgaaagcaatcatggcccaaaactgaataaacttgtgtggcatccattgctttctttcatccatatgaaaaaatggtattaaggcggtggcggcggcggtcgacgactcatccgagacagcgagacctagagagagagctttttttttcatgtttgtgagagggcaagaaggacgtacggcggtcagatacccaaagggagtttggagtttaaaactccaacccaaccgcgcaaaaaaccgcccgtccttattcctagtggcggagctagctcccatgcaagtcgggtggccaccgggctccaccactaacatctccattgcaaatatcttttgatgttcgaaaaatactggtatttatttgggcttcacgatattgttagctctactagtgcccgttcctagcgctggttggtcgctgagctccgcagcaaagcacagcacaatggtcaataccggaaaatactaccccctccgtttcacaatgtaagtcattctatcatttcccacattcatattgatgttaatgaatctagacaagacatatgtctagattcattaacatcaatatgaatgtggaaaatgctagaatgacttacattgtgaaacggagggagtagtattcattcgtgcttcacgatattcctgctctagatctcgttattggactcgtcgtgcatgcctagcgctggtccccgccgctggacccacggtggtgacccgacgacggcgaggtgttcggcagtcagcacggcgatgcgtttcgtggagaacgtgggcccgaaaccgaaacacgcaggcagctatactggcccagtaaaaattgcgacgcgacggcccaaatgaatagattggcccacttaatctggggcgcccacatctcagggccgaggtccggagtatgagggcccctttgaattaaaggattcatgtaggaatttcataggattcaaatcctataggaaattattctgtttggccctttgattcaaagaattgaagctctccaaatcctatgaaattcctatggaatggcacattgcatgtggattttggaggaaatttagcaagagctccaacctcttggaaaatttcctttgagtctatctctcttatccgattcctgtgtttttcctgcgctccaatcaaacgaccattcctgtgtttttcctgtgtttggcaatcctctgtttttcacttcaattcctgtcagaatcctgtgttttttctattcctccattttttttgtaccctgcgattcaaaggggccctgaaactccgaagaaccccctacgccgtctgttgcttgatgcccggctgatcctattcctacctacgcttatcaatcaacaaagcatatactcgtatgatgattgatgcgtgcatgtgcaacatggcggccatgtgatgtgactgtcaatttctgtttctgcaactcatggaactcaccagcaatttgtgtctttgtcaacttatattaaactttactaactccaggaagctgccacaagaaccaaacaaaaaggaaaagtaagcaaaactagtatctctctatcttgatctttcttctattgtactactagctggtgaatatttgggcaatatttgtgtatagagtagagggaattgatcgaacaaaagaccaaattaaagtggttgatagactgtagcgtgcaaattaaggcttagcctttgtggatgctgaacaagatggtagagcttatatacgtgtacagatcgaaccagatgcaaatgctacaggtcagaatattttacttttcttttcttcttttgcaaagcaacgtatattataattaaccctgtggatcgatcgaatcgaatctgtcagtcgtccaatccccttgaacaagctaagcgacctggcatcgatcaatggcatataggctcgatcgagagattggtctggtgtttctgcgacatggagaagattgggcaatcacatgcatttccacaaaatatagggtgtaaacggtataggaatctttccgacagtattgatatcacttccacaaaactaatataacaataactaatatatctttgcttcttaaattccagatttccactctaattaacaaaaataaaactacaaaatgtgcatgtctttgctgctgagcttattataagttgacaacaactgaacagaggacaacaggatcatcagatgatcaaaatggagtgtttcactgcatgcgcagcagcaggtgactgttaataccaatgagactcagcaaacgagacaagacaaaaattctctggacagttacatatttgcttcttgaattccaggcttacacttcaacaagaacaagattaaagaatgtgtagggataacatgatgagttccagcactagacttgctgatctgttatgatagacaagaagtaaatagaaatcaccctggcatgaagcatagtggaagatcagttcgatcaagattcagagcttcagaatatttttaacagctcatcaagatgtggctgatcaagattgggcaatatttgtgtatagagtagagggaattgatcgatcgattgatcgaacaaaagaccaaattaaagtggctgatagactagcgtgaaaagcttagcctttgtggatgctgaacaagatggtagagcttatatacgtgtacagatcgaaccagatgcaaatgctacagcaccggctagcaaggaaaacaaagcataggcgggaggtcagaatatttacttttcttttcttcttttgcaaagcaacgtatattataaccctgtggatcgaacgaacgaatcgaatcgaatctgtcagtccaatccccttgaacaagctaagcgacctgcatgatccatggcatgcaaaactttttagataatggaaagtttttattgaactcagttaattatattaatgtgatacaataattttgaaaacacttccgatctctacgtaactgagatgcacacaaccgaacatacaaaaccacactaaaaaacaagaatgacatgaagtattgaggaccatcaatcaccacccatggcatgcaaaacaaaaaaagaacatctttcccgtcatcaatggcctaggttctttgttttgcatgtcaatatattagaaagaaaagagttttttgtcacacaatgcaatcggccagacaagcctatacccgatggttaagggtccgtctgactcatccgagacctagagagagagcatttttttttcttctttgtgagaggacaagaaggacgtatggcggtcagatacccaaaggaagtttggagtttaaaactccaactcaacagcgcaaaaaaccgcccgtccttattcctagtggcggagctagcaggaaatgctactgggcgagcgatcgccctcgcttgcccagagcgatcagtttccacccccccccctccttccctccctccacctctccacctggtttccttttttggcaccgcattacttttctattttagtaaatttatacacctaaagtttatacacctaaagtttacacatctaaagtttagataccaaaatttataagtcaaaagtttatatatccgattcaaatttgaatttgaatttaaatattttttttatatatagtatttctatacatctaaagtttatacacctaaagtttataggcctaaagtttatagacctaaagtttataagtcaaaagtttatatacccgtttcaaatttgaatttgaattcaaatatccgattcaaatttgaatttgaattcaaatatttttcatatatagtatttctatacatctaaagtttatacatctaaagtttatagatctaaatttatagatctaaagtttatatacctgattcaaatttgaatttaaattcaaatattttctatatatagtatttctatacatctaaagtttatagacccaaagtttataagtcaaaagtttacatactcgattcaaatttgaatttgaattcaaattttttatatatagtatttctatacataaatttttctaacttttgttttttaaaaaattttgtgtggtctactgtagtagaaagaggagaaggggaggagagggaggagcatagggggaggggggccggatccgatcgctgggcgatcgcccattagcccccctggagctagctcccatgcaagtcgggtggccacccgggctccaccactaacatctccattacaaatatcttttgatgttggaaaaatactggtatttatttgggcttcacgatatcgatggctccgcgcactgctctagatctcgttattggactcgtacgtcgttattggaccagcgctaggcaggcacgacgacggcgaggtgttcggcagttggcacggcgatgcgtttcctgaaggatgtggggcccaaaccgaaacacgcaggcagctatactggcccagtaaaaattgcgacgcgacggcccaaatgaatagcttggcccacttaatctggggtgcccacatccgagagccgaggtccggagtatgaaactccgaaccccctacgccgtctgttgaattgcttgatgcccgtctgatcctacctacgcttatactccctccgtccaaaaaaaaaagacaaaccctgatttccgtgtccaacgtttgaccgttcgtcttatttaaaaaaattatgaaaaaaattaaaaagataagtcacacataaagtattaatcatattttatcatctaacaacaatgaaaatactaattataaaaaattttcatataagacggacagtaaaatgttagcacgcaaacctacgtttttttttttaaagacagagtgagtaattatcaatcaacaaattaagcatgtactcgtatgatgattgatgcgtgtgcccgtgcagaatgatagccgcgccggcgacggcgatgcgtgcgtgtctggctgaagcaagcaagcggtgagcaatggctggaattaattaagcctggaacatggcggccatgtgatgtgactgtctatttctgttaatttctgcaactgatggaacgtaactcaccagcaatttgtctttgtcaacttatattaaactctactaactccaggaagctgccacaagaaccaaacaaaaggaaaagtaagcaaaacagtaagcacttcctctgtctcaaattataaaattataaggtctatatttttctagcacggcctttaatgacatactttaaccattattttattttatgttatgttttcaacaaatattaaattactataacataaaagtactttgaaatattaatatagtgatataacccgtataatacttagtatatatgattatcagttaaaagttatcgagtttgatttttctttaaaagagggagtactccttagttataagttatgaagtatactaataagcagtccgtcctgttggtgcttaatttgcttggtgataaactggtaataatatgcacagtttcagcactagagtatctgaatgtttgtcatagacagagaacaacaagatcatatgaccaaaacggagtgcttcagtgcaacagcaggtgactgtcaataccaatgaaattcagcaaacgagacaaagacaacatatattctctggacagttatatctttgcttcttaaattccagatttccactctaattaacaaaaataaaactacaaaatatgcatgtctttgctgctgagtttattataagttgacaacaactgaacagaggacaacaggatcatcagatgatcaaaatggagtgtttcactgaatgcgcagcagcaggtgactgttaataccaatgagactcagcaaacgagacaagacaaaaattctctggacagttacatatttgcttcttgaattccaggcttacacttcaacaagaacaagattaaagaatgtgtagggataacatgatgagttccagcactagacttgctgatctgttatgatagacaagaagtaaatagaaatcaccctggcatgaagcatagtggaagatcagttcgatcaagattcagagcttcagaatatttttaacagctcatcaagatgtggtgctacagaatatttgaacaggttgatcaacacaactgaatcctcttgactcaccattaatgtagaggctacagcatctctcccttctgtgtcaaagaaaaaaaatcaacacaacagcttagatattacagattcagtgcacttctgatgaatgaggcagcgtagattggtaataaaataaatataagagtatcaagctacctaggacgacacgaatacgcgtagtaatatttggagaaagtcaaccacgcgttccatgttaaaactaatccacaataatggtcaacggaagatgggtcagctgttccatgcagccatacgacgaatgcaagccactccacatgcaggtagctagctagtcactcctacttagcttcactcccttagcttgcttggaatgatcaccacgcactgagagtctgaaaaccaaccagcaaatcaagctttgtggccaccaggcgcctgcaatggcggagctcgtggtcagctcggccaagggcgccgtgaggtcgctgctgggccgcatcagcaccatgctcgtcaacgaggcacagctgcttggccgcgtccgccgcgacatgcagttcatcaaggacgagatggagatgatggacgccttcctcctgctcctcctgcaccagcaggccggcaccctcgaccaccactaccacaaccaatgcacgccatggatcaggcaggcgatggagctcgcccgcgactgccaggactgcgtcgagcagtacgcgcagtgcatcgcagctgggccatcctccaagagcctcctcctcggccgcctccgccgggtgtcccggcttgtccggagcctccccgaacgccacaggctggccgtgcagatccaagacatcaaggtccggctgggcgaggtgagccaccggcggaaggcgtatgacatttgtgccaacctcaacagctaccgtccacctgagcaggacaacggcggtgaacaggaagatgaagctgcttggaggcgttatttggcttctgctgaaccaccggccgacctgaagaacactgtgaacgaacttgtcaggtggctcatggaggatcaacctgcagggcttagaatcatacctgtggtcggaatctgcgtggatacaagtgcgattattgctgagagagtctaccagcactcctctgtcaccagcctgtttgactgcaaggcttggatcactgtccgtgattgtcaatctcatcttcagattctcaaagatatactatgtcaacttgttctccctctgaacaagttcaggagtgagatgattggctggaacgaggagcagttggtggaaaagctgcgctgctatttgcgaggtaaaatcttcctcattgttcttcacgatgtccgtgatgaatcaatctggagtcatataaagcttgccttcccagatgattgttctgctggtagtgccatcataatcaccacagatgatgataaagtggccgagtctttctctgcgtataaaatcttcaacccagatagccccggttatgttctcgatttcttccttagtaaagctatagctctgcttaaacatgaaaatgaaaagcagctaaggaaaatcctaccgtgcatgctgatccatcttgaacctgaaaccttttttatgaagatgctccttcggtacctgtattatgggagatatgctacgttacgactgcgtgatgcactgcagcatacgtcatcgctgcatgattattggcctaagaatatggtatacttatgctacaattatttgcctgataagtaccggagctgcatgctgtatctgtctattttcccacctggttgcagcatcaggaggaccagcttagtaagacgatggattgttgaaggcctcatcactgatgagcaagagaggagtgcactaaaacaagctgatcactgttctgtccacgcgacatggatgcttcaggcaagttcaggacctgcatagtacctgacttggttcacgatgctcttactgatctggtagccagaggaagcaacattacttctgtggacacagttttggcgccaccagagttggcccgtcatctttcaatccgcttcagcacgaagttgcacatgtctccatctgaaccaatcaatagtattctttcctttctcaagtccttgcattcatcatctcggcttgggctgcttaaagtgctagatttggatggctgcaaaggtttgaagagacgccacctgaagaacatatgtggcatatatttgctcaagtatttgagcctacgggatacagatgtcaccagactgcccaaggaaatagagaatctgatctacttggaaacacttgacatccgacagacgaagatcagtgtcttccccaggaaatctttagtgctccctatgctcaagcatttgttctcaggccatactgtctatccaagtgaagacattttcaggcagcaggaatcattctctgccatccacattcctcaccaaatcgggaggatgaaaaacatggagatattgtcccatgtcaaagtttcacatggtggaatgcagttgattgctgttggccagctactgaagctgaggaagttaggtgttgtcatccatgacacagataaagatggttttgacagtttgcttcatgtaattggcaaattgaacaaatgcctacgatctttgtcagtccagattagatcaccttctgctgctgatggaagcaatggctttgacatgagcatgatgtacagcacatacccgaggcttcttgagagcctgaccatctgtggcatcaaaagtggattgcctccctggattgaacatctccaccaacttactaaggttactctgcataatacctccctgacagagagtgctatccatgtcctgggcaagctcgtgggcttgtgctatcttaggctccgacacaggtcatacatccgaggcgacctcaccatctctacaagggaattcaaaaacctcaggttccttttcattgagggcccagacattgtcaacatcagtttcgatgagggtgcagctcctaggcttgagaggatggtctggcgtttcacgagaatggtttctcttgttgggattggtcacatcctaagcatcagggagctcgagcttgaaggagacagtgacctggagaagattggggtgattctccgtgacatcaaagcacaccccaatgaccccagtctgaagcacattccagcagcagggaactaatcatgcacaaggactggtgcctacggatgaagcaaactgaaaaaactgccgtggcttagatccattatgtgcctggacaaacaaggatgattgacattactatttctttcccactttgagctgcttgttgatgctgctgctcctactacttctgaagcacttctactgttagtatggaataaagatgctgaagggggcccttcttcctcttccatgcatggattgttggctttgttgtattgtagcaccaatatttagtatgcttgtttgtttgtctcctttcccaacagtcatgggttttcctgtaccattcattagtaaggcttttgaaagaattcctgtgtttatcttatcttccttgtacaagaaaaacttggtgttattgcctaaagcttactcttcctcccttgtttctgtacacagatatgtttctcacttggcacccaataattaccactgttgtcaataatcctttaacaagtaaacaccggcctagaagcatcatccctccaaatccaagcctcttttagctagcaacgaaaaaaaaatgcagctagctttctgacagaaattcagaatcagcagacatgtgagatgaagataaaaagggggaaatggtacgagtcctacatgttacagagaagtgccaaggtattgctgcgagacttttcatcaaaccgaacaaaaggtattcagacataagcactgtaaaaatactgagaagtgattcttctacatggaatcgccaaaaaaaaaaaagaagaggtgggtgaattttacctagggctgattctcttccctctccggtgagaggttgggctatgtgggccaaaaccgactgcagctcatggcccagtaaaatgcaccgcgatggcccaaatacttagctgagttgctcgcttcttctgaattctgatagtatgtgactcagtaaacacacgctccaatatgcacactgtaaagcattccagatattgatactgaatgaatacctttatgaaccaaattatatggagcatacaaagaagctgcaatgacatgtatgtgaccgttgatttttttgataaacatttgaccatttgtattattcaaaatttttgtgcacatataaaaatatttaagtcatgcttaaagaacatttaatgataaatcaagtcacaataaaataaatgataattacataaattttttgaattagactactatccaatgaccatatgatcgacctaccttcagctccaagcctccagctctgcgattaattcaattaatcatgcatccatgagcctggctgaatttgtattccagtaggcatgtgactccagtcaaatttgataaacaacacatcttggatgaatagaggcagcatctggtacacaacaatgtaaacaaagacagaaccaatcaatgttactttccagctagaatgcatacatgcctggtattattctaggttatcttgtctttttttttttttcagaagtatcattcatactcaaaacaagtcgattcctgacttgttcaaaatccacatggctgttggtcctagcagactaaattaaggatttcataaacaaacagaatagacaaatacataccaactacccccgctactatattacaaatcttgttcccaccaaattcagtgtaatagtttataggtgaggtgacaccaaatagtccgaacagagaaattggtggtaccaaaagtggggagaaatcacaaaatggaggttgatatgtaatgtgttgacgattcacattgcaagtcatgaattgatttgaccgtgtttggtgtaatgtaatggtaccttagaaaatctggatccttgtgattctgcttagcatgtggtcacatgcttgctgacttggtaatgctaaaaggagatggagctggggctcattaaatagatgccagatttctagtagtatactttccccctctccagttgcacttgcacctgttcaggttgagttcatccttcccacttagctgccagtagtggccatggtgtgtgtctgatgagcgagctgagtgagggagatcccggatatggacgggtttggcctgagctccacccactccgccgtgaagtcgctcgtcggccggctgaccgacgtcctctccgaccaagtgcagctgctaggcgggctgaggcgcgaggtgcagttcatccgggacgagatggagagcatgaacggcttcctcctcaatcatgcccgcaggggccgcatggaccaccagctccaggcgtggatgaaccaggtcaaggacctcgccaaccattcccagtactgcgtcgaccagtacttgcggtgcctcggcaccaccagccaccgctcgccgggtggcctctggggctccgtgcgccgtctcccccggttcgtcagcacgttgccggcgcgctaccggttggctatccaaatccaggacatcaagatccgggtagtggaggttagccagaggcagcagaggtatcctctccatggcacggctaccgagcaggagccgcagtctggcatggccagcgatcatagccagcaagctttccttaccggtgacagtgaagccgatcagcaggagcatcttcggaggcgtatcttggccgaagacgactctggcctgttcaaggaggctgctgatgagctcaccagctggctgacagtggaaggagatggcagatcagatctcagaatcatccccattgtcggctcccgtggcatgggcaaaaccactcttgctgagcaagtgtacaaaggttattcctcaaggttggcagaccacaaggcatggatctcggttggctccaaccaatctccacagcaagtactccgggacatactcgcgcagattgtagggcttcatgctaacaatctgcaggacatgggaacatggggaaacagccaaatcgcactgatgattcaggagcagctggaaggtaaaaggttccttattgttcttgatgatgtctgctccgagtcgctctggaaagatatcgaagcttctctccactgcggtaattctgctcccagtgctatacttgtcaccacaagcttgcctgaagtggcacagtcattttgtccttacagaatatatgatctaaggtatatccaggaggagcataaccgctccttagttgatttcttcctcgtgagagcagctaactttataagtgacaatggtcatggcaaagctagtctcaaggaggaggttcttcgcagcattttagtaaaatgttccccctgtatctttagcatgaagatgcttctccgattcctttatgcgaatcctaacaagaccctacaggaactgcatgacttcagcaacagcctgtgcttctgcagccctctgcatctgtcttcatggctgtccaatgccgagaaaatgctcacattctgctacaacgccttgccttgtgattacaggagctgcttgctgtatcttaccattttccccaatgaccacaatatcaggagaacgagcctgctcagaaaatggatcgcggaaggcctaatagctgaaagagatggactgagtgcatttgatgttgccaaccgatgttttgatgctcttctcgctcaaagatttgttcttcctggtgatgttggaaattcaggcaaggtaaacagctgcagagtgcacaatctagtccgtgacttcattgcctgggtcatcagagatgacaactttgtgtacacaaagctaccagtcgacttggctcaccgtcttcccatccacaatggagaaagactgcagcaggtctcgcggatcaaacttcgtgcttctcatttcgacgattgttggagcatgacaaggtgttgcttcacaacgaagtcagtggatcccttggctggcatatccatgttacttagatcaattcaggaatctgctcaactaggattacgcctcaatgtacttgatctagaaggctgcaaaggattggagaagtatcacctgaacagcgtttgcaagatatttcaactcaagtatttgagcctcaggaatacagatgtttcccacttgcccaagaagatcgacaagctacagtacctggagacacttgacatccggcaaacccagataaaggcattcccaggaaagcattttatccttcctgggctgaagcacctacttgctggttgcaccaattgtcctagcaagaaaaataatctcatggaaaaggaatcttgctcgttttccactgtgctcatgcctcaaaaaattgtgaggatgggaaagttggagatactatgctatgctgaggtttccagtggcctcactgggctaatgggcatttgtcagttacgacgactcagaaaattgggagtactcttgcaaggtaatgcagcttgtaatctggattacttgttccgacaaatcgatatgttggatagaagcctgcactctttgtcaatccggatggaacgactgaagttagccaaagacgatgctcgcaaaagggatgacatggtacccgcgtcatttcccttctcacctccaaagtttgttcagaagctaaacatcagtggcatcagaagtgcattgcttggttggattggtgacctccaccaactttccaagataactctgcatgagacttcactcacggaacatgttctcggtatcctgggacagcttggcagcctgcggtgcctcaagctccagtgcaattcaaccatgggtagcagtctatcgttcaggagtggagcgtttcggaacctcgtagctcttgttgtccaggacaataacctccttgacattatctttgattacggagcagctccaaggcttgagagagtgatattgtctatcgccgccattgactctctgtctggagtacagcaccttcagcagctgaaagagctcgagctccatggaagtgcaagaaacataggcgaggtcgaacaggccatagcaggacaccataataatccagttttcagacacgagcaatggaatgatcttcactgaagcttccgaaattctgaatgtctggtgcttgcatctgtgttctacaatgaagatagtaataagtggacgcaaagcaaacctcttttttcttgatgcatccatgttaaattttacttgtgttggattttcagtttgtttgatttatatgtatcctccacagttgccactattaagcttgttgcaactatatcttccggaagcatttctgttgtacaaaattttccttagtcttctcattaaaatctcctgtggatacatggcaaatatcaccagtgtacaattaaagcaattcacatccatttgcattagtatacaccaacgcaccatctagtcaaagattgcaccatgtcaagggtaatgctctgtttagttgattgcatgctaggcaaagaaaaatgcagcagaattcctgacagaaatccataatcagaaggcacatataagatgacccaaaccatcagtagtgctggtgggtgagaacggtttcagtccaatcatttcatcagcatctaagattccaacatgatatacagaaatccaaggtgtagctgcgaatctttcatcaaaccgaccaaaatgtattcagaatcagtattgaaatgaaaattttctacttggaactgcaaaaatggggggaaattacacctacagtacacgcgcgggtgtgaatcgtcccacgcattcggcggaggcgagatacccagtaaaatcacgattcacccggccgagaagaaccaaaattttcccctgaaatccgccgcggcacatgcagttagtcatccctctcgctccgatctcctaccaaagtgcaggcgattgatctaacaatcgaagctcgtaaggctactactactctactcacctgccaacgccggccagcagcaaacgtctacattgcatccttcctgcttgaacattcatctccgccgccgccgccgccggcaaagcggcggtgccgtgctcgacggcggtgaagagggtggtccgattcgttcgagaggagaaacagagaaggctgcttgggccgtggtgggctctattaaggcaacccctaaatgggctgggcctcatttgtttctgaaaccgaggtcgtttcgcgaaggagatccactcaatctgaaccgcacgcacctgatccaacggctagtagtgtcccaggaggttcggagtttaaaactttgaacccccgctggtagcaaagaacacacgccgtgcttccgtactgtacctcgccggagcgccgccgcatcctggccgtctccgaccatccggcccgtccgtcaccgcgccaccgcacgcatcggcgaagggcccttgagagctagctaactcctgcaaacatgagcatggttaggagtggagctagaaccaaatgtggttccaatcgtttgctttactctattttggaccgagtttaaattgatatgggtgtctaggtttgaaccgagggagtgcacatacgatgaaaatagatgaattatatctaaaagaatttttgaatcggttttctgggcacacctcggacacatgtagcttggcatctgagcatgacagcaagtgcagtttaacttcagatttgttaggattctgggagaaattttccagtcaagatggcactgatgtctgtgcatctcaaaattaacatagaactgaggcagttttactcaattcattaaccaccgatagatcgaaagggcgaaacagattgcttatgtttgccgtgaggtcgaaatgtggatggttaagaaagctagtgatgatccatctgccgggaagtacataagacagtgcggttctgaagaaacaggcggtaactgtaccaattctaggaatcgattggacttttgggttcgatttgcgttgataaagtgaatggtagtatatatattttgggggaactatattagattgccatctcttgtttctcttccatgtcacctaaatagtcactaattttttttaaaaaaaagcatatattaatatgaaatatatcactacacaaatatgtaatattaaattcaatttctacaatttacaaataaacataaattaaactaaaaataattagcatacattcgcagttatacttgttattttgttacaacttgtaaatgttgaatttgaacttacatatttgtggagtgatatattttatattaatatatcttttcaaaattttttaaaaaaaattataactattaggtacatgcaagaaacggatgaaaacaatttcctttttttttttttgcccagggagagaatttaatttgcatgcatgtatgattgaagtcctaacaatcaggtgttattagtcgcatgccaacttgattaaggctgagttcttttcctaactttcccaactcatcttatcgtttttcgcgtatatgttttttaaactgctaaacggtgtgtttttcttgcaaaaattttctatacaaaagttgctttaaaaaatcatattaattattttttaaaaaaataaataatatttaattaatcataagaaaatgtgtcgcttcgttttacgtgcgcgggagatgagttctcaatcaatctcacctctgaacacaacctaattacttgaactaatatccaaaactaaagtcaacacaaagataaatattggataacctatatatctgttctatcttgcatatgcatgtggacggacgtatacaattagcgggagaagctagatgcgtgtaaacgtaaagccaaaatgagagacgaacatcctaacaaccaccaattaattatcacagattaaagaaagacttgattgaccgagctaagtcagtcttgcaaatatattcacaagtgtttgcattgacaaattatttagtaagtatacgtactccagcaagctagcttttggacagtggaagagagacaacccgaccctatatatacattgtacaccgggaagggatattattatccttcaaaatctcatataagtgttcttaaaacagatcatactccttccctcccttaaaaattacagtttcagctagtcaataacggattaaaacagtactatgcctttcattaatgaaaaaaatgttgttgtttttttttgacaaatttctagactaaaactacagtccttaaaaggagggagtatataaatgcaaacaggaaggttgttgggaggctgggccaagctaggctcctccacagaatatatgatcatgcatgacgtacgtatttgctagtcaataacggattaaaacagtactatacctttcattaatgaaaaaaatgttgttttttttttgacaaatttctagactaaaactacagtccttaaaaggagggagtatataaatgcaaacaggaaggttgttgggaggctgggccaagctaggctcctccacagaatatatgatcatgcatgacatcattgattttgtgacaaatgtttcatcattcatcctattcaaattattttacaattataaaaatatttaattatacttaaaaaatatttgatgataaatcaagttataataaaataaatgataattatatttttaataaaacgaatgaaaaaacgtataaaaaatcaacagtattatatattaaaaaaaggatggagtagtacttgctatgtgtgtcctgacataataacacacgattgatgacccctcttaattagtccatatacccgcaatagttttaaaatttatccctagttcatggaagattattatctctgagattttccgcatcaattgcaagaaatgacaataggtatgatgtctaatgttcttgtcagcatgtgaactgcatggcaataaaactattaattagcacgtcaactctgcatggtcgtattagtgttacttaatcttttggtgcatagattaatgctaccagctgtacttaatttatattacctacatagcattttttttatataggtggtatattttattttgaaaagtcttcaccgtcacgctttggacgctgatttgtcgtaatatatattcataattactactccctccgttttttaatgtat

SEQ ID NO: 75401 - DNA, 3872 bp, Oryza sativa
agtgtagcagtagtacttgctttgttccattctttagggtttgtgcccctaaagaatggcttaaacattctttcggcaaatgcgtgtgctcttgtctttaatgactgtttgtcttagcagggtaggagtaggttctagccttttgttcctgtagtttgtactactactaggatcatttcaggtttgggttgctttttcaaagacaaattgcgtgaaatatattcttttctgcatgttttgtttattagtgtaaacattattgtttgcatgaaatgtttacagtgtcacattcagtactgttttcacaaaaaaattttaccttaagagaataagagtttgtatcttctctttgaaaaatcgtacagaggatcatgtgtgcatctctttttttttaatgttttgtttagtgttcaaattgttgcatgaaatgtttacaatgtcacattgggttctgtataaaacattattttaacttacaactactgcatctgtcccaaaatatttttgaatggaggggagtatctctttttattttacaaacaattatgtatacagcggcatgcagactcgaaaactgtactacattttacggattggcaagtgccaacctttgggtaatataggtgttatggtacatcacgattgcttgagactcaggagtcaggaattcaagatagctgcaccaacccattgcaaatttgcaatgcaaaaggaatatatgagatggttggttgcattagtgatgagttccctttacttccaaatgccaaccaattttagtttgtacaatcaatgtgtggtactatcacgggatagtatatgtagcgtaaacctataaactattgtaggatacacaaatggatgtctggaatttgttcacgtccccctgattaatcttttacttctagattaaagtatgattatttttttattggctaaatctcagatgataatttgtgtatcatataacagttttcaggtttgtattacatacagatggtttgcactatatattttctccgctatcgttgtgtctctatctccaggccatttctagtcttctctacatgagccaatgggaagttggcttgcattgaaatttgcatcattgttgaccatagtggaaggacgagtgagtattaacaagtggactcattagtcattagtcatggtggttagtatgcacgtacgctgattaatttgaaacaaaccaataatgatgcccttctccaaatggcactgcagactacctgctctcggctcatttgctggtctgtcagtatcataaaacaaactcatcgcagggcagaaaaaactattatggtcacaaagatttctgaagagctatgtcaggcacatctggaaacctgcctgttccattaagaaccccaaactccaaagtgcaatttcaacatactactaatattctgatgctgaaatccctcaaccaagtttggtagacaataacctaatttaacaatgctgatgttttgtcggttaggtatgcaagcttggctctattagcagctggatgcagtaatcctgagttaatataatcccacaatcttactgctgctcacaaccccaaaaactgttactcgaggttggttgaggtagaaagcctaagacacatataaccaagctgatgttagaaaaaaaaaagctaaccttttcctagttttgcaagctgcagaatacaaagaagccgggagggattaaaattttcagacctgtggatgcaaaaaaggtacagtgattagtgtatactactactactccatttatccagcaaagaaccaagggaaaagttgtgcgtggcattttcacgagatgtcacagtcaacggcctttttgcaggcgccctaaacactagtgtgcgtcactggttgtggctgtgctgtatataacgcagagtgcggggtttctgcagagctggagtggagaaaggagagacctttccattccctctctgaaaaaacaacaatttagtttttgacctgaagggtggtagtagtgggctagttggcggtagatggcattgacactggttgccaagcacagtgcaggttttgttggagcctagtgtggcttcagagctcagaagcagccacatttctgcattcttggatcatttggagctctccttgtttgttgttgggtctcttctctttcctgcttccgagttctgtgaaccagccaactaatctctgtaagttctactatcttgttcttatttctcctgctcctttgcccccaaggatatggctactactgcttgatgtcctgttgcttagagtgttcttggctggttgctttcagttcttgattggttcataccttggtgccaagaaatggaggtggaggcgatggagaagaagggacacagagcctttgctaaggcaattaagtctttcggttcttcagaaaggcacaagcgttctaagaggtttgtgtctttggatttcttatgcaaagttctctgtttctgttgttacgaatgctaataacgagatctagatgtttttctatggcagtgatcttgaggatatgtgtgctaaagatgcgctgtatgcttcagataaaacatgcgttcagcctaagccagtgagtttattttctgttctctgttctctgttctgtcttccacgtttttctactgtattctgcagtaaatgcataatagttctgcatagtttcagtaattttgagcattctgtgttctggtttactcaggatgctgtaaaagttaaggtaaaaagtgatatcaacgctgaagtgcaacctgggagaggagcgcagagcttcttgagaaaagaggtaatgagtgtaaaattctatttttcttcattgattttatcgccaacctgccctttctggacttaaaaatcttttttagtaggaaaagaaaagaatcacatttcaattacagacaggaggttgcatttcctttttgtatctccatgcttgccaaatgacactttttttttaaattttcgtttttggccgaacaatgcaaatccttaaacagaccaggtttttttttgtttgttttacaaacaaagcatgattttcccagtgaaaaataatcctggtaaaaatttctctgcaaatggtctaggataatgtcacttttctgctgaattcaacatagtttagactcatcatgacggcctgatgcagattctccagctagaaaagcacctcaaggatcagcaggtcatgcgtggcgccctggagaaagctctgggaccgaacgctactgctgctccagtcaacgtatcaaacgagaatccaatgccaaaggtaactcctttgcctaaccacatgaatgagaattcaccaattttaagtttttaaccccttacctgagcaatactgatctgaagataaaatggtttttttttcaggatgccaaagaacttatcagggagattgctacactagagcttgaggtgaagaacatggagcagtatctccttaccctgtacaggaaggcctttgagcagcaagtgcccacattttcccctcctgaccaccggggagctccgaagccgccggtaccggcgatggcggcagtgagctcgcagcctgtgcagctgcagaaatcacccagtgtcaaggcatctcgcaagaacaacagagctgacgcaatgctgcgatccagctacccgccaccgtcccgtaggacgttgaacgatccagtgatgacggattgctctacgtcgggttgctctagcaggctaggtgaatctgatgttctccggtgccagtctgcggtgtcgtaccgcggcatttgttcgtccaggatttcaccatcggaggacagtcttgcgagagctcttcggtcatgccactctcaggctgcaggaatt

SEQ ID NO: 75402 - DNA, 1188 bp, Oryza sativa
tccatcttcttccacttccgttatgatgtgccgaccctcaagcttcttcggtgcacctcgttgcccgcgtgcctttttctgtctaacggagggttgactaccactagcctcctcctcttggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcattgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaattcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagttaataatgtcatactaagtctaatttgcaataaaataatcttatattaaaactcaaataatattagaccactacacaatcttatatgataagtctaattacaggtctaataatcttaattaattgcattacaaatataacaatcatttatattattacgtcacttgcctgctccaattccttctagggctagctcttccactccggcttgacggtcgactccgacaacacgtcttttatgaaagatacaaaaagatgtattaggataaatgcaaagtaacatatatatatatatatatatatatatatatatatatatatatatatatatatatatatatatatatatatatatatatatat

SEQ ID NO: 75403 - DNA, 23860 bp, Oryza sativa
  unsure (1)..(23860): unsure at all n locations
cgttatggacaaggggatctcatctctcacctgcttttattgacaacaagatgcatctatacatcactgtttggaattccaagcttttaatatcgtccaggccaagaacagctagctccttcgaccacaaggtttactatatatcacccgaaatccacctaactcttaatactcaaacagtgtcgtttcttgatgcagctagacattgccaatgaaagagagtttaattttgaggtgttttaggcttgtagcaatattaacaataggggagccactacaagtatgcatagttacatatgcaatacaattaatacatacagttcgtgtcgaccttttacggatctctgttctaactttgcagatctaattaaccatgaattattgtttggtccttgcagaaactaggtccttggaacaaattaggtttgtttggtctgaattttctttcttttttttaatctcatgtagtaatttgaaaaaattatgcatttcagtattacacatgaaagagcaatatacataggtgaactaaggatgaaaacgttcaaaacgttatcatttctagctagaggaatggttttggtacggtcaaaaaaatttcatattggccaaattaactatttgattaaatttcacaaaactatagatactttgattaaattatcaaaaaactatatatttaagatgatgcatgtatcacaaaattataggtttaacatgaaattcattccggactacagatttaaggtggagtatcataaaactacagatttaataacaaagttaccaaaaaaaacaacaagtttagtatcaatttaatcacaaaatttggatgtttataattcaaacataatattagtgctaaggatttaaacccaaaatctatagttttgtgataattagccttaaacatgtagttttatgatatattacctgaaatctttagttctgtcaaatttactcttaacaatttagtgacaacttcaatacaatgctgatggaattaattaattaattaaattttatatatagctagaatcggaaaaacggcgtcacttttagttttacgaaaacggtcttggtactgtcagaaatttccaccgccattttttaacccccctataggtgataaaacaaacaacctagtaaacttttaattctgttggaatttctttaaaatttcttcgtaccaaaagagcttcgtagttgaactgcatcgtgtatagtaataacatggtcagtactagtggagcagtgtgcttcattcaatcactcaccctctccacataccatcaaaaatatataattaatgttctcaacaaccaaaagataagattatacctagtattacatacatccactttgagtcattaggaataacctatctactggataatactaaacaaagcagcaagagttggtcacacaacaaacatcagagtgattgccactgccaaaaccagctagccagccaatctctctccctctaattaatcctccataattaacaacagttcccccatgaccaaccaaattaaaaatgcttaattgcaggttggctaaccactgtttggtcggctgaacgtgtgattaggcttaattaatcctcattacccctgatggccacaagggtttgttaaccaaatcagaggatggaggttgggttattagctggagtattgcattgcatgcatgcgcgtgtcattattattttggaatgaaacgtttggtacacaaaaagcataggggagcagcatgattatgatgtgatggttagctagctactagtactatattactactactagctgattaataatcatcatcatgtgtgattagtttaggtggtaattattaaccaaattttggtgataattatagtattaaccacgccggataaggccactactcgccggcgattgcggtggctatgtgtcacggggtcctattgactggagctttggattgcatcaaggcttggcacttgtggtattttagccctgtttgtttaagatggatatgtttagttaatcacctaggttactagttttagatgtcatgtgaggtaactaactttcacatgaagaaatcaattgaactctggacaacaacatgcagctataacacgtaaatatctccccgcaaaaaaaaacacgtaaatatctatctatgcaaaaaaagcccttaatttctagctgttaaagtttatcttaatgttttttaccctcttatttctacaaaccgaggtgttgtatctcaataatcttacattttttcacctgacattgacaatactactttcttattagcgaaagttactttatttgttttctttcattactaaatgttctcaaagaaattaaggttatttttattggatagttgagtagtaaagacggcggcggcaatctttaacacactatatagttgatctatttttatattttagtggtatggagtttaattaggatgaacttccgtgataccagcgtaagtgcattgacgaggcatatgattagagtgaaggaggtccaattagcagatggattagtaggcaagaaaggaagagcttttgccgcttaaaacgaaggaaaagtatggatggagagacgagaggagaggaaattatgccgttgcccccaaaagctgcaacggcatcctttgcttcccgcttttcctgtagctttatttattagcgtagggtgccacccaacacaaatttgctctgctcacccccaccatcttctccactattggttagtatttgtgtatcatcattatatgagttctaattttgtttagagaagggttttttttacccggcctttacatccaaccggatatatgcagccattttatattaggaacttagcctattaaacaaggaacttagctctcaaataacccaatctgaaattagatttgaacttaagaccttagagtgctactcaggtcactacaacaactaggttattgccatttcactaaagctgagttcgttgcttaaggttaccaacttcgcgcgcacactttttaaattactaaatattgttcttttaaaaaaattctatagaaaaattgttttttttaaaaaatcatattaatctatttttttaaaaaataactaatacttaataattcataggctaacgggtcgctctattttgcgtgcatgagagatagtttccaactccagcaaacgaacttagcctaaaattcgtttgaatttctcgtaaggtccgctatccgtatcttatctttgtttcattcatattttgcagtatactagaaaaaaaatacacatgtgttgaaattggtgaaggctatcttaatgttattattgttatacagtttagctaaagtgaaattcattgtaggaatttgcttggatattgtttttacaagatcatgagctacaagtaggattagcatgcgagttttttttaagatttcttatacgactcctatgttttcgaaagcaaacggacttaaaaagtctactcaaatacaaatctataattccaaaagcaaatgaacttaaaaaccgactcaaacacggatgacatactaaaataccggtaaaaatatctttaatttttataatagtagagatatagttgtatatccatgtgcatgtagaccatacaacaatcacatgcaatatgttgcactgttgatccttgtttagagaagttgcactattgatattcttatagaacaagcatttgagttggttacatcaaaatattggttttcataaaagatgctataataaaatggtgggcacatgatgcatttatctatgcctcttgggtcatatctagagttaaaattgattaatgacaatactactactagttatgtgataggcaatttacagcggactgtactatatccggtgatatctaggttgctaattaagccggccttaagagtgacagtataggcaaaaatgaaagggctatgtgtgtgtgtatatatatatatcttgaagcatatgccactgaaaatgaaacttatgcatccaagttagctttttaaaaagggcactttttagatgagtaattgagaatttttcatggcaattatctactaaaataatgtcatatttacatcatggtatacctcttcttagaatttaccgatggagaatgtacaaaacatgagattcagtcaacatagatcttgtactcttaagacttaattagtatattcacttactttgatggtaactatgccaatccttaaaaatatcacttcatatacaacacttgatagtatccatctaacaaggaagacagacattaacagcatataaatttgcctaattaatttaactaacttacactgttacacataagaaagttactttgttcgagatcaacaagtacaaacaacgcataaatacttgtcatttagaatgagatttggtcaaaatttgcaactttaataatcaataacttatccattttcatattttttatataaaaaaagagagaatggtttgcatatatgtcttgaaaaatattgggcctgttcactttggtgtcattttcaaccttaccaaattttggtaaagttacaaaaaaaaagtggctacatttagtttgctgccaaattttagtaactatataagaaatcctgccaaaattttagcaagttaccaaaattttggcatagctgctaaaattttggcaatgccaaaatttggtaaggttttttttgcaacaaagtgaacaggcccattgtcatactatcacagatttatcagattttacaaacttatcattacataaaatcaatggtcaaagtttgactaaattttatcctcggcatcaaatatttacaacctgatgggaaaactgagctacttcctctgtcctagaataagtttatttttagcccctcccatttgccctaaaataaatttatttttaagtaattattgtatcaaagttttttaaaatagaggataaatgaattgagagtatataaagagaagaatattttttgtgggatttgataaagtgagggttttcttgtctttttattttctatattgatacgtgtaggataaatgaaaaataaacttattttgcgatagatggagtagctatcctttttaacacatattttgacacttcacgtagctaaattgcacctacataggtaaaaacaaaagaaaatgattcctaactataaacacaattgtgaaatggcatgtagcctagtggttagaagcaccccgaggtcttaacttcaaatcttcataggaatgaaattcagtttgggttatttgatggctaagttccctattggtaggctaaatttctaatttaaaaaggttgcatatatctggttggatgtagaggatgggtaaaaaaatacccttctctaggaaaaaaaccctataaacacaattcaaaatccataactttggagtacaaaattcggtgtgcatttggcggtgcaacatagcaaaaaaaaaaaatccccacacaaaccacccatgcaaacaacaactacatgacacatgttcttcattcccttccctccctccctttcgcactctcctcccacacgccaactcgcaaatgccgacgcccggctcgtcgccggtggcgacggcggcggcgcaccgccaccgccgtagccgacgccgccaccctcagggccccccgccgcgccagccctggtgctgctccttcgccctcgacccgctctccgccgtccaccgcagccccgccgggacgacgacggctgctcctcctcctcatcaccggcggcgaagcaagcacgccgccaccacggcgccgccgctgtcacgccgcatgcgctcgcccggccgcgtctcccccgtcgacgacgcgactgcctatggcggcgccgccgcgtcggcgtcggcgtgttcctccgcgcgtctgtcgtccgtctccgagtgcccgccgccgcctccgcctccgctgccgcgtccacgacctccgcctccggcggtggaggcgctgcggatcaggctggtgtccaagggcgtgatcctggaggtggcggaggtggaaagggtgcggagggagtgcagggtggtcgggaggattcttgaaggcgccggaggaaaggtggcggtggaagggaaggtggaggtgaaggcgatcagggagccggtggagatgatgctggaggacgccgacgaggccgccgcgatgaggcgcctctcccgcgccggcgtcgcccgcgccattgccgtgctcgaggtaattaacctctctcatactgctctgcttctccaaatcatgaaattgcaatttgagaatgaggatgaatggtgatttcttttttgtagttgatttgttcgcaaattctgcatcattttgtcgattgtacatgtgttctggtcaagaattgatcaggaaagatttgcatttattttacttactttggtcaataatagttaacactgttcctgaggtagacaggtagttgaggagttgaggtttggttgttggtggtcaaattgggaggatttcctgtttcttggatgttcatcagaattccgtagtggtttacttctgttccactcaatatctgatgctaattaatttggttgtcgagctatatatgtggttcagtaaattttaccacccaccaagatttgtttctcagttttccttattggcttttatttttcttcttacatagttcgatgagttttccaaatctctactggttttcttgattcgtttgggttaattggttaaatatcccagcatcacaagccatgtagcagatggtaacaaaaatatgagaagggaacagaacatgaaaataaaacaggacaaaaaattggtacattgtacactgtaaagaataaatcagaaaatcgttggacttcatattttgttctagtttttggagttgagtaaacttttttctgtcagcatcttcaattttatataaattgaagctttcatttttatgcccttcatttcctgttctttttttttgcagtttatatctaaatatcttctgcataaatctgtttcctctgtttcagttgtctcttcattttatttctgcttttgtttgatatattcccttacatgtgttaggttcatattttttgttaatgaaatccataatactcttgcatgttcggcacttactggcacacttcttgttgtgttacttttataaataattaccaaccttaagatagtactagtattaatcgttctaatttctagttgaacatgcctatgttatatgaattcattaaaaatcatcagattaggatttttgcttttgctgatcacaataggaaatacttgactcttatattagtgttgatctaaatttcttagacgaaatttagttgcttgctatgctctaaagaacatagaaccaggcaatgcaataagttgctgttttgcaatgattgcaatagctgcacgccaaggcagccgtttgatcatacaatcagctgtatatcaccttgtcttgaattatttatgagaaatcggcatttattttattcaatcacagtgcaatgagttggttcacttgtttggatttggactcgttatgatgaatgtaacatctgttacagtattttgagaatagccccactacctttttaagcttggtggttgcacgtaaagacatgatcatagcaaatactgttttgcaatcatggtattattgctctattagaagctactgctactgttaaaaagtggaagattccatgcttatgtgaaaattaaaggatcttgtctacttcatgctggggatctacattacgtgcgatacttcataggattgttaatttattaagaaggcttttgcactgtaaagattgagctcctgtgcattacagaaattagaataaagtctacagtctacactgcaaaaatctgcagagacaagttcatttcattattttaactccctttatatgtactgtaatatatatctcaaaatgtaaattggatttaagccggttcttaacatttttcacttaatgcctaatcgaatttctcaggtatccttctcccttatgtttgacagaggagtcaccaactgtctaaaatatctcgaggctgtcccatggagtgagcccgaggaggagaggatcaagagtttgctgtcccagtatccttgcaataaaacggtttctcaagatttgcttgcaaggttacagcctcaagaacccagttcatcagctgaactggttgttgaactcatggattccatcacaaaggggaccaacaataatgcccgtaaagatttgcggactcttgtcgacggtatattatccaggacctctatctacataaagagtgataaagagctggacatgatgaacatttactcaatctgccatacttgcctgaactgtctggtggaattatttggggaagcctctgacctgggcccttctggccaaacaaccatttcagttggaaaagggccacacgagagaatatgcaagcaagttgagaacctcacctggttgctgcagattctgatagacaggcagatgggtgaggaatttgtggacctatgggccagccagaacacactcagtaccatgcatgaacgtttttcgcctatggtacgttacgagctcagccggatttcagccacaattttcattgccatggggagtgggaagctccactgcaccagcacgtcgcggcttggcatcttcgaagcatggttcaggccattgctggtggattttgggtggctcaggaggtgcccaaagggcctcaacatggcaaccctggaggatggaattgggcaagctttgctgacactcaccttgaagcatcagcaggtgctgttcatggagtggtttgagacattcagtgggcaaggcagggaatgcccaaatctgatgagggctttccaggtctggtggagacgatcattcgtaagatccctaggtagcagcagctgagactgttcatcttcttgcaaattcctcacctgagtcaattgtgtgtaagcttacatgtaccatgtatgtttgatattgtcatatatatatagcttgtttgtcagattccctgacgaagcctgtatctgcaattctttagcactgctgagatgtaacaaaaggaaagaacaattctttagctgttgttccattggcctgagctgaatgcatttgcttttggtggttgataagttgatccatgattatgctccattgaatgtgagctgttagtagtagtacaggttcatttataatcggaattcctttataatccagtagagatccaaagctgcgtggtccagtgatgcatgggttgcaatttgcagaagaaaggacaacttggagtattgtagtagtacgtatgcaggtgaaactggagcttccggtgtttggtctcttggttatcatgggcaaatgatttctgtaatgagcttgctttgttagcgccaggaagaaattaattccactgaaatgttgctctatctcactatctaaatgaaaaacaagtttgtcaaaaaaaaaagagtaaaaggtagtttacaaaccaaactgggatcagattgtgacattctgttggagatatttattaaaaataggatgaatcaggtaaattccacagcctgccctttttatggcttctttttttcatacatgtcatcttctttacccaattacccatataaatggaacaggacgacaatggacaacacacatttcataaacactaaacaaagatttgttttaaggttagcctggtacaaatggacacaacagcttgttcagttccagtaggtgagattctgtgaagtctgtgagtatatgtgtctgatagaatgtcatagtcccaaggaaagaaaccaaggtactcaaccattcctgacttaggtctcttggtggcttcctttgatgcctttgtggtcaccaggccccttgcttttggaagctgagatcagaaatcagaatttgctccgatgaaatatacttggagtggaaattctgatgatggtgctgatggatattcctacctaggagtatttgtcactgaattattagcaaactaattaaatttcaatctttttccgtagctgtgcttgcatcatggcaggtattcagtctaatcatacagccaaatggccaactgtacgtacgtctcatagtcacaggcatttatgttcatttctcctttgtttttttgtttttttgaagactatgcccatctctccttgagcttcctcttctttttttattgagctgattctcaatctgtctttgatccacgcatgagaccatatgggattatatgtttatattaatttcgcctagaaaaccatgtctgttgtggtgatgtaccagtatgtgtgtcttttatgtaatccaaaaaaatatttattatgcctgatgacacataggccattggtgactaagtatcaagagatcaacaataccactttggtgtaagtataaagacatggttggtgctcaataacaaagctatttgcaataccaagggtggtccctacaaggaaaaaaaagaagctaggatagtcccttgcattttctagcaaataatcctaagctagctcaaaaggctgtccatgctgatcttagccaagcttgctgagggacatcctacccctgcttggaagaaaaatgatggtgattggctgctgcttttgtacttatcccaaggttgtgcagcagtgtttacagtaatattataggttgaatattttttatttcacaaatacaaatttacaatgcatgcatctaaccagccaacttaatggtgtcctacttcccttgaatccaaatataagagctttcgttttgaactagtgtagtaatgtttgctaagggcatttactctgttctatggatattatggggtctgattatgataaccagttcacctgaaatcttaaccaaatgatgaataaggtctctgttctcatcatttgtatcgcctttactagctagaacatccaatgttgggtccctgctcagccggtcgtcgtttgggaatgggggtgctggccctagtccagggacaatgcagggtagtccctgctctgtattgttggtgatttggttggctcaggaggatcagattcccttgcatttcctttgtcctcccaaggcagtataggcaatcatcttagtactaatatcatgcagaattaatagctagatgcatcacaagattcacatcaacaactgacaatgtcctacaatcaacagcatatgttaccgcaaactccccagcagccccagcaaccacagcataccatggagcagcatatgggacaacctgatcagagtggcccagggcagatgttgcatgcttctaatgttgtgaagctcgaaccacaacaactacaagcattaaggagcttgggtgcagtaaagatggagcaccaaagctcagacagtcagacccatacatgttcttgcagtagcaacaataacatttgctgcagttagcagagcagaattaatcctcacacaccatcatgtgcacagttaagacttgcatgcgtgtgatcctacaatctccgcgagcagtgcacgaaattatgcttgtggattggttgttatactctatccatcccaaaatgataatcatatatgtttatatatgtttatgcactaagagtaaggataatttaaaacgcgtcaatcaagacaccatacacatattctcccacaatgcatgtattaattgtattatgatgaaattcatgttcatgcgattatatgatgatcaatttgagaaattttagatttcattatatgatgattaatttgggaaggaggaagtactacctctgatttctttttttttaactagaaaaaatgcccgtgcgttgcaacgggtaaatgttattttaattttattattgttatacgattcagctagggtaaaattcaatgtgggaatttgattggatattttttttcagaaaatcatgagctgcaattaggagtctgtatttcatctgaagttagcatgctgggttttttttacaaaagatttttatacgactccttttatatttccaaaaggaaacaataaaatccaactcaaacatgattttgaatttccaaaagcgaacgaacttaaaaactgactcaaatacggatgacgtatcgaaattctaacaaaaacatcttcaatttttatctctcctattataaaaaatgaagatgttttttaccggtattttggtacgtcatcttgtttgaatcggtttctaagatcgttcgcttttggaaatagaatatgtgtttgagttagattttaagcttctttgcttttgaaaatacaaaaggagtcgtataagaaatctattttaaaaaactctgcatgttaacttgaaatgaaagtcggactcctaattacagctcatgtttttcttaaaaaaaatctaagcgaattcccacggtgcattttgagtcaatccattctataccatcgacaaattaagcgcgggttctataatatgccattaacaaagctcggttctacaatacaccttcgaacaactcatttacttccttatatgccatcggtgttagtcaaccgttagtcatacgccgttaagggaaaataaatgacaattttacccttaggataaaattgagattttgcagaatgccatgtctcattaaataatcttggatgctaaaaaagacatgtgatttctatttttctcatcaatgagaagaaatagtggatcgtgaccaatgaaatctatgcatacgcatgataccctaggggtaaaatggacattttcttcctcctaacagaatttgactaactgttgactagtggtgatggcatgtaaggaagaaaactggttgttcgatggtatattatagaactgagatttgtcagtggtatattgtagaatccatgctttgtcaatggcatagaatggattatctcgtgaattttaccctagctaaaccatacaacaacgataaaattaaaatagcattcacccgttgcaacacacggacatttttttctagtaatagtagagatttgaagtttaagacatacttcgggcctgtttggtggagcttaaaattctgagaagcaactactgagaagctagctggtgagaatctggagaacctaggaaacctagcttctgacttttagttcatttttcagattctacaactatagattctcagaatttaggtaaaaagctaaactgtttggagagcttctggtaacttaagattttaggagaagctgcagctgctagtagctcccaaaatacccttcatccggttcaaaatacacatacaacgatgaaaggtaagaaaattaaggaatgtgcgaaatgactatcctgcccttcatttcttcccgatctgtcccgtcccgtcccgtcccgtcccgaacctgcggcccgccgcgagagcgctccacgccgcgcgccgtcgctgcctgcacagacgtccgtagatgccagcggggcggcccgccggatgtggagcaaggcggcgcaagcggccatggcggcggccacacatgctcgtcggccccgccgtcccctccaccacctcacataatttccgtccacacctttcgaggctgtgcattgggtcggcgacagtagcgagagctggcggccatggatgagatgagagtgggacgagcagccgtggccgcggctgcggagtcgcttttggaggctacgtcggcgagccgtgctctcgactctgtcaaagacccccgcatctccccgaggttcatcttctccacactcctagcactagtacttccgtcagaactcggaattacaaaattcaggcttcaattcaatccttcctcacttgggaatgagaagaagtactcctagcactagttatgtagtaggaattcagaaatcttggagtaacttgatcttggaatacccctagcactagttcattcagaatttagaaatcctagcactacctactactccttcaacccggattcagaactcagattgcgttgtactccaaggatttagagtgaattaacatgtgattgctttaggcggtatgatgcgttagatggtaaggcagagagttgattaggctacattgttaccaatttgaattctttttttgatggttattcaggaaaacaagtcgtaagcatttcatttatgacatgttcatactcctgaatttcagagtatgattgtagcatgaaacaagttcagagtattcttgttactcctgaatttcttttagagaacaatgcaggagtagaagttctttttttttattattcttgttagagaacaatgcgatacaatttgggcatttggttttgtccaattggtgtgttattctgaaatggccattaggttcagagtacttgggttttgtctgttattctgaacttgctgaagaactaatcctagagatggtggtctgtgtgaattttctgagaaatcggagtaagatgttttctcgagtagatatcagtataatccgatttacagcatgcatagatttttttttttgataacaggtaatttgattacccggcttttgggagaaagccaaacaaaacaaggtctgaatacaaaaaaaaacttaaaggaaaaacagagtaaaactggggctgccagtacccatcacgcgctagaaaactaaaccccaaaaggcttacaaaccccgccaagaagtatccaaacgactaggaaatctcaaacccctaagagcaacatcactggcttaagcactaatattgtccggtagcacattcacaggacgtagagactccagcttagccttcagcttctcaagcagcgcgttcaaagcttcgcgatctctttcttttgacagcagcaccttccatctctgcatcaaggaaattgccttgtacactacctacaaaggtgatctcactaatttattctcaaaaacaaagtcatttcttaccaaccacaaaccccagcacagactagcacaaagaaaaaggcctaaattcacccccaatttattatccttaacagctcttataccatcccaaaaattggttgaaattaacccccccccccaattacctccattacagagcaccaagcaaagcaagcaataggacaagtaaaaagagcatggttagtagattcagttctcaggcataatttacaaaatttagtacccccttccaatttctctgaactaagagttcagcacaaggtattctccctctcccagccaaaaacaagaaatgcttgacttttaaaggaactttgcacccccaaatctctgttatctctttgtccacaacacccccaaactttaacaacctatacatagatttagtagtgaacttcttattcttctcatgaggccaaattaagctatcaggcaaatcatctagcctcacatgctgcagcaaacttttcaaaacgtctaattgagccttgtcagactggtccagatttcttctaaaggacaaatcccaattaggggcacccataacctccctaaccgaaagatgttgttgattattcaccatatataaggaaggaaacaaaattcttaggggaacatctcccaaccaaacatcctcccagaactattttttttctctattaccaatcttcttaactacaaaatagtttaaccagactttgcactcatgaaggcctttccaaaattgggaacccccactagcagaactcttaaaaaaactgcccctccttaagtacttattcctaaaaacaacacagctcatgttctgagagttgccttccaacttcatgatccatttactcaacaggcaaatattcatggtcctagtgtccaagaaacccaagccaccaaagtctttaggtctacacaaaccttgccacttaataaggtgatatttcttcttctttccattcccctgtcaataaaatctcccccttacagtgtctaaatttttgtaaaactcctcaggaggctttaaaaaacccatagcatacattgggacactggacagacaggtattgatcctgatctccctccccccataggagagatgaccactgtgccaagattgcaatcttttctctattttttgcatgattggaagcaagtccttttccctaccttaccaacccccataggcaaacccaagtaagtaaaaggaagagaacccactttacaattaagcatgtcatcatacgattcctcctcatcctttggaacccccaacacataaacctcactcttctgataattgattttcattccagacatctcttcgaaacagaacaacaagaatttcaaggctaacacattttccttagtagctttagtaaagagaatagtgtcatcagcatactggagatgagtaagaccccctggaaccagattaggaaccaacccctccaaaaccccattactgttagcaccatccagaataactgacaaagcatcccctattagattaaataagataggagacagaggatccccctgcctcagacccctaaaagtcttgaaaaaaggtccatgttccccattaatatttatactgactctaccccccttcagtgatcttcttaatccattcaataaaaatgctgttaaaattcttcttctgcatcacctcatagagaaaccaccactgcaccctatcataagccttttcaaaatctatcttaaagataacacctgattctttctttttatggagctcatgcaatacctcatagagaattacacacccatccaaaatataccttccaggaatgaacgcagtctgtgtccagttaataatccccccaatcacactagttatcctcatggttaaagctttagttagaattttcagaatcacattttgaagacaaatgggtctatattgctttattgtattagcatccttaatttttggcagtagagaaatcaccccataatttattctatcactgtctaaaattcctttctaaagatcatcagagcatttctttgatcaaacccctaaattcaggcaaaagtttctttataaaaaccccactgaaaaaccatcaggtcaggggcagtattgttttcatgttnnnnnnntcncccaatatgacctgatcaatttctgacaattcaaaaggtttcatcaagctttcattatccctctcattcaaacttaacctgttagcccaaaccccctgctccaaatgaatgtttctcagttcttccctcccaaacaactgtttgtaataatcataaatatgagtctgtatttgttggaaatctgaaataacctcctccccttgctgtatagagaaaatgtgacttttcctattcctaccattagcaatcctatggaaaaaagaggtattgctgtccccccttaacaaccattgttcaccccctctcctttgccaccacagttcttcttgtagatagatctgctctacttccttttccagctcatatctgacctcccattcttgaggaaacaaatccctctccttagcaatgttatcaatttcagtcagcttttgttctatctctttccttctctttttctgtttgctcaccatattagcactccacccccttaaccatctcctcagataaggcataaggagatgccagtaatccattattttgctctgtattctggcaggccacttctcaagcaattctttcttaaaaccctccagctcaaaccaacccatctcgaacctaaaattgtttcccctaactctctccccctccctagtgtctaacagcaaagggcaatggtctgagccaaccctcaaaagagaactaactatggccaaagggtataaatgatcccaactagaggtcaccaggattctatctagaacacatctgatgggattgatttgcttattcgtccaggtgaatttcccccctaacttaaacagttcttgcaactcataatgattaataaaattattgaaagcctcagttcttctcacatccaccccaccaccaccagatttctcatctagatatcgatacagattgaaatcaccccccagaatcataggataaactccttgctgtactttgttgccaatttcagctaggaactcccccctatgtgcctgttgagcaggaccataaacgttaattagctcccaattctgtccatccttcttatttttaatcaccattcttaaagaaaaggccccttgatcccaatcaacaatatcaaacaacaactctttaaccccagtcataataccaccagagtgacccacagctgccacatatctccaagtaaagttatctcccaccagattcctcaattccctatcaggaaaactttgcttgattgtctcctgaaggcaaattatatccactttttgttcaaaaaccatctccctcaactgtctttgtctacctgcagcccccaaacccctaacattccagaacaccactctcatgatttagacttctttctaggacgccccctctttttcggcccagaccccttttgcacagattgtttccctttctttttcttctgtcttagaccctcatggtcatgcaagtcaaaatcccccaggttatcaaaactctctttatctgcatcatccaactcatccctatcttcctccttcagaccctccatatactgatcattctccatttctatcacaggaacccccagaatcgcattattctcattggggtacagcatgcatagatatcagcattctcgtaagatgtttttgaaatttagatttccatactccctaattgtacatgtaaaatgtatttgaaaatacacactaataaaatgtctgcttggattagttctcatgttgctttcacagaaaactagagtatcaatggcttgagtttctgatatctgaatatttactgtaactgtctattgtctgctcaatatgtcttctgcagagtgcgtaagaaccatctttatctttaattcgatcaatttcatctcattcagagttcttgcttggaatgtgctattcttgggtcaattgcattcagtcacattaagttgagcacaagcacatgccatggaaaaaaaagaaagaaacttgaatggctcaagttgtcacagagtggaactccaataagtactccaagatagaatttcaggaatatcatcctcatgtggttttcaacccaagcacaaattgaaagaacattgaaaccttaagatattatcactgaattattgccaaattagacaaagagtacactattttgaaggtgctaacttcagatggagtacacactattttgtcaaacaagctttgttcttggcacaagcacaagcttctagtgctgttgaattgaagtgactggagcatcaatcggcttctactatggtagagttcctaagctgcttcaaaacttatcttaaaaacttgtatggacttcacttctgcctaggcacctgaactgccgcttgattcaatggatagctgttactgttagacaacacttgcatctaacatttgtatctgacatttgcattggtagtacacactctctctctctctctcctttttacgttggtatctgacatttccattttctgtcatattttcagctgttctgaagaatacaagtctgaagagctactttcaggtcagtgaaaccacactgacaaccattttagaaacagaattgaattgccctgattaccgcttgatgccttgaagcatatacaatcaaagttcaaacagatgtggccatcatatatgtatatgtagcacagtttgattcctctttgctagtcaaaagatggtatcatcaatcaataatagttacagtattgattccatggagtagtaggattacaacaattaaggacgatgaagagaaaggggtggctggcgatacacatagagaggcaaagcagggggtagcttagttacaacttacaaacgaagctctgatcgatcaagtctgatttgattgatgcagctgaagaagaagaggaagaagacgacgatgatgatgcaatcagctgctgacgtacttgtcgatgatggtggcgagggtggtcttggggacggcgccgatgacgctctccttcttctcgccgttcttgaacatgaggacggtggggatgctccggatgccgtagttggtggcgatgtttggtgagtcgtccgtgttcaccttgcagcacttgatcttgccgacgtactccttggccagctcgtcgatcaccggcgcgatcatcctgcacggtccgcaccacggtgcccagaactccaccagcaccggcgcctcgctccccagcaccatgctgtcccagttcttctcgtccgccaccaccactgccacgaccccacacgcacacatacgatggttttcgttttgttttgcaccagaatatgacgaatggtcaaacatgtgttttaccttcgtcgacgacgttgctgcactggcaggcgaagcgggaggcaggtcggagcggtgacggcgaggcgacggacaaccttggcttggactggctgctgccggcgccggagaggaggagtctgtccctactgccgccggaggacggtggctgtggggcgtgcagagtcgcccaggctctgaagcacgtctccaacgccattattttctcactctaagctacgctcctcacacgcagtgacacagagagaagagaaagaggaggagaaaattttttgtgtagaagagaaagaggatagggtttgttctccctgtggcattggataatcgggagctttggcgttggtgtggcatcgtgaggtgctcaggggttgtgcttcctgcttgtggatgaggtggttttgcccccctaaacttttggcccggtgtcgcctgatcttttcgttgcctccttcgtgtgcctgactcgaggatatacgcgcctataaaaatgaatatcttggattcttcaagttctctgcaagtttacaacacataaatttctagaatactaggaaaattgggcaactttatgtgaaaacactataaaatatttgttgtacattaaaaatatgtaagatgtgttttctagaggaaatccggtttgtttatttctttattattaaacaattggtatttctttattttttttcagttctctgcaagtttttcagcccactttttcttccaagatgatacgaaaatcgaaccattttatgtaaaaatatgttttcctaaaaaaattggaagtcctgcataattcatgcattccaaagcctaagaggtgctctagaggaaaagtcggttcattccttcgtttgtttaacaatgcatatatgatagtttattagtgtattcagtaatataattgcatatatgatactagtttattagtgtattcagtaatataattttgcattagttttcaaataattaaacatgatgtttggagtactcaaatttggggaaatcagtgaaataaatgtgtggcccatctccaaatacgtccaccggcctcaactacaccgcaaccgaattcaataaccacaaactttttattctcatttggacattcgaattgtgtcgataaaattatttggtctacttatacctctctatatatatagccatacatgaaaaattcaccaactattccatcataattgttgaccataaaaaccactttactttgtcctaagactggaacacttgcactccataacgctaattttgaaatatattttgtcaagatgatattccaatacaagtgtgcctgtagtagagtatcttgccatttataagagaaagtccattttacaccctcgaactcttatgtctgtccaaaatacacccccgaactataaaatcgggtataatacaccctcaaacccttatgcttgtccaaaatacacccctaaactacaaccgggtataatacaccctcgaacaataccagacacttaacccccgccctatttttaccgtggtttttgacacatcggatccacgtcagcccacaaaataatatgagccaagcccatattctctctctccttgccctgttgtgcttctctccctcatgaccgtcggcggagtggagctgcgagggcagcggctgctgcggccgcgtggcgcggctgcgagggttgcggctgcggcggcggcgtggagctgctgcgagggcggctgcactgccagggttgcggaggcggtcgtcggcgaaagcctttgcacgcagtcgccgacgaggagagcagcaacggcggtggagcttgctaccccgcgcggaagagacggacctcgccggagccacacgcgtccccaatcactgtcgcctccgccgaactctacatccccaagcagctctagctctaccggcgagctcgatcgatttcatggagaagatagagctcctggaggcggcaggagaggcagaccttgagctcgggctcgccggcggtctgcgtggaagggaaggctggggatgtgcttgagcttcgtcgccgcaacgagtcccctgctccaccgccaccgatctcttgctctacgagctcaagaatgccaccgccgcttctctcctgctctgagaggaagaaggatagagagagaaagtgaagaggagatgagggaagaagaagaggtggctccgtggttatagactgacatatggtcctaatttttatttttatttgctaactggacttccacatcaatgccacgtagataaaaaccagctgaaaaaccactcgagggtgtaaagtgaacggtattgaaagttgaagggtgtgaaatatcctgttttagagattttggtgtattttatacaaaataaaaagttagagggtgtaaatggacttatccctatttgtaacttgggacagcatacataagagtgcaggaggaggaagctaagggtgttacccaagttaatcagtatcgagatatgaggatcttctgttttgcagtatgataggatcgggatactactatattttgggatactactatattttagaaagtacatatttttatataaaatataatatgttgtataaattaaagcatataaattggttttgataaatttaattggttttaatgtaaacttaaacatatttattcatattattttcaatccaccttattttaaataatattttgtaaaatcgtagaatcgaaatactatctaagataggatcgtatgtaaatgaatagtaagatcaggatactacgtgggattagtatcgcggcttggtaggattgtagtattgtaagatactagaatacaaatcgggatatcagtgttaccaccttcgacaaagaataacatctagtaataacaagtagtgtggcctatcaatgacacgtcgccaaaccacctttaaaattggttaggggtgatattgagtatctagaaaatcaggttaactcaagtgtttgggtgaatactttacggcgtagggtggacattttcttcacactctgtttatatagatgtgttatattttaaacaccattagcatatatagtttgccttgcaagtgactgcacaactaggatagaaagtattcaacaaggtttatataaaatcatgtattattaaagacttaaagcggccaatatttgcgagtaaacgcggttgtgaaaaataagagatttgaacgatactcaatctgttaaaaaaaatgtaacaccctagcatccaaatttgtattagtctgctctacgcgttgagtgggcccataattatgtaacacctcacttatatctttatttttgtttcgtgtaaaagagttaatccagagaaaatatgtttggagggagatatatatatatatatatatatatatatatatatatatatatatatatatagtgaatgggcttgggcctccatatatatatatatatatatatatatatatatatatatatatatat

SEQ ID NO: 75404 - DNA, 1042 bp, Oryza sativa
acttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcactttcacttgacacctatttaaacggctcgtctcgccgctaccttatccta

SEQ ID NO: 75405 - DNA, 4924 bp, Oryza sativa
tatcggttattcgctggatcaagtcaggtacgagcagcagtagtatcggtatttgttatcaactactgtattagtaaaacaatccaagctgatctattactgttcacattaagaaaaaaaaatcaaaaccaattcactgtatcggttatttctgtgaagcttcaaactctccaatcttttgctaagcacattagcatacaaggaaaaaattctaagaccgtatattaatttattcggtcgacaatatttcggctatgagctatatgaccggatttaatcaaggaatttcttcatcaactttgacgagcgggaacgggttcaacaatattgctacacaatacattaggaccgatcaaggcatcatgaaaggaaacgtcccgctacctcaagttgtaatttcaccaaaggtaaccttcgattcgcccaacccgtcctttgctattcaaaacgttaataaccattgtgtagatgcatatgctacttctagttttgctcctatacaatatgcttataatgctacggggggtcaatgggtgattatacagccgattgcacaggaatcggctatatgcaaaacctagctaacggtatgaccggtcatgacaccggtctaaccgcgtcctatgccggtcagaccgtgcctaccatagccggtcagactgtaccctattctggccagatcggacctcctgtggccggtctgaccgcaccactgaccaccggtcagaccgggccatgggccggtcagatcggttccctgggagtttctccaggttttcataccacgactagcaatattgattttaattattattcatcacctgttaatactgttagtcatgctactccacatatccctaatgcctacaatgatattaataggggatatcctcccgatactaggtatggccaatataacaatattgtgccgcaacaaccaccttttaggccaccaagtccaccaccagatccaccaaggcctgaaactgtggaggattggtttagaaatattatcagggagaatttagcaaagctaaggaatcgcgctagggagtaccaaaagccgtatcctgattattatgacattttcccatatcctcgtgattataaaattcctgaatttaccaagtttagtggtgaggatagtaggactacatgcgagcatgtagataaattcttagcgcaatgtggtaggattaatagtaatatttttaaattacgtttgttttctttatctttgtccggtactgcttttacatggtttacttctttaccggcaaattctattgatacttgggcttaattagaacaaaaattttatgattattttcacactaatgaaactgagcttaagttatctgatttaacatcggttaggcatgaatacaatgaatccattgctgattattttgaaaggtttagagatgttaaaaaccgatgtttcaatttgaaaataactgacaaagatttggccaacattgcatatgatggattgcttgattctattaaagagaaattgaatggccagatatttcttgatgttgatcatgtgttgcatgaagctctggcttaggaaagccgagtggatgataatagcttacaagctagtttagacgaaaatgcaatatcatgtgtagccaaaccaagcgatggttcggattgtattaataatttgtgcaatgatgccataataagtatagccgaaccaaatgttggttcggattgtcttgctagcttggataatgatgcaacaaccattatagctaaaccaagcaacggttcggattgtgttattagtttaaacgatgatggaatagccgaatcaagtagtggttcggattgtgttgctagtttagacaatgacatcattgaaaatatagccgaactaagtgacggttcggattatatcacaagcgaaagtgaaatagcattgtcacctaagaccgaatcacaaatcggtcatatggatgttggaaaagataatgataatgtcttgcgggatagtagtgagatagaatctaaaatagttatgcatatatatcaaaggccgtatcctgaacacatagattcggtcccatacccgcaaggatttgaggtgcccaacttcacgaaattcacaggtgaggatgctagaacaacaatggagcatatcggccgatttattgatcaatgtggtaaggccggtagcgatgatttgcttaagttgaagttgtttcccctttctttgtcaaactttgcatctacatggtatagtttgcttgctcctaattcaatttctacatggtcataaatggagcatgagtttcatgattatttcaaagatgcaagcttgatggagaaagaccgattgatacttcatcggtcacttgtgaaacgatttcggttacacctatgcttaagaccggaattgttagtgatcctctccctattagtcctactgatgttgacaaaaagaaagggaaaagtgttgttattggggatcttcggcccaagaataggatcaataatgcaaaggccgaatatcgtaaggttacaaaagatgagtcatttagttcccaaaagaccaaaaagccgaagctcgcttttgagatgcttatggctaagtacaagaaaggattagccggtcaacgatttgataaccaaactagtgattcaaaaagaccaagatcatctcgtaggaagagatttggtcaaacaccaaagcaatcagagccatcaactataccaactccatacaaacctccggttgtgatgccatggtatccatatccaatgtcactatatggttatccctttatgtattacatgtcgtggatgcctcaaccatctatgccgtgtcatcaggaatggaagcaatcacctaggtcagtaccaagtcattctaacccaagacaagaccgttttccacaaaagaatcggtccggtggatcaaaggtgaaagaggtaaagaaggtgtgggtgaggaaagaagccaaagctccggaggtcgttatcaataaggagtctcaagttgttcatgtacctactggagatgtggtggaaaccatacaagcaaaggggatcgaagccgacaccgtgattgtcaaaagtggaggtttgatcgaggcatctagctggtctgaccgccaacctgtggccggtctgttcgaacctcttggccggtttgaccgacggcttgtggccggtttgaccgggcccagaggtcggtctgactggggggcattggagaagagtgggaaaattgagagcaacataggagcttccactccgaccaaaaatatgaagaatcattgcttagctcctgaaaaacaaccacagccaaagtggataccttttggcttatctcgctctcaaaagaggaggctacaacgtcttcgagccataggtcaaaaagaaaaggaggccgaagctgtagagaacaaaacatgtaataatttagagcctcgaacgactcctaagagagtgtggagacctaaagaagtaaaagttaagagaccggtgatttcccatagtagagataaatccaatttgatgagagaagaatcatcgatcattagagataagtctccttcgcatggtgctatgaatgttggtgcggtgtttgtcttgccttcgaaatcgtgcagtcaagaaagccgattttgctcggggggcaagacattaatatgctcatgagggaaccaagagaagatgaacggcgatggatacaacatcacatctttgagccgccgtttgttggatgctaaggcaaggtatgggtttattgtgttcaacgttatattatatgcctatgccatgttagaacattgattgatatatagcacatgtgtgtttttgcttatcaaattgatattatgcatatatgttgcaaatgccagttctaggtagtggaattggtaggttggcatatagtttgtttgaagtatgatttggctcatgagtctttgatatttatttaaagccaaatcatatgtgtttttatggatcaccatataatatatagatttcatatttattgcaccatgaaagttttgcttattagtaattcggctaatgtcaatggtcaatgtaatgatttgttctagagttattgtatttaggaacattggcattgttaatattttgcatacatgctcaagccgattacttacatttttagtttattggaatctatgcatgtgacacatatgactttggtgattcattattgatcatacttcaattggctaagtgttttgatgccatgatgattattgtctcaaaagccacttgaattctagacctattagttggatgtcataatttttcatatgtctagaaagaagaaagtttggtccaataatttgatacaccaagcatctggctattatgtgaagaaaaattatatactaaaggtcgatgcttgatttcaaaggtttggacgaaattggcaaagtcatagaccaggggcggtctgaccggcattgcacggccggtctgactggtgataccggcgctctgaccggctctgcatggccggtctgaccgggtagacagggcggtctgactggcattgcacggccggtctgaccgatctcgagcagagagctaggggcacgttacaattgattaaaaggccgaattaattgtgaattcggacatttgtgcccatgagttagaaatagcttggagaattccttagattagatatttgaaagatcctacatttatggttgatcgaaagattcggtggcaagtgttcaaatattatatcgccgaaaaatagatggagtattacttagataatgttcaatctaagttgctaggagagtagtacatgaagggattcgtgaaattcatcaatcggccgtaagataaattggttgcttaggagagtggagtttcattggccgaaaataattgatgattgtttcaaatgctatag

SEQ ID NO: 75406 - DNA, 18745 bp, Oryza sativa
cggcccattcaaaagaaaagagaaaggaaaagaaggaaaaggaaaaagaattttccagggattaaatattgcttatgctccattttaattggttaaatttatttctagggctctgaaaattccactaaaaatcttgttagcgaatttcgacatgtagaactcaagaaaaatccacatgccagtttcgattattatttgcattaatttattagggttttctcttgatttgcaccggcattttcttagggtcatttataaattcaattttaggcttgggaggagaacttcagggtgtgacacccagtatctctctcccccttcatccttttccatccgccgtccctccccccccccctctgtccgccacccctcctagtccctctctttccaccgccgcccctcctcctcctctctccagctgcatcctctcctcctcgacactttctcaccacttccgagctgtctctctctctataaccgtgctggatgttaggggccaccagattcaggctccttgaggtcggggctcaccggatccagccgccgggcagcgacgcagctaatgtttcagctttttatttttcacgatttttattttttttcggatttttgtttttgcgtgcggtcaacataagcacccgcatactaaaatccgattttcgcgcgcggtgcgtcacccgcacggtaaaattggatttttcgcaacccttccgggcagacaggccagagatccacacgcaaaaactacttttgatccatctggaacaattgttttttactagtgagtggccttattttggtaccgattgagaaaccggtacctataagggattctcaattggtacatatggagtgttatgtagtagcagtgattagtatgtgttaaaaattttcttactgatatcattttcactttcaccccaaggctagcactacgcagtaccactgtgccggttgaccaagttctacgaccaggtcaagtcgacaacgacacagcgcccactaattatctctgtccattctacagataatgatcgtggtgtgtctaccttcaccgttccctgcccaccaaggcaaaaaattctccaatccaataaattctccacagacaaagacagtgatgacaccacatgcagatttgcaactagctaggccatcatctctgcactctctaaagctttgtctgatgacggatcatcattcaattcgtagctccgatccatcgtcttcttcccggcgacgacccagccatgaacaacacaatgtccttgctgcttctacttcttggcctcagcatccttgcaatgaattctaccgctgctaccaccgataatggccagttcatctacaccgggttcgccggcgccaacctcaccctcgacggcgtagccacggtcactccggcaggcctcctccagctcaccaatggcaccagcgcgctcaaagcccacgcgttccaccctgatcctttgcacttccgcgaccttccggtcgccggtggtggtggcagcggcaatggcaatggcaacgatgtgcactccttctccgtctccttcgtcttcgccatcctctccatctaccccaacctgagctcccatggcatggccttcttcgtctccccgaccaagaacctctccgcagcagcgccgaggagctacctgggcctcttcagcaacaagactgatggcgatgtggccaaccacatcttcgtcgtcgagctcgacaccatccagaacaccgacttcatggacatcaacaacaaccatgtcggcgtcgacatcaacagcatccgctccgtgagatcctaccccactggctactacgacgatggcgacaacggtaacctcaagaacttgacattgaacagccatgagccgatgagaatctggatcgattacgaccaagaaaccacacggatcgacgtgactgttgctccgcttgagatatcaaaacccaaaaggccccttggctcagtgatctacaatctttctacagttttaactgattctgcatatgttggcttctcatcatcatcaggtgacattgactcacagtactatgtgcttggctggagctttgccatcaatggagctgctccggccatcgacatagcaagctgcccaagctacccagagaaggcccaaagagttcatccaaagtaatggagatcaccctgccgatagccactgcgatgttcgttcttgttattggcgtgatcgttcttcacttgttgcgaaggcagttgagatatgctgagctgcgggaagattgggaggtcgagtttggtccacatagattctcttacaaggatttgttcgatgcgacgcaaggtttcaagaacaagtacctacttggttcaggggggtttgggagtgtgtatagaggagtgctaaaatcttcaagatagaggttgcagtgaaaaggatatctcatgaatcaaggcagggtatcaaggagttcattgcagaggttgttagcattggccgtcttaggcatcgtaacctagtgcaactacttggatactgtcggcgaaaaggcaaacttcttttggtttatgaatacatgccgaatggtagccttgacaagtatctgcatggacaagaagataaaaacaccttagattgggctcacaggttccatatcatcaagggaatagcattaggagtgctttaccttcatgaggagtgggatcaagtcgtcgtccaccgagatatcaaggcaagtaatgtgctccttgatagtgatatgaatggacggctaggagatttcggcctagcaaagttgtatgaccatggcgtcaacccacagactacacatgtcgtcggtaccatgggctacctagcacctgagctagcgcgcacaggtaaaacatcccctcttactgacgtatttgcatttggcgcgttccttctagaggtcacttgtggacgaagacccgtggagcataacaggcaagataaccgggtaatgctagttgaccgggtgctcgagcattggcacaaggggttactgacaaaggcggtagacgaaaggttacaaggcgagtttgacaccgacgaggcatgcttggtgctgaagctagggctgctatgctcacacccggtccctcaagcaaggcctagcatgaggcaagccatgcaatacctcgacggagacatgaagatgccggagctgataccggcaaacctaagcttcggcatgcaggccatgatgtccaatgaagggttcgattcgtacatgatgtcgtacccatcgtcatcgatggtgagccatggcacattcatgtcaggactctcaggaggaaggtgatagctagctggcatgaaggggacggtatgtgatcgatggcgattgataatacccggtaaactactcaatttgctagctagaagtatatatgtacattacttatgtgatcatatatgctgttatttaaacatttttacatcagcgtgtgaatgaatgctgctcttttttttttttgtgcatacgaatacttgaagctgccagtgattgagaaatgagcatgccgtagcattgtagccagttggtacggaccgtattggagatttggaatagtggttgatgggctgaaagagctttcacagaaagcccatacacaagaagctctttgtttctgtctttgtggagagctgagtagaaccgaattcagatagctacaatagtttttccccttagaagggagtgtgatggatggataatttgttttttccatatatttgtaggtttaaattaatggattaactactataaagttgaatagttgctttgacaaaaaaaatatttaagaagattttatatagaaaattttgcacgaaacacactctgtttaacagcttgatgaacgtgcaagcggaaatccaaaaaccagaatcaaagcagtatagtgagtattcttcaccgtttgatttgcaatcaacgaatgcggaagagagaggtatacataagcgctatttttactgcggtctaagtattgttagagcaggtacaatagcagactataagttagctatagacatatttcaagaagatataataggagagaagagcagcgggctacaaatttgtagccagctgcagcacggactccaagatacttgtgtgtataacaggtgggaccaactatgaattgtgtagtatacgtttataggtactattgtatgaatcggctattaaattgactataaatgatttggagccggttgttggctatactattaaacttgctcttactacaaggtagttcaacactgtttagcgcatattattaatttgcggtattgcacatatacagtagttaccgctgacacgtggaatcggatccaccggacgtggaaccggatccaccgattttgccactatcacttcaggagtgtagtactatatagaatccgtgtccaacaacaatatagatggcacgtcactgtaagtaccaacaggtgccgtttgcaatacttgaggggactaaaatctggacgacacattgggcctgttcactttgatgacatttttaaccttaccaaactttggtaaagttgtcaaaaaaatggctacatttagtttgctgccaaatttttgtaactatataagaaatcctaccaattttggcaagttgtcaaaattttgacaactatgctaaatttttggcattgccaaaatttggtaaggttttttttttcatcaaagtgaacaggcccatcgactctccggtcaccaggctgtctcaacctggttctcaagcatatgtacatgcttgtaatattcacttttataggaaaaccagtaacgttaattaagcatttgaacacaaaggaagaagaaaacttaactactactccatcaattggaagagctagcgatgctccggtagtgacacatgagtatatatgtacacaccagataggtggtaaaaagctactagtttttcctccgatcatgtccctctatttctcaatgcttcaaccactatccctcgctcccagcttttccgtttcgagaatcacctccttcttaaccctaattttctgccgtcggttctttctaactgggatcagcccaccaaccttgctgacccagctgctcgcgtggctttcaagctgaagcatacccgcaccacaattaaaggctggatgcaggctaacaggaaaagaggaattttatgcgaggattgcaagttcaccatcgactacttagattgcattgaagaattcaggcggctatctgaatggggaacggtgcctccgtcgtctggtgcaagacagattagttttggaggtgcaaggcaagctggcatactcgaaacaaagaggaaaggttaagcgtttaaaactgggactggataatacagctttcttcaaagctcatgctacaaaaaacttcaggaattctcgtataaagacaataaaacacgatggaatagaagttgccgaccactttggaaagtcccaacttatgttttccttctacagccggctcctgggatcatctttgcagccttcttgggagttcgatctacaacacctttactcagatgaagggagagattcaaacttgctggctgctcagggtctaccgttttcacaggaagagattcttcttgctcttcaggcaatgaattctaacagtgcgccagggccggatggtttcagtccaagcttctaccgtgcagcatggaacacaattaaagaggaggttcttcagtttagcaacaggcttcacaacttctggggcagacatagagcgaatcaacagagcctatattgttctaatccaaaagcccgggaaagaaaacacagtcgatggatataggccgatctctcttcagaactgctcagtaaagattctttccaaagtgcttgcaacacggctgcaaagggtattcctgaggatgatacatttagaccaaacgggtttcctcaaagggagatgcatctctgagaatcttatatatgcgacggaattgattcaagcatgctacagaaggaagtgccaaactattattgtaaagcttgatttcacgaaggcgtttgattccgtcatttggtcaagccttttcaagattcttgctgtccgaggtttcccagaaaactggattagctggattaaggggttgctttcctcctccaagtctgcagtgcttcttaatggagtccctggaagatggatttgctgcaagaagggccttctacaaggcgaccccctatcttcatatttgtttatcttagttgctgatgtgttacaaagattgcttgaaagaaatactgaaatcagacatgcaatctaccaagacaggccatgtaccaccatccagtatgcggatgataccttgattatctatcgtgcggaggaggctgatgttcttgctctaaaggagactctgctacagttctccaaggcaactggactgcaaatcaattttgctaaaagcactatgattactctaaatgtcgatcaaagcaaggaactagttttgtcgggattgctacagtgcaagctggagaaatttctgatgtcttatcttggacttcccttatcaattcataaactgtctgcagcggacttgcagcctctggttaacaaggttgatggtttcttatctggttgggaagcatctctcctatcgcaggcggagcggcttgttctgataaacgcaatcctgagcagcctgccggtgtatgcaatgtctgctttcaaacttccaccaaaaattatagaagaaattgatagacgacggagggcttttctctggacaggggatgatgtctgctcgggagcaaaatgtctggttgcttgggaatcagtttgcaagccaaaagaacatggaggacttcgtattaagaacttaaagattcagaacgaggcaattcttctcaaatgactccttgccctctacaacttgaagacctcctggactcgatgggtctgggacgaaatttcagattcctcgttactgtcctcaactcgtctagggcatcactgggcatcctttcaaaagttgttgccagaactgcgatctttgacggaagtcgtggtaggaaatggtgagcgaacctccttttggtacaacaaatggttttcgactgaaagcttttcaagtcagttcagcaatctcttctcccacgtgtgtgacagacaaatctcagtaaaggaagcccttcacataggaatttctgaaaatcttgttccacgtttatctgaaactgcatcggcagagctgggctgcttacaggaattgctgcagaacttctctctgagcgatgagatggatttccgcctcagtgcaaagctaggaaagttgacaactaggaaattctatgaggcaagattaccccctggcttgccatctccaatctgggatcttatttggaaatgcagagcacctctaaaagttaaactcttcgcatggcttctggtccgtaatcgcctgtccacaaaagaaaatttgctgaagaaaaccattattcaggaggcaatctgtgacatctgcaatcaggaagacgaaatagctaatcatatgtgtttcttctgtccgttcgctcaggctttctggacgcagatcaacattcaaccgcaagctcaagacatcacgcagttccatcgtttgggtccaactatgcaagtgctggcgctacactggcaggtcttcttcctgctttgcatgtgggctatttggaatcatcgacacgatgttgttttccaggggaaaagcccctcactaagagcctgccttacaacgatgcatcaccgaggcagctctctgggcagagaacttaacggaagatgatcaatttgtaatctctgtttggaaacagatcttctcctcccccttacaatctatcaatcttttgtaatgaacttcttacctctaattgctactagtcgtagttgttacaaagattgcgaaggtcttccttcacttcattgcgcatagacgacagaatgaagagggcaatacaatatgctgaaacagcacccgttatcaccatcctgttgaagcttctccgttcttcatatcgtttaaccaattcatcaaaattctgtggtggatcgtattcaaaataattgccccagtgccgccccgtaggagcttcagtcttgggagatgtcgtgccgcccagcttattatcctacaattccatcaaggaaaggaatatttaataataataataaactacgatgaatatataataataaactacgatggtaactagatatattttaagtgttaatttttatttttatttatttatgaaagaaagggacagttgcatccacgctctcactttgaaccccagctgttgttttactcttactttttaggatttgcaattgtatcccatctttttaaaaacgaacccaccgtttgccctcacttttaaccctgttagatgggtcccacggttttgggataaaaaacacaaatagaaatagaaaattcattttatgaaatattaaattactgttgtacccttagtgaatggataaggatccaagcacccattccttcacagagctcaggtcaacatcccaaaactctagaggaggcggcggcggttccagcatcggcgtgcgcagcgacggcggcggctccgttggaactcgtgtgcgacggccgcggctccagcggaacgcgcggcgacactgacgatggttccggcaagaagcgcggcgatggcggcgaaactaacgtgtgcgcggtgacggcggcggttccggcgggaggcgcggcgacggtggcactcaagtgtgagtcgacagcaagtcttcggcgtggcggcagctgcgtttcatctcccttgcgtggtgaggcagtcggcataaaagttggtgcaaaaatacaacaacaatcaagggtataaatgttcttttgctctaaaactaacaccgtcaaactaggcatcaaaagtgaggacaaaataattggtttgttttcaaaaagagagggaaaaaatacaaaccctacaaactgatggtaaaacagcagttgagattcaaagtgagagcatgaatgcaattgtcaataaaaaaaaccaccaactaatttaattgattggacccagttgttcttgtccgttcaccaactgttcctgccctatacactcctactactgcttacgacaattacgtgtccgtcacttctgttactgcttttattatatatatgtgtttcagaaaaatagtctatcttgtcgtagacaagttgccaagatagactatttttctgaaacacatatagataataaaagcaataacataagttaggggataaaccccattatgttgccagaagataacaaattaaagcaaagagccacccttttgaaaagggaggttaattggactaaagaagtagacttcctaatggaactgagcagcagaaaaggagcaagtcgatagggagctacggcaatgtcgcaacgactgctacctagagcctcataagacgtgcaaaccgcttgacaaaccggtaatccccatctcggctgcctccacagaaacagcacaggacagaggtgtgatgctgagccgtagatattggtgtgagcttcaccggacacagcaaaggatctccacggagctcgtcattgaatctgaggaactctaacaaaaaccctgttgaccgaaatcgcgcatgtggtccgagctcaacccgaatgacaaactcggcatggtttctgctaatcaggcacaaaagagaagactgaaccaaagaccaatcaaccttcatcatgcgagcgttgtagtggctgcaaagatcctcctgtcttgctgagacgacgaagttggctggggaagatgaagtctgcatcaagagtctacaagagtctggcaagagcatacacccatccaccgccgcctccagaactccaaacatggcctcctccacaagaccacccagcaccaggaccatcatcgatgaggtcaacgacaacaacaaccggcgcaggtgagactgatggaggggaaccaaaggaagaagccgaggaggagggaccaacgaaggacacgagaagccaccgcagccgacgcaagggacaaggcggcgacctcccagccgaggatgacgacgctgccgacgccgccaccaggagccagctccagccgacgatttgcccacagatcttcggatctcgcacctccactgccaccaaccatcaccacctccgaccactccggcacccatggagctagccggcaaaagcaccaactagagacaaaccctaacaataggaagaacctgacgacctaataacagacctaaccacacaatactagtaaggggaggtggccggacccctataaccctcgccggcggcaagccgccggaatcgaggaggaagaggggccggagagcaggagaaacggggagggctactgtagaaaggggaaaggggaaagaagactcgagaacgaaggggtattcattgcctccttctgtggccattccagtcaccaagatagaccggagtttttctgttctcatgatagacctaagtcttaaccaggggtggattcacaatgggggcagaggggtcttgagaccccactaccgccccgggacagtggagacccccctaagccccactaattttttttccatagatccataggatatagggactggaggtttgatttatgctgatgtagtttattcagcccccactactatatttttctagatccacccctggtcttaacggtcactcgcctgatctgatgactatggattaccagacaagtttgcgaggaaaatttgtgaagtgatggacgggtaattgtcgtaatcggcaggggtgtagggcaggaacaactggtgaactgattaatcatggattcatgggttggtatatatttattcaaaaaaaaaaggtgacatacattgaacgcaatgttgtcagtatcccgatccatatcatagtatcttaggatactatacaatcctaccaacccggaatgataccgatcacatcttgtatcctaatttccatagtatctcgattgtactattcattattacacgatcctacgaaatcttgggtaatatcctaattctacgatcctacaaaatattatttaaaataagatggtttgaaaataatgtaaataaatatgctcaagtttatataaaaatcagttaaatatatcaaaactaatgtggtttctcttaataaatgtctctatttgtatgatatatattattactatatttttttatatataatgactatatgtaattaatacatatattaattgaattttaaaaaaaattatagtatcccgatcctacgatacgatattactttgatcaaaacggataacctttattgaacggcgctgatagtgggtatgatatagattgatagactttgttgttgactgacttgggtcgacgaccattgacgaaggcagtccaatgaaacaaactcacatatagagaacagtcatgatgaataaacaactgatccaagtgcactagaaagttaagtttcaagatccagcaataacagaattaaggcaaggctgcagcaccaccatgcccagtctcgtcttgctcttgatgatgaatttcgtgatgatggtaattgccacctttcctgaattcacatacaacggattcagcggcgccaggaacctcctcctcgacggcgccgcttccgtgggagaagatgggatcctctccctgacgaatggcagcagcggcgcccagcagcaggggcgctgcttctatccctaccctattcccctgcagtacaccggtggtgagacccgctccttcacctccaccttcgtcttcgccgtcacatgctccggctccggcagctgcggggatgggatgacatttgtcatctcctcgaccgccgacttcccggccgcctcttcgccggcgtacctgggccttgccaacccgcacgatgcatcgtcaaaccctttcgtcgccatagagctcgacaccgtcgcagacccggacgcgacgaacggcaaccatgtcgccattgatttcaacagcctgacgtccaacttgtctagacctgcagggtacatctacgacgacgaaggagccgtcggcaactctagctttcaggcgctcaagctttccagcggcgacccgatgcaggcgtgggtgagctacgacgccggagcagcccggctcgacgtcacgcttgcgctcgtccccatgttcatgccctccgtgccgctactgtcttacaacgtcagcctctcgcgattgctgtcggcggccgacgattctcccatggcgaccaaagcatatttcggcttcaccgcttcgacgggtggtgatcccggtggcgctggcgccacccatcaagttcttggctggagctttagcaacggtggattgccactcgactactcgctgctgcccctgaaacgagctcatcagggtcaggattatagcagaagtagacgagccaacaggaagagcttcgtcacatggttgcctgcagctgcatcagtgctcgccgtgcttgcagccatggcagcgtgtcttgtgctccggtggtgctggaagaagaacgcccggagtcgggaaaactgggaagcagagctgggacctcgccgcttcgcttaccgagacctccgccgcgccaccgacgggttcaagcatctgctggggaagggtggctttggccgcgtctacggaggcgttctctccgcgtccggcatgcccatcgccgtcaagcgtgtctcgtctgagtccaggcatggtatgacgcaattcacggccgagatcatcatcctcggccgcctccgccaccgcaacctcgttcgcctcctcggctactgccgccacaaggaggagctgctgctggtctacgagcacatgcccaacggcagcctagataagtacttgcacgagcacacgtactccagcaactgcaggacgctgggttggcctcagaggcttcacgtcatcaagtgcgtcgcggcggggctgctctacctgcacgacgactgggagcaggtcatcgtccaccgcgacgtcaaggccagcaacgtgctcctcgacgccgacatgaacggccgcctgggcgacttcggcctcgcgcggctgcacgaccacggcgccgacgcgcacaccacccacgtcgccggcaccaggggctacctcgccccggagctcaccaggttcggcaaggccaccaaggccaccgacgtgttcgcgttcggcgccttcgtcctcgaggtggcgtgcgggcgccggccgatggggcacaacgcccgcggcgagctgctcgtgctcgtcgagtgggtgcgcgacgcgtgggcggcgggcggcggcggctccgtcgtcgacaccatggacccgaggctggaggagtactccggcgaggaggcggagctggtgctcaagctcgggctgctctgctcgcacccgctccccgccgcgaggcccggtatgcgcctcgtcatgcagtacctcgacggcgacgtgccgctgccggagttctcgccggattatctctgcatcaaagacgtcgaccaggtccaagttggagactactctccctcggtggtcaccacgatcacaggtctgtccggaggaagatgacggccaatttaggcgccaccatgcctcatccttgaccacgctacatacttacatagtaggcaaaagtaatgcatggttcctaaaggtgagatggatgggtagctagtaagttttcttcttcgtttgtgttcaaatgttctttaaagttgttggatttcttacatgagatttgcttcggttcaacaaaaagtatcccgaggtacaggtatctcacgatatcaatcgtttccgatcattgaatctaacaatgcccatcctgtccaactaaatcaaacgatagaaaatgatttagtactgcgaggtaccggtactttttgttggactggagcaaatctcctaacccttacctctacggcggcggccacgacgcccccacggagggggtgcccgacccatactatgcctggagcggcggcggcgtcttacaagcatgtagaggcttgtgaatgataaagtgcttacacacatgtgcgtgcaacggatgaaggctattttaaacttattatttttatatggtttagttaagatgaaattcaccgtgggaattcgtttggatatatatatttttagaaaatcatgagctgcagtttctgtccaagcatctcaagttagcatgcgagtttttttaaacagatttcttatatgactccttttgtatttccaaaaacgaacgaacttaaaaatcgactcaaatatggacatgaatttccacaagcgatccttctgtatttgcaaaagcgaatgaacttaaaaaccgattcaaatacggatatgtattaacacaagcgaacgaacttaagaaccgactcatacacggatgatgtactaaagtactggtaaaaacatcttcaatttttataatagtagagatagagatatgttgtgtgtgcgcgcgcgtatgttgaataaacttgaagctgctgatctgcgagcaatcgcctttggttggttggttgattactgatgagcatgggtactgtagagtgctgatgagcttcaggaaagagctagagagcttaatatacagaaagcccaaacaaacaagacaaacaaagggatggcttacggagagcgctacaaatcgaacgtccgatgaaaggcgaaacatcggacaagttccagcacatgcaaaaaaatgtttcatatgttcataattcgatgagaaaatgtttcgacgagaattgttttagcatgttccatgacttgatcaagaatgtttaattgctctatcgaaaaatgttttaatcacatgcaacattcaagaacacttgttgcaacacacaaaaccagaatattgcaacatcaagaaattattgtaccaatttatgcaacatccaaaagagactgatcgcaacatcaagtaaatattgtgcgcaacatcaaaagaatatggcgtgcaacattcttgcccaactagtcgggcacaccagtctcacctttgtcagcaccagcatctgcttcttcacctgctctgacggagatggtggttgcaagaagctcccaagctgaagccatattcgtgcctctctccccatctctatggtggcctcgccccggatctgtcgatctgatactcgaggtcagggatggctagatctagccggaggaacacccatgttgggagagctgagggtgggagaggaggaagagtacacgagttgaaaaggagaagaacaggaaggcttcctaggagccaagaggtatgcggtggcggcgtctcgacgactgacgatggtggcgtgtggcgagagagagggacggagcgagagagaagaatcggggaattgaagaaggggcagttacaacgaggaggaggagttgtggacttgtggtgcgagaagtggagaaacgtgtggagcgtccgatttttgtggtggtatcgaacgaccgagttaaagcgtttttgatggcttacgcatagtaccaatgggctgcaagatcgaacttgatttacagtccaaacaaaacaaaaaaaaaaggccgtaatttacagcccaaacaagcaaaagaaagaattggtgacggactcggagaaccgaacgtacccgtatacacgcaacgtataaacgtacgtacggtctcgtcgatcgatcggtagatcggcatggctatggcggcgctgcgctctctgtccctgtctctggccaggacgacgacgacgacgactctccgccggcggccaccgccgcgttctctccaccaccaggttcgtttcttttcttctcttcgttcaattctctccctccgatccggccatatatattctcaatccgccatgtctgatatatatgtgttcttgatctcttgttcaatccgtcgtggaactgtatctgtaattctgaatgtataggataataagctcatgatgagcagctggagtacttctcgcaacactactggttgtaagggttgccaagatcgggatcggcttatcgatgaactggaacaagaacggaggcggtttgcgaggatgacgacggtaatcatatatatttatattttactagaaaaaatgcccgtgtgttgcaatgggtaaagacgtttttcactgatatattaagagctgagcaataagttgaaatattaggatcgctatatacattataattgaaaaagttaatgagaattttaacattgggatcacgttaatgagaattttaacattgggatcactatagattataataaaaaaaagttaatgaaaatctttcctgggttgggtcgatagacttccttccttttcagccctaggccagtccgctacctccctttgtttggcctgcttcccttcgacccagccacaagtggagccgaagcacagctcgcacagtctactaccatcttcagccagtctactacctccctccgtttggcctgcttcccttcgacccagccacaagtggagccgtaagcgcaaatctgccacaagtggagctgtagtgtagctcacatagtctactaccatcatcaacctcccgaagatagtcaagtggccgttcggttgccagagcaaatctccccattaaatctgggccgtacggttgccaaagcaaatcagcccataaaatctagtcgaatttttctcgatcacattatggttgagggtttttgatcattcgatcttctctttctgttttttttccaaaatcagagtgtaaaactatttgttcccatcaaatccggtcaaatctttctcgatcatccaaaattggttgagggtttctaatccactcctctttccttttttttccaaaattagtgtaaaactcggaataaaaacgaccatggaagatcgccgtcatcatctgcaactgttaaacggagattaaatccaccgaatcgaaaaggaaaataacggagaaaatgatgagggaggagtggggagtcgatttttgcaatcaaattggaggagaaaacgcacaatcgatatggcggcggcgcagcgctagggttcaaacataagaggtgtgcggcgaatagatcggattaaaaagccagatgaaaaaaccaaaagcgcataggagaaaaaaccgacgacaaaaaaaaattacggaaaaaaccaaaagcgccagggaggcgcgatcttctttttttacctatttgagtcggacttttttctttcctcttttaacatacagcggaaatttaagtagtagagataacataaaattaaaaaatcgactcaaacacggatgacgtaccaaaataccggtttagtacttcatctgtatttctactattataaattattattatctctactattataaaaattgaaaacgtttccgccagaattttagtacttcatccgtatttgaatcgattttaattctatgtttcgtttttaattttatgtttttgtcaaatcattttcttttttcttactatatagtgtccctctaatacgcacgcgacttaattgggtctgctcctgagtccgttttccacacgcgtctttgcgtgccgccgtgattgttttactttcaaaaagaacatgccaattaaaataaagaataatcgaagttgctcggatccatcaattggcttatgttgttgcttctcagcataagcagtctgatgcttatcggcataagcatttccatcagccgtagaaaagagtcgggaatgattggacccactaccaatggctgatgcttattcagcccaataagtgaaccgatgggcttttgctgagaatcagcctcagcaacagcgaaccaatgaggccagctaattatgtccatcatcaattcctatccgacttgtgatcaagctggatgacaaatcgagctcgtgtttgaaagcctaattgtttggcttattcaatcctagaagtcaaattttaaattttagaacttaactttaaattcgactttttggttttttattatactttattttacaacattcgcttttgtgtcgctaagaacatgtatataaaagatttgcacgcacaaatagtcttttatttgataataagtgattcgaataagcacatgaataaatgaaacaatacgatgtgattatttatccattgcaacacatgtacaaattaaattttctctacccgttgcaacgcacgggcatcttttctagtttttataatagtagagaagtgttaattttgatgtttattcatcgtagtttattattattattattattattattattattattattattattattattattattattattattattattattattattattattattattattattattattattattattattatccctttccttgatggaactgtaggataataataagctgggcggcacgacatttgccaagactgaagctcctacagggcggcgctggggcaattattttgaatacgatccacctcagaattttgatgaattggttaaacgatatgaagaacggataagcttcaacaggacggtgataacgggtgctgtttcagcatattgtattgccctcttcattctgtcgtctatgcgcaatgaagtgaaggaaaagcttcgcaatatgtaacatctacgtacgagtagtagttttttaccgcctatccggtgcctacatatttatatatatagtactcatgtctcaatgtgtgtgtattcttaaaaaaaaaaagaacataagacgcgaatattgaa

SEQ ID NO: 75407 - DNA, 29628 bp, Oryza sativa
cgacgacctgggcgtcgtgctgcacgccatgcttgccaagaaggaggagctgaccgcggtcggcaacaacgggtccgatccctgcaagaggctgcggatcggggccgacacgggggcggtggcgtggggacccggcggcgacgcggccgagatggcgcagagcagaggcatcgtgccgttcccgtgctctgctggcggcgctgccatcggagtcgtgctgggtgccgcccatggacgaggacgactactcgtcgctgtccccgtggatgatcctgtcgaccaccaagtccgtcaagtacatcgacacggcgcactacgcggtgccgggcggcgcccgcgtggttgagttggtgaccggcatggagacggcgatggtgcaggaggtgagcaccgtgcccgggctgtcgtacaggctggagttctccgttggggacgccggcgacgggcgctccgggtccctgaccgtgcaggcgtacgcgtgcggagatgagagaggcggccggcgaggaggcgggaggaggagggcggcgctgctggcctgctgctatgccgtgcgacgaggagggcggctgtctgccgaggagaaggccgatgtcggggccaccgccacggcagtccgctccatcgacgggcgcacggccatcgccgcggcgtcgggcggggtagcggccatgggcaaccccaccgccgccccttccgccaccccgtcctccaggggcctgctgctggggcggccggcgaggccgacgcggagctcgtggccgcgcaggaggtggccgtggaggttgcggcaagcgctgcgggtcgtcccgtcatcccgatggctggcgagggagggagaagcggggcacaccgtcgatgtggtggcggcggaggaggaggacgccgggcaccgctccgtggctggatccggccgcggaggaggaggagacgaggaggacaccgacaaccactatggcaacgccgacgaccaccatgctcaccagccgccgcgcgctcgcacgccgcctccgccgcccgccgctcagccctgctcgccgccgcccgttcttgctactcccctgccgcaaagagaagtaaaaaagaagagaaaaaaagaaaggggaaagagagagatgacgtggcacgctgacacgtgggtcccacgctgactcagccgccacgtaaaccaaaaccgtggtcaaaaccaccgaaggatctcggggtgatcggttttgtatagttaagataccccgtgtatctggttttgcggttcgaggacgtattttatcccgatgataagttgagggaccttcggtacactttttccttcaccggccggccacgccggacaagctacaggtgcggcatgggctgtaaagcgcatggagaggcccaactctctaacagttacgaataaattactttgagtttggtcgaagtcggttatagacaaatataataatatttatattactaaattaattttattaaattaataattaaatatgtttttataataaattaatcttaggtcgaaagtattactatttattttataaactttattatacttgaagcagtttgattttaaccaaagttaaaacattttataacttgaaacggagggtgtaatgtatttgttgattatcactggattttcaaagaaaaaggaaatcaattcattattctattatccatcaagaaattaaaacgaaagcagtcagcagcttagtcaaagggaaacgtacaaactaatgtccaatttttgaatcaatccaactcagaaataaccacacacttggcattaatcaaagggaaacaatcagaagcagcagacacagaaaggtagcgaacacaaagagccagccaacaaagccatgcaaagaaattaaacacgcattaaccagcacttaaataaacttaaacagcagatgaagaagccgcagtctcgttgtcggcggcggcggcggcgggcctggagacgatgccggcgtggttgagcagcgcccagagcagcgtgatgagctcgccgccgcgtgggcgtccaggttgtcggacggcgccaggtacaggatgatctccgaccaaaactccgcaagaaccccccacgccttattcccttcctcctcctcctcctgttggttttggaccaacgccaccagttgctccgcgagctgcgcgccattccttaacaccttgtgcctgcagcctgcgctgagcaatcggaccagcttctcgtactccggtggagcacgaccggcggcgagagcacggcgagcgtctgccttgacggccttgtacaggtccttgctccagccatcgtcgtcggggagcagctcgggacagcaggccaccaggtaggcgcagtagcctgacaggtgagtggcaacaaccctgttgctgctgtcagagcttgagcttgcagttgtacttggatttggatacttcacctcaaggatggtggtggcgatgtggcacaccaggaggacgtcggttgtggctgtcacatcctcccagagcagctggctgtcgctgccctgcagatgcagagacgccgtgcatgctttggtcagctgcaggctccccttgctgctcctgagcttggcgacgatggcggacttcacttggtcgggcaccttgacgatcttggttttctccggcagcggcgaccactttgctgttggacgatgcatgtccaggattgagcagaggttgatgttgtccttccatgggttattcaccagcttgcaactgcatcgcaataataagcttcagcatccaattaccaatgatgatcgtcgtcgtcgtcgtcttggcatatcaactggaggagcagcaggagacgaagatgtggtctggtgatgatgatttgttggttgcaggtagcggcagatgacaacaactttggtccagttagagaacaaaagggaagcaatattcctcgcctcggaaagcacaagtagcacacaaagaagaatagctggcactagatcaaatgtgagacttccaaatgtataataatcttcgaatcttttgaagtgcccaaggaaatctctggccccgacatctttgcatggcatagtacaccatagttggaaggagttggagaaattcacgcaagcaagagtggtcgacaaaacggctagacgtaagctgtaagccaaggtgaagactgaggtagagaaggtgaggataggaagccagcaggtgtttgaataaaaggtagggatggatgcatagtaataatcgtgaatgaatgagagctcatctgctataaccttaaacaccctcctgctgctgctgctgccaccatcatgagtactactggtcagcaacaggccttgccaaatgaaattctcgacccaggtaaacttgagctcatcagctgtgtaccttgcgaatcgacaacgtaacagcttgaacaatgcaaatgaaagacaaacatctttcagctgtttgtgtcctgcaggtgtccagcttgtcagagaataattcgtgtactcgtcatccatttgctgccaaacttcatctaagttcaccaagccagcagctcctctctgctgtagattattatcaactacactagtgtaactattgggccctttttgtacattaacagtgtcctctcccataactaaaagtggcggaggaggcacatcatcgccagttacatgcattactgatggtaggacgacgtccttctccttctccttcatgtatccaagcacaagccgaggattccgtccaagagcaaacgattgtcgggccatgaaaaatgcaaccaacttgaaaaccaatttgacaaacataagacacgctgaaaccagcacaaatattctacgaaaatcactcatatcctgtgagatggttttgactgaaaaatcattgccactaccaaggtccgtccccaggaagtagatgaccaggtagcaagtccagattgcatgaataatcaataatgcagatggtgcaatgcttcgtcctaattctctagcatcagttgccactagtgttatggtgttgatagcggcaatctgaacaagcactgtccactgtaagatacaaaacgtgtgtaggagccatctgcaggtcgctgtggttgtaatgggttggatgagaaaggtaacaaaagtactatcagagacaacataggacactataggcatgaagagtgcagcggcaccctggaagaggaagcgagtcaaggggtggtgtcggtagcgcggggcataggctccaatccccacaaccactcccatcaacatggcgttcaccattgacagagagttcactcgccatatctcccatttcgcccgcttctccagcaacctcacctcagcatcagtacagtttctgataagtgaacttgcgcggtccatcgtcgacctccaattccagaggtatgtgtgtgtgtgtgtctatatatatatatatatatatatatatatatatatgaagggtatgaatcaaccgatgaagagttagatttaattgacgaactagccggtttaaaaatagaaatgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttacaaaacagaataaataaactagaagtagaactagagaacctaaaaattaactataatattaaggcattaccagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacaattaaagaaggaattgaaggaagaaatacttaaagaattaaaacaagaaatggatcagaaatttgagcaaataaaaaaggcagtagatgagaaattagaagtttctttttctgatttggacacaatggatcttggtgaccatgggcaaccagatgaataaattgatataagctaaatatgtttttcaatatatattgataatagaatatcaacaatttgggcgtggaagaagaataaaagaataaaagaaattcagaaagaataaaagaaattcagaagactacccaagaaagaatccagaaggacaccctataaagtataaggggacaatatagggtgcggtgaatgacatatccctgtgaagaataaaactttcggtggaaaggcctcaactttagccagctctcatgaagatacagtagcgaagagataagcaggaggcacaggcgacgccatccctggcctctataaaaggagacgttggccttcactccggggacacacaaccacgaagacaccattcagagcaaagcttccaagcgcgctctcaccctccattccatctttcttagtagtagttcctctagcctaccttgcataatatatattgaagcaaggagttgtaatataaaggtttgtaaagtgagaaaaacttgtttgtatctaccttcggggttcccgaaagggaaaaccgtatgtaagcctatttgcttaatatgaagtaattttctttaagtttccctgtttgtttgctctagataagcgtttatgctagggaccctataggagaaacctctcggttgttctcgtttttagcctgcatcttgcataggcgtctggagaaccagtatccgtagagaagtgttcccctcgggtggaactgcctggggagacggtaaacgcttagctagttcaaatatgactagggatacctgaagatggttgcttaaataggcagataagtgaggcatacggctagtaccgagtaggactttaaaatttctaaatcaagcgccggctgttattggattcgccaccctgcaaagatcctaaaaatttaaagaaaattttcgagtgaacagtaacctgtgaacagtaattctgtactcataatagtgaattcagcactaagaatagtagtgaataataaagtggtatatatatatatatatatatagacacacacacagtggcgaatccaggatagacaaagagggtaggcttgacctccaagtactaagttaataaaaagtaaattgcagtacttacagtagctgttcaacacatacatgatacatgattgaatagaaaagaaagaaataaagaaaaataccttgccaatgcgaagtaattgcttacatcagtcatatgagaaatcagtgataaattgaaggaaaaataacattaactgaaagatttggcctaccattaatcaaaaaatacatgtaattcatttaagaggcaaggatattctatgggtttctaatgcttggaatatatttatgatgattgcatcatcgtcgtcatcatcatttttttttgaatatttctcgctcagtatagcagaccatcaaattcaaatctataagccacccatccgatatcttattgtgcacatctgtcttgaaatgctcgtgcttgaaaatatgcgctccactcaatcaatagattagtttgcagaaattgaatagaataatagaaataaccaatacagccaaataggcagcaaccagcaagaccatgattccatttattcaatgactcaccggacgctagtttatcctgctgctgttggctgctcctcgccgcgacgccgcctgacccgctgatcctgagcctgctgctctgctagtgctagcggctgctgtggtgctgctccgcgcgctgccacggcgcctgctgacgcttccccgcgcggccgctccgcctgcagcctgccggcttccgcgccccgctcgcgcctgcggccgcctacgcttgctcttactcgccaccggacagctagctacgacgctgcagcctgcagctcgaggcctcgagctcttgcgagttgcgactcgcgtcggccgtcggcgtcggccgctcccagtcgccaccagccgccagcccccaccccaaacgcccccaaccctaagtccccacctgacctgtgtgagtgtgtaagtgtgggaagtgggccactggactgggccattactatcgaattgggccaacctagtttatctgcataccgcttcgcttcttctctctcatgtgccctgttcatcttcttcccagcgccgagcacatatcgccatgaactccaggactccggctgatgcttgaggatacctagttgatttttttttgcaaaaattagagggtaggctagaacctaatggagcctacctgctagaatcgccactgtatatatatatatatatggtactcttaattaatgggagtatctagctagagacattaatttttgtaaacaaaatttcaaatataactatagtacaattattctaactacatatattccagttaattataatgtaacttgtatataagtaacttatagtcatgaaacacaagcgcgcgtagtgtgcgcagctggctaccatcgggatcgagttcgaatcccaggtccacaaattgattgtagtttttgttaggttttcgtgtgtctatccggcctacgtaccctgtattcctctgcattttccatggtgccactcacagacataatgcatattgaggctagctagctagagggtagggatctatttatagaatcttcttccagatatacactatatctatttccggtgggagatttgcaataatgatactgtaaacattaatctttgctataatgacactggacccacatttcatagatacagataggcctatttgccatccactcggagtatcaaaacagcgaagccccaatgtttgcagtctcaatattgcaattttcttcggtacaccgttaaactcccaaccacaataagacagttcagttaaatgagtctacaatataatagtcccgagcacaaatgtgtgagtcatgtgccatgatcatattgtatatgagattaattccaatataatcatgtgggtcaatggcttatagagcagatcatgtaaacaaaccctgctattccaccttctgctatacccaggtataaatatgtatgtacatataaattctatagtatatctctattattcatctactgtatttcagcacagtcgttcttggcacctctagtattaattcctcgagttaaattccacatcaatatataattcctcatcacatgcagcacaaatgttttccacattgagttaaataaataccataatatataaatgttgtaagccatataaaagtccaacagttttaactaagagggaaattaaaaaaaacttgcttcctcgaaaaaaaataaaaaaaaaacttgggcaagaaatctagctagcaattccgatcttaattatttgggcaaaagtactatatatatatgtaccaagctcgtgtgcatgcacatcatcacaacatgcaacaattaattaaaaactaacaggtgtgtgtaagtatgtaaaaggtagctggaaccggatcctttaacgtaattcattctacgtcagagggacgttcaaccacggatcgtcgttccttgcgcatccgacggcaaccaccgtttcagtccgtcctcgcctcagaccccacaagtgcgatgtctctgcttgctctctggcccattcgttgatagcggcagcggcgccgcgccggccggccacccggaagctcaggcagccgtgcgctgccgccggcggggaggtcggactggaacgcagtgctaccgccgtccgccggcgaggtcgagggcgaggactctgcaccgcctcggtgtctgctgttggtcccatcgcccagcaactgctgtttctcggaaccatcgccggcgaggttggattggaatcgatccgtagtctatcgaacttgcatcatcaggttgccttttctcatggaagaggcagctagttgaaattcttgctaaggcattcgtgctgtcattggcttgtcccagaaactaccaagtaacctgaagaattaaaatcagagctgaaaccagaactttgccaacagattcatatagaatgcggcatagcaagtctgcaattgcaataaaaaattaccaaaaaagatggtaaaagatggtttttctccttgaagaagagatcaatcgagtgcagatgttaaccaaggaaagaaatctcatggcacgaaccgaagagaagatgagtaatttttctgttctttttgttccccgtgtagctcaccaaggacggttccgagaaacaccgacagcaaacaccgaggcggtgcggagtcctcgccctcgacctcgccggcggacggcggtagcactgtgttccagtccgtcctccccgctggcggcagcacacggctgcctgagcttccgggtggccgaccggcgcggcgccgctgcccctatcaacgaatgggccggagagcaagcagagacatcgcgcttgtggggtctgaggcggggacggactgaaacggtggttgccgtcgaatgcgcaaggaacgacgatccgtggttgaacgtccctctgacgtagaatgaattacgttggaggatccggttccaaggtagctagctagctggtataaaaacaggtctgtaagagtattgagaaatcttacattcctttgagtctcaagtatctcgaggtatttagattttacattaaaatttctactatcttaaggtacttagcatatgatgatattaaaattttatattaaaaaatgtggtatctcccactaccttactctaaggatggtaaaaaaaactgacgccaaactaactaattaaaggaagatgcgtgcatgcaagcttcttaataattattattttttaaaacaagctagaaagaaaagtaatagctagaaatgagagagatcaattacctggtactccctccgttccaaaaaaaggcaaaccctgggtttgcgtgtccaactttgactatccgtcttatatgaaatttttttataattcgtatttttattgttgttaaatgataaaacatgattaatattttatgtgtggcttgtctttttaatttttttcataatttttttaaataagacggacggtcaaatattggacacggaaaccaggtttgtttttttttttgggacggagggagtatatttttatacgatcgaacggatgactgacggcctgatcaaatcgccagctggcccgcagctagaatgaatatataggatcaactaaataattactccgtatcagatagctagcagtagtgcagagcaggtcgctggatatcgtgttaatttgtattatgcgatcgagacaggacaaggattatatatactactccaaggctgtgtttagttcaagcgaaagtttagattttggttaaaattagagatgatgtgactgaaaagttgtgtgtatatgacaggttgatgtgatgaaaaaagtagaaagtttggatgtaaactttggatctaaacacactccaaatgtactactatttacaaattaagatggccccggccccatgaccccatctcatgcatatgcaaatatgccttttgtctttttctttttcttttccttttcctcgtgcttgtcgctcaagagtgttcttctttctcggaaaactatagctacgctacgtactcccccaattcccaattaatcaccatgcatatataattcttttagttatacgtaaataatcatcgtattagttttccttcactaaatctgctcgctatgtgtgcatggacgaagtaaatgtattgatgcatgcatccatgcatatgcatacaaccatttacaacaaacatgcaatatcttttatggtttggtagtggctaggaagtattagggcaagttttatagtggagatgatagtcacccttaatttagttcacatcatcaactcattaattataagaggcaatatatataacaaattacctctagcacacttgccccggtacatcatatattaattttactttatttgtttcctatcaattcattggtctcttgttcttatatctctagaagtttgtggagagattgcctcttgcataagatgtggctccttctctctccttgcatatctcaaccacctcattatgtgagtttatatggcatctagaaataaatgtgtagaggtttatagtacttgcccttagaggatttatatggcatctagaaataaatgtgtagaggtttatagtacttgcccttagaggatggtacatgtattcagttctgttaccaaattaaatgtaatatgggagagctactgatttttcttggttttgtatacattcctataatatgataatcaattggcaatggaaggagtaaatatatgggtaaggtgttttagtgatttattaaattgcatggctctgcttttgtcttgcattgccacaccttttcctttttatttcctctgacacttccctcttttcttaaagagatttggatcgaatatattggatcgcttgcattgcgtatgcgtactcgatctctccttttcattttgggaacatggttctttgcttccgatcatgctgatctatcatgcatattgttgcatactcctttcgtctcataaaaaaataaatgctataaatgaatctggacataatgtatctctagattcatccatttgattttttatgagatggagagagtatattgcacaagaaggaaagaaatgctcctgccagctgcagcagctgacaaataaaggccggccgggcccctattgtctcagaggttaaagacggaaggatgtgctataaggggatcaaagtactctgtctaattctgatccgatcggattttgtttggatgggctgggatcagcagagatcttgggccaattaatccacttgtaaaataaggcccagcttggcttcatgatcactcttcctgtacgttccatgagaattttgtaggaacaaatttttgaattcaaataaaaggattcaaaaaagaaatccaaaattaaggtgtgatttgctgtgcagtcgatcacaccatcgccagagccccgcagctaatggatacaccaagggggtcgacagggggagcttagagatgtgcactaaccatcaacactatcgtcgtatttgctgattgcaagaccgtacgtgctctccggccggccactcgagctcgaccagaccgggtgcccctaacgagcgaccagtccgctcctactagctacctgctgctactgatgctgctgctgctactactactgcttctgctgacatgcgctactactactacaacagtactactacatgtatatatacgtatatatatactttatatacatacctatagtttatatatgtgtatacaaaatatatgcatatgtatatataatttttatgtgtaccagaaaattggcgtataaaaaaatatacatgtatacaaactttgcatacgcgtatataggggtgaaaacggtacggaatatttccggattccgggtaagttttcgaaaacggaattggccagtcgaaatttttcggaaacggaaacgaatacgaaaatattttttcggaaacggaatcgaaaatggtaagagcaatttccgtcggaactcgaaatcgatcggaaactttctgaaaactttctcggaatttccgaagttacaaagtccataatacctcccacttgcccagcccaacccactactggctggccagtggccactaaccagctaaccctagttgacgagagtgagaaccagaggcagtgcatcgcacgcaccacgcaggcacaccgcacgcaaccagacctggcgctgtcggccgccgccgtctcgcgccgtcctccccccgccgtcgctcgccgtccctgcccccggcgtctcgcccctctctgtgcttcaccgtcgccgtccccgccgcctctcgccatccacgccgccgacgtcgatgcccactggtgactcttcctcaccgccaccaacgccgacaacgcctcgccgccccgctgcccgggcatcatccccctgcgtcgccgcccatcccctctctacctggttgggaagcacaagagaaaaaagaagcggagaaagaaaagatatagggagagatagaaaagagatgaggaggaaagagagaaagaaaagaaaagaagataaaataaaaagagagtgggacccacgcctctccctcagcccttgactcaacgttgaccggcttacagtcgggccccattaaaatatttcatttgatatgattgtgttttgtaatgtattgttgattgttaaaacttgagaattgtacctgacaaagtttgaagcttagcttgagggacttttgtattctgataaattttcgttaccgtattcgcgccggttcattttcgctccgttttttgtttcgataatattcgattctgttttcgtatccggagtttttgattccgattctaattctgaaaaaaatatgaaaacaaaaaggtaaagattgtttccgtccgttttcgtaccgttttcacccctacgcatatataaactttacatatgtacatattaaaaaccgagagaaaaaaatataaatacaaactttctatacgtacaaatacaaaacttggtatacatacgaatataaactttgcatacgtacatcttaaaaagaaaaaaaaagaagagaaaccgaaaaaaaccaaaatagaaagagaaaaccgaataaaaaacccggaaaacccctccgcgtgggtaccgtccgccgcccccctctgcgcgcgacacgtgttcaatcacgcgggagggcgcgcgtgactggtcaccgattagctttttgtgacaagaccagccacttcaccgctagctagcgctggctggtggaaaggagattgcggctgcaggctgacaccgcaagtcgccgagacgcacactcgcgataaatacggacgcatcaatccagttcaggaggataagggcaaatccgtcctttagtttctctttattatttggcagaaagcaaatgaaaaacatattaaaaaaattatagaaacggaaggcaactaaaacttttgatggtatatttataaacttgtaaactttcggcgacaccaaactaatttttttatataatatattatagatgtcggtttttaatctagccgacccaagccagagggtgtgggagggagatattccagtgaggagaggagcgtgccttatcatctctatctctatcgcccagtgtcacgcccagaaattaccgaatagaattccaagcagaatgtgcattaaaacccccgtccaggaccggccggggtacacaaacgacaatgttgacatacagatccacgtcttacaaatattataaaagtcttacataaatacagcggaaaaacgaaagataacaggagctaagccttgacttgaactgcagcgggaacaccactccacaggcatcctcgacggcacggacgaagcctactcctcggagaacccgccatcggacacatactcaaactctggggttggggggaaatagagcaagactgagtactatccactgtactcagcaagtcataccggaatagaggtatgatgcagggatttaacaagggatagctatacatgttcatttgcataatactggcatttataaacagaagttggatgcgaaaaactgttgtaataatttaaccaatattaatcatccactgtccaacgctaccccacgttgcaacaggcccaaccatccacctgtactatccaatttcattagactaaactaggataagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccgttcgcataaccccctctagccaagcacaccacacctcaggtttcacccccgtccccagcgggcgacgggcagtcccctctcgtgcctaggtgaatccggaagacgcattggccgtcgcagggcccatccaaactccatcacgcccacccttgcctggatgcgtcagctagagaaaagctacactacaagcccagccgttgcccacgctggcttgtggtaagcacgataaattcttccagggtttcccgtgaaccggtccttaattgccatgggtgcgactagcaaaaccatgcacccacagcccaccatgtgattcattttaattaaccaacaccaaaacggtggtactaaaccaacattaccatttgaacctaaagtctatattttaaagagatttccccattgtgtgctagttgaactaagcatggctaagcaattcctagtccaaagtctattcatgttaggacccaagctaacaaaggagcatggtaccaaaatagcatggctgtaacaataggtaaacatcccatagtattattgcaaaacaaatgcagtatttgaaagaaaacattaggacatttgcaatataggatcaacatgatcaagtgacaggcatgacttgccttgctctgctgctggaggaacctcggcgactatctcgaagtacaccggagcgtcggaagagccggaatctaacgacatacaaggcaaacaatgcaaacaggctataagactactgaaacagagaacaaaaccatttttaatggattctacatatttttcttgatttactgagacttgaatgggcttaaatggagctcggatgaattagatatgaattttagaagattcactgtgtttatttctataacaaaaagtccttaaataatttattgcacaataaatcgcagggctgacgtcatcaaggggggcagcgccgacaggcggggcccgcatgtcagtggcgcaaggggagagaggggcgccggcaagtggggcccccgggtcagcggcactaggcggccggtccaccgtggaccggaccacgtgggtggtccaccgccggtccacgggaccgacggcccagatcgacccggggccgatcggacgggcggcggcggcctcgctcggctcggctcggcacaaggccggccgaccggccacggcaagggcggcggcgcgcgcgcgcacgcgttgccggcgacggcaaccggcggcggatgcggcggcgcaaaggcggcgcgaaagcggcggcgctaaagcggcggctaggaaggagagggaggggaatagaggggaggggatgcctcaccgagggtggccggcgcggaggaagacgacgtcgaacggcgacggcgagccacgggaggacgacggcaaccggcggacgagcttcgggatgccctaaggaaggaaaagagatagattagagggagggagatgaaccacggcggccggaatccatggccgaaggcggcggtaggggtagagctcaccggagtgcgaggggatgcgggttccggcgacggacctcgacggaggaggggcggacggggtggagttcggcctcgcgaacccgtcggcggcgacggtgcggtgtggcgacgaccctaacggcggctagcggcggccggagcaacggctaaggcggcggcgggcggaagcatggcgagggagcgatggggagcacgagggagttcggcgagatgggaaaaaagagagagggggtgacggtggagcttaaataggggaggggaatcccggacgtggccggtaggggcgggatttcgccagccaatgtggggagtgggggaggagagagaggcgggattcgaaaatcgaatcccggccatctcgcgcgcgggcgcgggcgagagagagggggagtgggcgcgggaggtgcggcgcatgcgcgggcgtggccgacgtggcccggaggaggcggaggcgtgggcgcggcggcggttgccggcgcggcggcgcgggcgcgaggtgggagacgggtccgacaggtgggccccacctgtcagcgaccccgggtgagaggagggaggcggccggcccgcgcggcttagctgggccttggccttcggccggcccagcgggaggggaggggaggaaggagaatgggccggcggcccattcaaaagaaaagagaaaggaaaataaggaaaaggaaaaagaattttccagggattaaatattgcttatgctccattttaattggttaaatttatttctagggctctgaaaattccactaaaaatcttgttagcgaatttcgacatgtagaactcaagaaaaattccacatgccagtttcgattattatttgcattaatttattagggttttctcttgatttgcaccggcattttcttagggtcatttataaattcaattttaggcttgggaggagaacttcagggtgtgacaaacctaccccccttaaacggaatctcggccccgagattcggaggagttggcgaagaggtgcggatgggcgactttcaactcatcttcccttttccaagttgcttcctcctctgaatggtgactccactgaacacggcagaacctggtgaccttgtttctagttcttctttcactggtcttaagaatgcgaattggcttctccacgtaggtcagatcctcctggatatcgatgtgctccgaattggcctgttcttcaggtaccctcaaacacttctttaattgggatacgtggaacacatcatggatgccgatcatattggaaggaagctctagctgataagcaacttctccccttcgttccaagattttgtagggtcccacgaagcgtggtgccaacttgcctttggtttgaaaacggtgcactccccggagcggagtaacacgaagatacacgtaatcccctgcttcaaaagtgagctcccttcggcggttatccgcgtagctcttctgtcgagactgggcaattctcaacctttccctgatggttatgactttctcttctgcctccgctaacacctctgttccaaacagttgacgctcgcctgtctgatcccagaagagaggtgtgcgacacttccggccatataaagcttcaaacggtgccatctgtagactggcttggtagctgttgttgtacgagaattccgcatatggcaagcttttgtcccaagctccaccaaagtcaagagcgcaagctctcaacatatcttccaaaatttgactgactcgctcggtctgaccatctgtctacggatggttggcggtactgaaatttaaacgggtccccaattcttcctgcagtttctgccaaaattttgaggtgaactgactccctcgatcagatacaatcttcttgggtaccccatgcaaacacatgatccttgccaggtacaactctgccaatttctttcccgtataggtggtatgcactggtatgaagtgagctaccttagtgagtcggtccacgactacccagattgaatcgtgacccgatgatgtccggggcagtcttgttataaaatccattccaatttcctcccatttccattccgggattttaagaggttggagtaagcctgctggcctttggtgctctgccttcactcgctggcaaacatcgcagagtgcgacaaattcaactatttctcttctcatgctgacccaccaaagcttttctttgaggtcttggtacattttggtgctgcctgggtgaatggaatactgtgtctgatgagcctcggtgagtatcatatccttcagttctttgtcgtcaggtacgcacaatctttcccccatccagattgtgccatgctcatcctcaaggaaatctcgagcttttccgactctcatgttctttttcagttctgctatttcaggatcatttacttgagcggctctaacttgatcgacgagcgtaggccgtgtttctagagcggctacgaacccctgttcaacaattcccacgttgagacgctcaaacaactgctgcaattcctcacacatgccctcgatgcatagggcagtgcagtaacttttcctgcttaatgcatctgccaccacattggctttccctgggtggtagtgaatgctcatgtcatagtctttgattagttccaatcatcttcgttgtcggagatttagatccggttgggtgaagatgtattttagactcttgtgatccgtatatacttcacaacggttgccaatcaggtagtgcctctagatattcaaagcatgaaccactgctgccaattgcagatcatgagttgggtaattcccttcatgtggacgcaactgtcgcgaggcatacgcaaccactctgccttcctgcattaaaacacatccaagcccgtggcgggatgcgtcgcaatagacttggaagtctttcatctggtcgggcagaatcaaaactggtgcggatactaatttctttttgagctcctcaaaactcttatcgcactcagctgtccatttaaacttctcatctttcttaagtaactgagtcatgggtcgggcgatcctggagaagttttcgatgaatcggcggtaataacccgcaagtccaagaaaactccgaatctgcgacacggtcttcggtggggtccatttggtaactgactccacattagatggatcaactgctacgccctgagctgtaataacatggcccagaaatttgacttccgtcaaccagaagtcacacttgctaaacttggcgtataactcgtgctccttcaacttctcgagtaccaaacggagatgctgctcatgttcttcttcggactttgaatagataagtatgtcgtcgatgaaaaccacaacaaacttgtcgagaaattccatgaacactttgttcatcagattcatgaagaatgcgggtgcgttggtaagtccgaaagacataaccgtgcactcatacagcccgtaccgagtggtgaaggtcgtctttggaatatcctcttcccgaattcttagctagtggtagcctgatcgcaggtctatcttagaaaacaccttagctcccttcagttgatcgaacaagtcatcgatccgtggtaaaggatatttattcttgattgtgacctcgttgagtgcgcgataatcgacgcacatcctcttcgtcttatcctttttctccacaaaaatgactggagcaccccaaggtgaagtactcgttcgaatgcaccatttctgcagttgctcatcaacctgcttcttgacctctgccagttcattggctgccatcctctacggtctcttgtagattggagtggttcccggtgccaaatcaatccagaattcaatctctctcttgggtggcatggtagtgaggtcttcgggaaacacttttgggtactcgccggctatggggatttcatccaatttcctcgaattcttctccacagtgaccactgggatttccgcctcaatctaattcaaggagaccccttgctttggtgagactagagatttgaacactacggtttctcccttctcgttggtcaaggcgactgtgcgattcgcacaatcaatgactcccttgaacttggtcagtcaatccatcccaagaatgacatctaggtctttggagttaagaagaatgaggttggctagaaatggtgatatttgaatttctattagcactgaagggctaaaattgaccgaggttgaactatttcccggggtatgaaccctcattggtgtactaagctcttctttccttaacccattcatccccacaaacttctttgaaatgaacgaatgcgttgcaccagaatcaaaaagtactgttgcagggattgagttaacaggaaacgtacccagtacgacctctggtgctgcttgcgcctcctctgcagacgcgtggttgacacgagcctggacgaaccttggcccggcacgcctaggctttgggcatttgtcggcgaagtgaccaagctcaccacagttgaagcaggaccctggctttgttctggtctccttcttggcttgcgcgggcggagctgactgtgctggtgccactagtgggcgtggagctacaccgcggtggggctgacctccatggtggttctgactaccactggcgccctggtgaaagttgcttgagttgaacgggcggtgctggcggacgatcatggtggtaggtccaccctgctgtccgggagtgaagcgcggtcgctgatggtttccttggctggaccgaaactgtgccgcctttctcttcctgtccattttgttgcgctgatcctcctgacggattgccttgtcaaccagcctttcaaagtcggcgtagtctccagatatcaactggttggttagctcatcatccagacctgctaggaatttctcctgcttctaggcgtcagtgcggacatcctccggtgcatatcgcgcgaggcgattgaactcatggagatactctgtcactgtcctgttgctctgatggagtgcccggaattccctcttcttttgtgccacgaccccgtctggcacctgcgccttcctgaagctgcgacagaactttgcccaagtgacttccgtgcctggcggacgtgtggccatgtggttgtcccaccgagctgacgcgggaccttggagctggtgtgtggcgaaagcgaccttctcctgatcattgcactgcaggagattcagcttcttctctatggcatggacccagtcatttgcctccatggggttggtggtgctggagaaagtgggtggcctgacacgtagaaattctggcagtttggattgagggggagggggaccaaactgctggtgatgctgttcggcgtgctgttgcatcctctggtgcatctgttggtgctgctgctgcatctgttgcatcatggctgccatcatctgagtctgatgtgccatcacttgggccagcgtcggattctcgggaagtggtggcggactattgtcggaatcactgttggggtgcacaccatcagtgcgctcttcgccgttgctgccctcgcctgttgtgcgggtgccattcctggtgtagaccatctagaggaagagcagacggggaaacggagaaaaacagatactcaggaactaagctttattatatagaaatttaaactgcaattgttctgatctgaattaaaacacttaaacagcaagcaaccatccttattaagacagccatatcataggcacatgatatcgaccgtcgactgaccccaagcgaacagacctacacacacaaactagcagacagaaactaagcagtcgataaactaagggaaatcgagcctaatgctcggaacggctcctgcggtcggtggagtcgaaggcgtcctcctgctcgtcaccaggtccctctgagcgactcctggagcctggcagatatgtctcgccgctgcccggctctgagccactggaactgctgctgctgcggtcgcggctgccactgggagtagctggcaaccaacccccattgccactggcggggcccctgacggctgatgcaggcgcgaaggagagagcggatgccggagctgacacgggaacaggagctggagctgctggagctgcgggtggagctggaggagctgcgggagctgctgacggaggtgggtacctgggcgcaagctggatgcgcatgggtgccgttgtcgacttgcggggcgtagtgcggatccggactcctcttggcgtgggtagcccctttaactgagcattctccctcttcaggcgcgctatctcgtccttcagtgcgatgatcctcacgagcttcccatcattcaaggccttggacgccttgtgcaggtccgagtgcatcctgtccatccccctcatcacagcgcacatgtgaacaaaggtggtgtcgttcttgccggctgtcggacggaaagaactgacatcgctgccgctggctcgacgagggtggatgcggtacgccgtgtcgtggaagatgtagttgtggcgctcccgtactctggccatcatcaggtatgctgcctcctgacatgcgtgatctgctgtgcctccagacgcctcaaccaccatgttagcgaggcaagtacccacatagccatggacctccaggcggacacggtgaggaagctcgccactgagcggtggaacagttgtgtactctggcgcgttggggtagcccaccaccagtgtcatgcgtgccaattctgccacgaaatcatccatgccttctccgcggtggttgggtgggtgctcggccatctagagaagacaaaggagtaggatcaatgcatgctcaaatccaaattaaataaagcaataaaggactcaaataagagaatcgaataagagcgaaattttatgcagagatcattttgcatgagagcgaataaataagacagacttacatcgcgataaagtaatgaggaaattagatacatactaataataactataaaagcataaataccttacaacccatattcctgagctaggacctaatgcacttcccccatcaaatcccaactgactgtcgaaaatgtctcaaatatttttactaaaaccctagactgacttgttttgacaaatcttactcaaacgagcgaccaagattttttcccttgaaccacaagaacagatcccgaattttcccggaacaaattcaattgcaaagaacttatgcaatgaaaaggattcagagggctcctaagtttccatttggcttgtcctacggtcaaggtcggctctgataccaacttgtcacgcctagaaattcccgaatagaattccaagcagaatgtgcattaaaaccccagtccaggaccggccggggtacacaaacaacaatgttgacatacagatccacgtcttacaaacattataaaagtcttacataaatgcaacggaaaaacgaaagataacaggagctaagccttgacttgaactgcagcgggaacaccactccacaggcatcctcgacggcacggacgaagcctactcctcggagaacccgccatcggacacatactcaaactctggggttggggggaaatagagcaagactgagtactatccactgtactcagcaagtcataccggaatagaggtatgatgcagggatttaacaagggatagctatacatgttcatttgcataatactggcatttataaacagaagttggatgcgaaaaactgttgtaataatttaaccaatattaatcatccactgtccaacgctaccccacgttgcaacaggcccaaccatccacctgtactatccaatttcattagactaaactaggataagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggaccgttcgcataaccccctctagccaagcacaccacacctcaggtttcacccccgtccccagcgggcgacgggcagtcccctctcgtgcctaggtgaatccggaagacgcattggccgtcgcagggcccatccaaactccatcacgcccacccttgcctggatgcgtcaactagagaaaagctacactacaagcccagccgttgcccacgctggcttgtggtaagcacgataaattcttccagggtttcccgtgaaccggtccttaattgccatgggtgcgactagcaaaaccatgcacccacagcccaccatgtgattcattttaattaaccaataccaaaacggtggtactaaaccaacattaccatttgaacctaaagtctatattttaaagagatttccccattgtgtgctagttgaactaagcatggctaagcaatacctagtccaaagtctattcatgttaggacccaagctaacaaaggagcatggtaccaaaatagcatggctgtaacaataggtaaacatcccatagtattattgcaaaacaaatgcaatatttgaaagaaaacattaggacatttgcaatataggatcaacatgatcaagtgacaggcatgacttgccttgctctgctgctggaggaacctcggcgactatctcgaagtacaccggagcgtcggaagagccggaatctaacgacatacaaggcaaacaatgcaaacaggctataagactactgaaacagagaacaaaaccatttttaatggattctacatatttttcttgatttactgagacttgaatgggcttaaatggagctcggatgaattagatatgaattttagaagattcactgtgtttatttctataacaaaaagtccttaaataatttattgcgcaataaatcccagggctgacgtcatcaagggggggcggcgccgacaggcggggaccgcatgtcagtggcgcaaggggagagaggggcgccggcaagtggggcccccgggtcagcggcactaggcggccggtccaccgtggaccgggaccacgtgggtggtccaccgccggtccacgggaccgacggcccagatcgacccggggccgatcggacgggcggcggcggcctcgttcggctcggctcggcacaaggccggccgaccggccacggcaagggcggcggcgcgcgcgcgcacgcgttgccggcgacggcaaccggcggcggaggcggcggcgcaaaggcggcgcgaaggcggcggcgctaaagcggcggctaggaaggagagggaggggaatagaggggaggggatgcctcaccgagggtggccggcgcggaggaagacgacgtcgaacggcgacggcgagccacgggaggacgacggcaaccggcggacgagcttcgggatgccctaaggaaggaagagagatagattagagggagggagatgaaccacggcggccggaatccatggccgaaggcggcggtaggggtagagctcaccggagtgcgaggggatgcgggttccggcgacggacctcgacggaggaggggcggacggggtggagttcggcctcgcgaacccgtcggcggcgacggtgcggtgtggcgacgaccctaacggcggctagcggcggccggagcaacggctaaggcggcggcgggcggaagcatggcgagggagcgatggggagcacgagggagttcggcgagatgggaaaaaagagagagggggtgacggtggagcttaaataggggaggggaatcccggacgtggccggtaggggcgggatttcgccagccaatgtggggagtgggggaggagagagaggcgggattcgaaaatcgaatcccggccatctcgcgcgcgggcgcgggcgagagaaagggggagtgtgcgcggaaggtgcggcgcatgcgcgggcgtggccgacgtggcccggagaggcgaaggcgtgggcgcggcggcggttgccggcgcggcggcgcgggcgcgaggtgggagacgggtccgacaggtgggccccacctgtcagcgaccccgggtgagaggagggaggcggccggcccgcgcggcttagctgggccttggccttcggccggcccagcgggaggggaggggaggaaggagaatgggccggcggcccattcaaaagaaaagagaaaggaaaataaggaaaaggaaaaagaattttccagggattaaatattgcttatgctccattttaattggttaaatttatttctagggctctgaaaattccactaaaaatcttgttagcgaatttcgacatgtagaactcaagaaaaattccacatgccagtttcgattattatttgcattaatttattagggttttctcttgatttgcaccggcattttcttagggtcatttataaattcaattttaggcttgggaggagaacttcagggtgtgacaaacctaccccccttaaacggaatctcggccccgagattcggaggagttggcgaagaggtgcggatgggcgactttcaactcatcttcccttttccaagttgcttcctcctctgaatggtgactccactgaacacggcagaacctggtgaccttgtttctagttcttctttcactggtcttaagaatgcgaattggcttctccacgtaggtcagatcctcctggatatcgatgtgctccgaattggcctgttcttcaggtaccctcaaacacttctttaattgggatacgtggaacacatcatggatgccgatcatattggaaggaagctctagctgataagcaacttctccccttcgttccaagattttgtagggtcccacgaagcgtggtgccaacttgcctttggtttgaaaacggtgcactccccggagcggagtaacacgaagatacacgtaatcccctgcttcaaaagtgagctcccttcggcggttatccgcgtagctcttctgtcgagactgggcaattctcaacctttccctgatggttatgactttctcttctgcctccgctaacacctctgttccaaacagttgacgctcgcctgtctgatcccagaagagaggtgtgcgacacttccggccatataaagcttcaaacggtgccatctgtagactggcttggtagctgttgttgtacgagaattccgcatatggcaagcttttgtcccaagctccaccaaagtcaagagcgcaagctctcaacatatcttccaaaatttgactgactcgctcggtctgaccatctgtctacggatggttggcggtactgaaatttaaacgggtccccaattcttcctgcagtttctgccaaaattttgaggtgaactgactccctcgatcagatacaatcttcttgggtaccccatgcaaacacatgatccttgccaggtacaactctgccaatttctttcccgtataggtggtatgcactggtatgaagtgagctaccttagtgagtcggtccacgactacccagattgaatcgtgacccgatgatgtccggggcagtcttgttataaaatccattccaatttcctcccatttccattccgggattttaagaggttggagtaagcctgctggcctttggtgctctgccttcactcgctggcaaacatcgcagagtgcgacaaattcaactatttctcttctcatgctgacccaccaaagcttttctttgaggtcttggtacattttggtgctgcctgggtgaatggaatactgtgtctgatgagcctcggtgagtatcatatccttcagttctttgtcgtcaggtacgcacaatctttcccccatccagattgtgccatgctcatcctcaaggaaatctcgagcttttccgactctcatgttctttttcagttctgctatttcaggatcatttacttgagcggctctaacttgatcgacgagcgtaggccgtgtttctagagcggctacgaacccctgttcaacaattcccacgttgagacgctcaaacaactgctgcaattcctcacacatgccctcgatgcatagggcagtgcagtaacttttcctgcttaatgcatctgccaccacattggctttccctgggtggtagtgaatgctcatgtcatagtctttgattagttccaatcatcttcgttgtcggagatttagatccggttgggtgaagatgtattttagactcttgtgatccgtatatacttcacaacggttgccaatcaggtagtgcctctagatattcaaagcatgaaccactgctgccaattgcagatcatgagttgggtaattcccttcatgtggacgcaactgtcgcgaggcatacgcaaccactctgccttcctgcattaaaacacatccaagcccgtggcgggatgcgtcgcaatagacttggaagtctttcatctggtcgggcagaatcaaaactggtgcggatactaatttctttttgagctcctcaaaactcttatcgcactcagctgtccatttaaacttctcatctttcttaagtaactgagtcatgggtcgggcgatcctggagaagttttcgatgaatcggcggtaataacccgcaagtccaagaaaactccgaatctgcgacacggtcttcggtggggtccatttggtaactgactccacattagatggatcaactgctacgccctgagctgtaataacatggcccagaaatttgacttccgtcaaccagaagtcacacttgctaaacttggcgtataactcgtgctccttcaacttctcgagtaccaaacggagatgctgctcatgttcttcttcggactttgaatagataagtatgtcgtcgatgaaaaccacaacaaacttgtcgagaaattccatgaacactttgttcatcagattcatgaagaatgcgggtgcgttggtaagtccgaaagacataaccgtgcactcatacagcccgtaccgagtggtgaaggtcgtctttggaatatcctcttcccgaattcttagctagtggtagcctgatcgcaggtctatcttagaaaacaccttagctcccttcagttgatcgaacaagtcatcgatccgtggtaaaggatatttattcttgattgtgacctcggtgagtgcgcgata

SEQ ID NO: 75408 - DNA, 7565 bp, Oryza sativa
aggtgcttgctagctgcaggatgatccttggctgagcctgggaggaacttcttcaaggccaactggcccctcatgcaattgaacctcctgtagcttgcagcactctttatgtacttggaccagccatagaaaatgacatgatgcttcactgcctcaaatatccgatccatggaaggtgtttgcttgatgtaccaccgctggttgacaagggcatcgcaatagatgcaagcggagagccagaggagacagttgggcttcttcgtcatccgtgcagcgcaccagatcacactctgctggtccaccatttggttcctcctgtcagtagccggccacaccgcaagcggaaaaaacaagcggcatagggtgacggaggagatcagctccagcagcgcagtactgaagaagaggatgtatgtcacggtgatatcatgtttgttgtacatgtctttgtggcttcttgcgtagaggccggctgcggtcgttgctagtaaaatggaaagcaaccggagccaagaggcaatgggcgtaatggtcaccctcaccctggtatatagccggatatatacatcaaagagcccagcacgaatcaccctataactgtaattagtgttgattgccatcagaaattggaggatcttgaggcgtttggaataggtgacaaaggcgtctgccatgaataactctggctgaagcacggactgcagccgacgcaaagttggtttactcaattgtccctgacgattcatgatctccttagccctctccacatactcgttgaggttgatgaggtcttcttcttcttcttcttcttcttctttttcctcctcctcctcctcctcttcctttttttggtggtctactactggttcgatggcagtttttacggtggacctttctaagttctcatggaattgcccaccttcctttctttctccttgtttgacggcttccgtttcgtcattgggttgcggccgctcacgaagttctcgagagaccacaaacattgtgactgtaggtataaagccagtagtgcatgacctccagtagtctgccaactgtcctccaccagatccaatcagcttcttccttcggggcacactaggagggtgccttgctatgcttcttataatggccctcttgagagcccagggcttggcacaaaacttgaggatgccaacaatgaacagaagaaccgcagctttcagaaggatcttcttacagaccaagccaaacagaacacatacatagcaaccgtgacttgggacaccaaggtgacgacttggcgccaccatagatagttgtcctggatgctgtaggaggctatcatatcttggccagagaggtgaatcaggaggatgggcgcccacagcacctccagctccgacgctgcaggagcctcatgcttgtgacggttgaagagggtggcaagggcgtagatcgccagggagtcaccgccgatgtatgcaagccagatgcatagcctgaaccacagcgagatacgatgccagcggacacctccatatataaagaggaacaactgtatcgtgttgcttccaaggacaaggatgcggagcttccaatcatcccaccaatccaaagcacttgagatacccataacttatgatgatatatttctctacatatatgtctagctagctacctctctaggttggaagcaagcttgctctcttgcttggagtatgtgggagtgttggtatgtcaatgaatatattggtcacacacacacacatatatatgttgttctactgtgtagcacaacagcttcttttcttattctttttggtgaataatgttcacactacagcttaaccaaacagattcatggcaacaagcttcaagatcaatccactgccaatggccccgtgtgtgcaaatattccaagatcaattaaaggggaaaagcatacggttttatcgaacacgctagaacgctagtcctagaaagaaaaaaaaaacttgaaccagcggggagatggaatctactgagggcaggtaatctagaagttgagacgactagctatcaacttcatgaacagtcactgcatatgttaaaacaacacaattgcacaaacataaccagtccaaatgagttggatgaaaacaagttaacatatataacatttaataccaacatgttaacatgacatttgatctgtactttcttgatctattctatttatccttgattaattcatgtgcccagagtagtttatttattttattttttttgcaaagagacgtatatttctataaaccccctttaattttggctatagcaacaggaaccaacaaatcaagagtatcggttgaaagaaccgatactaaaatgcataccaagtcaaaaaaaaaatatgggatgtgggatttaaactcaagatctttcatcttagccctcacgcgcgttaccatcccacctactctacatatccgacttgagtagatatgctttccttttgaactaactctataggcatatttagtaccggatgataacataaatctggactaaagatatttaggggactcggggcttttagaactggtactaaagagatctgtaccggtttttaatacatccagaatatttatggcttaggacatttggtaaaagatgagttctctgtagtagtgaaatgtcgccgacatttttgtaatcatcttccctcccttctgatttctgcccctagattcccgttcatgtttgtgtcttggtgcatctcagatttttcaattttttttgtcatgttttttttccatttataagcaatgtgccaatgtttggttgatgtgcatgaacatctggtgaaatatttcaaattgtttgagttcatgctgtgaatgtttggttggatatataatacccaatatgataatagtttgggcctgagatgaaagttcatgtccaatcaatcaaacatgagatgaatgagatttgaaatctgaggtgaacaaatattttatgcacaacgtacagtttgaatacaccatgtaaaaattgtggaatattaaatgttttgataaatgtgcaaacataaatatgtaaaatgatcatatattgaacaacgtttttaatgcgttgaacggctcactccagaggtaccaattttggtactccttaggtttcgttagttcccgcataagtactgagctctttaagtggcgaaaaaaaaaacccggagcaatcaattaatacataatacattaattatagatttgaaaaatgggttgtttgagtttttaaagaaacttttatataatacaatttaaaaaaatgcaccgtttaatagctttggaagcatgataacggaaaatgaggaaattcaagtttagagttggagtttagaactggggcttagtacctcttaaggacgactgtaaattttatccaatatatttcaatgttgttaatctatccaagctttacatgtggatctaatattctaatcttacactaaaccatataggcctcagaagacactactaatcaatggatgggctattacaaatggttacaatgaaaaaaaactagccagaaacttccaactgctaattaaggttttaatcactcttctcttcccgcaaagttattattagtactcttcatcttttcattagtgcagaaccataggtctcacagagttgaattctgcaatggcagagcaattgagttcgctggtcagaacagagcttggactttcatatggtttgcaaactgcacattcagatattacgattatgatatatttctatatttgcatgtgtcggaattgtagattttctcaaataggagaaagaaaacctatagatacatcgttgaattttcattgtgtttcacaatgtaggtaataaaatatattcttcccttatcttaactttgtgctttggttctctctaaaatttgtctgggtccaccagctgtccaaaacatgatataatcaaatcatgagcacttggcgtactagagatagaccactttgtccctttatgttttttttttgtaagctacacaactgctttaatttctttgtgtgattgtcgtaatattccacttccccatgtgtccgtgataatgtcgaagtcccttgctttttacaaagaaaattccgtgcccctaaccctgtaggtttattttcattgctgcacaccatttcgaagctattaacctgcaatgtactccaagcaatacttacttttgttgaaattataagcacataatgatttaatttatttcataaataaatcatgatattgcagatgtaaactagcatgaacacatcattagatctacatatgtaaactaagcagtaaaatatgaacagaccaaatatgcgtaacatatcgaacccgtaccgaggtggcggaaagaccggttactcggcagaaactactcgtggttgtgggcgtcgacgaaggcgcgcagcacgcgagcggagaggtaggcgagccgtcgcggacgaacagggagcagtcgcgcgaagcgcttcccaaaaaccttactgccgccttctcccggtgcaggacgtcgaaggcagaggttctgaagacctgctctcccgatcgccggtgcacgccggcaagcgggatggagtaatctacgagcgacggcgcagtacagagcagcaagcaaaccctagattgatttcgcgtgagttccgtgaaggcggcggctcggtttatatagtgataggtcgcttgatcagggcgcccgtgtaactgaaccggataagtcacgtgtaacttatccggactccacgccgttttcacgcaccggatttttcggaatgtttctaaaacaaaacaaatccgaatttcccgcagcaaaacaaaactgcaaaaggaggctgcatctgcgcaagggtgaggagccaattttgcggaccattcgacgcgtacgtcgtgcacgcgcgccacctgccctgccaggccaggccaggccaggctaggcgagcgagcgcgtgcgtgtgtttcccctcttctctcctccacacacgcttcaagtggctaggagagcatcctcccttttaaggaggtccccctctcctagaataagcaaggtagtactaaacttcacatacataccatcccatgaggtgggcttttatgattttccaaagaattaatcttcgaatgggccttagcccatctattaattccatcaatcccccaacaaatctcaaaatcccactgagatttgccttttccaatgtactgtttatatactagcggttcgatggagaccgattaaggttgaacatccacctagaacttcaagctacacttactcacaacttgaacaatggactacgccttgaattgcaagtcttgtgcaagcaagtttcactcagagtcttatctggtactagaccttctgtagactacccctcgggtggagcgtataagtcatactcctaggtctttagtaagcttcctagaagattcacccaaaatctccatagactgcgaccaacagtcaagcttacaaaggtgagttctttcaagaatgctctgcaggacagcatcttcgctaattaaagccaacagaactcattaaggcatagccaacctgccttgtagctcacgagagtacatgcatcttcacttagagagggtatagattggtactctcctgtagtttattaatggtttgttcttcccaggttctaattcacgggatctccgatcacatagactgggttaccaccatagtataactcacatgggtctcaaacccatctccttcgatgcattgtctatcacatttcgtgatagtcccttcgtgaagggatctgccaggtttctagctgtttggatgtaatccaatgttctaactccggagtttctcaatttcctaacagacttcaatcgtcttttcacatgtctagacgatttcatattatccttagaactattcactttgacaattaccgtttgattatcatagttcataaggatagccggcactggtttttcaacaataggcagatccattaatagatcacgcagccattctgcctcagcagtagcagtatccagtgccgtcagctctgctttcatggttgacctcgtcaaaatggtctgtttgcaagacctccacgaaacagcaccaccacccagtgtgaagacatatccactagtggctttgatctcatccacatcaaagatccagttagaatcactatatccctccagtaccacaggatacctagaatagtgaagccccaattccatagtacctttcagatagcacattactcgctcaagcgcacgccagtcatcatctcccggattagaggtcaaccggctcaacttgctcacagcaaaggagatatcaggcctagttgcactagccaggtacatcagcgagccaatgatttgggagtattccagttgattcctagcaattctcttgttcttgcgaagcaacaagctaggatcataaggtgttggagaaggcttactatcaatgtagccaaagcgattcaagatcatctccacatattggggctgcaagagtgtacccctattctcacctctaattagcttaatgtttaagataacatcagctactcccaaatccttcatatcaaaattttgagacaagaatgatttaacactacactggacaaggtcacctgtgacgggcccaaaccctcacctttgacggctttgggcttggtcagtgatcagtggtcactggtgagtccaatcacctttgacgggtgaaggaccgtcactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagtagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgctgccactcacctcctcctcgccgttgcacgtcgtcgagccctcctcaccgctgcgtcgagccgctgcaccgccgcgcgccgttgagccctcctcgccgctgccgctgcaagaacaaccggcggcggcgggcgggcggatccgtgtcccccaacctcgtggaggctagatccgacacccagcagtcgggggacggcggccgtggcgcccggcggtcggggaggggggcgaaggaggcggcgacctggatctggcatggtggaggcaggaaggaggaggctacccggatctggcgtggtgcaggcgggaaggaggcggcgacccggaggcggtgggcgaaggagctgac

SEQ ID NO: 75409 - DNA, 534 bp, Oryza sativa
taatcacgtattgggttcctatatgaacttctcttttcatattgcatatttttaatttcgaattttagctatttttagattgtatttctacttggactcttcttttctttttcttcgattaacgtgggaatttctagcctccacgacgaacgtggtgccttcttttcgagctgtcttaataatataatagatagataaaactattttttaagtttttaataattaatatttaattaattatatgataattgcatctctcgtacagctaattagcccaaatcttaataaaaaacaacgcacctttaggggccatttgaatcaaaggatttttataggaatttcataggattcaaatcctatagaaaatttttctatttgtccctttgattcaaaagattgaagctttccaaatcctatgaaattccaatagaatgatatattgcatgtggattttggaggaaatttagcaagagctccaacctcttggaaatttcctttgagtctatctctctcacatgattcttacgtttttct

SEQ ID NO: 75410 - DNA, 6098 bp, Oryza sativa
tgttcctgggcaacaataggtttgaaggggtacttcctgtttcaatctcaaacctttcagtttatcttgaatacctctatcttgattttaatgcaatatctggaagcttgcctgaagagattggtaacctcgttaggttagaagctcttctactccataacaactctttcacgggaattcttccgtcatcgttgggcaggcttaaaaatctgcaagttttatatatagacaataataaaataagtggatcaatcccattagccatagggaatcttacagaactaaattatttccgccttgatgtgaatgccttcactggtaggataccaagtgcacttggaaacctgacaaacctagtggaactaggtctttcaagcaataatttcacaggttctattcctgttgaaatatttaagattcacacgttgtcgttaactttggatatatccaataacaacttggaaggatcaataccacaagaaatcgggggcttgaaaaatcttgttcaattctatgcagattccaacaagttatcaggtgaaatccctagcacccttggtgaatgccaacttctccagaatatatctctccaaaataatttcttgagcggtagcgttccatcactcctgagtcaattgaaaggtctacaaattcttgatctttccaataacaacttgtcaggtcaaatacccacattcctgtcaaaccttaccatgctcagttatctcaacctttcattcaatgactttagtggtgaagtaccaacttttggtgtcttttcgaatccttccgcaatttccatccatggaaatggcaaactttgtggtggcataccagatctacatttgcctagatgctcttcacagtcaccacacagaaggcaaaaacttctggtaattcctattgttgtttctcttgctgtaacattactactcctcttattgctctacaagcttctctattggcgtaagaatataaaaacaaacatcccatctaccacatccatggaaggccatcccttgatctctcactcccagctggtaagagcaacagataatttctcagcaaccaatttgttgggatcaggatcatttgggtctgtgtacaaaggagaaataaataatcaagctggtgaaagtaaagatatagctgtgaaagtgctaaaactccaaacccctggcgcactcaaaagtttcatagccgaatgcgaagcactgcgaaacctatggcatcggaaccttgtcaaaataattacagcttgctcaagcattgataacagtggcaatgacttcaaagcaattgtgttcgagttcatgcctaatggcagtttagatggttggctacatcctgacaataatgatcatacagagcaaaggtacttgaatatcctggaaagagtgagcatactccttgatgtggcttatgcattggattatcttcattgccatggccctgcccctgtgatacattgtgatattaagtcaagtaatgttctcttggattctgacatggtggctcgtgttggagactttggacttgcaaggattcttgatgagcaaaactcagttttccaaccctcgacgaactcaatactatttagagggacgattggctatgctgccccaggttagtctgtttcttgttcttcaaatgaagcccacatttatacaataatattagagcaatgctccggtgctttctacttggagtattatactacaagtaaaattaatctcgaccgttcattttaaagggtagattagtaatctcctaatatatattaggggcaattttggcaggatctattttctctgtctcggtcggtcttggcttgatcgcatcaggtccgacgaaaagcaccgcatctcgcccgacgcacgttgcttatcgctactcctcccggcacgccgtggctcggtgcggtgaaaccctcaggcgtcccctcctcccacctctcacctgtctatccgttcctcctcctctcctgtattccacgtcggcatcctggttcgccatcgtggccttctgtccgctgcgagtggccttccgcgcgcgtccgatttcgccggagcccctgcgcaagacctaagattcttggcagcgcccactttggaggattcaatccattccgccggcgggtagtgatctccattccgtgttgctctgattgtgtgggctgcggccacttgggaggcagctgcgatacattccagcgccgtatccccggtccccctccgtgcgtgcccgagtcttgtggcttgcatcggcgagcacctcctcgaccgcgagcacggcatgagatgcagaatatgcaacagtgtcgctcgctgcgtgttgccgtggaaggcgtcgccggcgaacctgatagaccgcaatgctcagaggtttcagcacatccgtgctcgcggcggcgtcaggacactggatcggacgatgaacgatgcatgcggcatgcccgatctgctagctcaggatggtggccggcgactgtccgcacgctctccaacgggcatgacttccacgaggattgcaacatcgcgaagtggctccgtgacaacaagaaggcctgcccagttcattctgcttgtaatattcagttgtatggtgtgtcgaatacttcattgactaattgacgagctttgagatactgatgtttattggatcttgtgactgtcccaatatattcattgttcagtaatggtttaagtaaaaaagaaaaggtgaatagtgatggactactagtaatgtcaatgtgttgaccatgttagtgtgttgtgcattttttttgtgtgcaactgtgatggggtgagatgaatccaagcaatttgaactgaaatatgtcatcctgctcctggatcagtaaacaagttgttttgctcctgaaagagtgagactgaaaaaatctgataaactgcttaaatgagatttttcactatcagagttttgcccatatgtaaattgcatttcagtcagagctgtaattcaggatttgttttatatttcataccatcgaaacatctaactgcattctgtcatattctggcgctctgaatcatcgctacatgattcctttcttgtgctcatatgggggtagctaagccctcaattgccactaaattgattttttttcagtcataggacaatgtctactaatgggggcttagaacatcttgattcactctttgctgcaaactccctggtctactgtcgtgtttatgcaaaagcatttgcattagctccgcggcagcttgtgaagtcatgcacagtccctattcatgtagcatccaaacacctcattcccaagtcccttagctgctcgtacggtcgccggcggcgaccaaatgccaccgcctcactcgagctccgccactgcacgtcgccggctgccatagctcatttcttggccaatccgagccgtccaccacatccccatactacactcgttcattcccagttgcccattcctcctacctcgccgccgttcgccggaacccgttgaatttcgtccgccgtccaattgcccggcgatctcctgtcttggtcaaagctacatggcaggactagtcgtccgccgtgggcaaggaccttcagcggcttggcgaagaggagaagggccacccttggtcgctggagggggaggagatgtcgatcgcgctggagatgatggaggcggagagggagatggacaagcgacgaagtcaacgatggatggggtcagccgcttgagaatggcgaaggtttagagttactgaataataatttacgataatacccttacatgaattattatctatggacaaatatacccctccacgtttctactaccactatgagtggtggtagtagaattagatctcaaccctacgattatatacgatcaacggctcggattattttctactataagtagaaagcaccggagtgaggctcataatattatgggccatttgcagatgaaattagttttaggggaagcattgaatttttatttttacctaattgtatatcagtacaacttatggtaaatttatagctatacaagttataagaattctaatatttctggggaatgttcgatgcaacagaatatggtgctgggaatactgtgtcgacgcaaggtgatatttacagctacggcattcttgtgttggaaactgtaactgggaagaggcccagtgacagcgaatttacacaaggattgagcctctgcgagtctgtaagtctgggtttacatggtaaagtgatggacattgttgacaacaagctgtgtctgggcattgatcagcatgatcctgagacaaccgatgatttttcaagcaagcaaaagatcgattgcctgatttcattacttagactaggactttcttgctcccaggaaatgccatcgagtagattatcaactggagatatcattaaggaactgcatgcaatcaaggaatctctcttgctggaaatagaggatacagaaaaatgaagacactgcatttcttttttctgctgggttacttttatgttctaataaatctgtcatgcatattcttgagctccctcttaagtatctgcagctgagtcctgtagtggtcattccaactatttgtatcctatgataactggatcactgatgttcactgcagaaatatctgttatgtttcttttgatgcaattactttggatcaaatccaaattgtttacagtgtggccggttgcagtcatgcttctacagtctgcatgatacctttgataatttatacaagagtactatgcaaaatgaatattcccttgttcatttctggttacagtctgcatgatactccctccgttaaggttataagacgttttgactttaatcaaagtcaaactgttttaagtttcaccaggtttgtagagaaaagtagtaatattttcaacccaagataaatttattattaaaatatattcaattattgatttgatgaaactaatttagtattatatatattactatatttatctataaacttagtcaaacttgaaatagtttaactttgaccaaagtcaaaacgtcttataacctgaaacggagggagtaccaaagtacataacaaagtaatacattgattcgcatgataatttcgacgattttagactgggtaagttattgcttacgttttttttttttggagaatacgcaaggagcgcatctttgtattatgaggaacaaaagttatttactgggaaaattgaaaaaaaaaataagggacgggatacaagcgataaccaaaaacactaagctagacctattctcgcacgagtattgtgcgacctagagaagactaggggctggacattcaacgccggaattgccgcgttggccaaacgccagagttccgcttcagcaatcattgccttcgcaacctctagccacgttctatgctctcttcgtgttgatcacaaatgacgcaacggtctaggtgtgggaggccacggttgtggaggaggtccacgatccagcacctgttgagagcaaccaaccataagaagtagcggcatcgcggggcgccatcaatttccagattggtttggactgaaaccagactcttcctaggaacaatgctcgataggctgaactggaggtgtattcccccgagcagtcccacctccaagagagggagtccggttgatccggcaatagctccatcgagtttagagtggtctaaaggtggaggtactcgagaatcgcttggatccctagagctccatagatgtctctgacccatcttctaccttgaagtgcctcaacgatcgttttgcgacgtttgaaatgctcgacctcagggacacagttgtagacggctggtgcaaaggagcgaacagagtatccttctagctagttgtcttcccaaaagagcgcagattcaccattgcccaagatacacaccgtggacgccgccacgaagctgcgttccttgggtgagattgggatgttcagaccttgccaaggcttatccaagcttgttctctgcagccaagcccagcgagatcttaaagcgatgcccattcgctctaagtcgggaacacccaatccaccgtactctttaggggcgcataccttggcccaa

SEQ ID NO: 75411 - DNA, 2333 bp, Oryza sativa
atatatatatatatatatatatatatatattaggtgataccccgcgtgttgctgtggaagtgtggatatagttgagaaattttaagcaggcgacagtaccataggcatttgagcagaaaggataagattgatttctagttaaaaagagcacattccaattagcatagctgaccaagaatgtgcatgcagtgccattcagctaaccttttcttttgtttttgtttgcttgagggtcattcagctagccttttctttttctttttttgtttgagggtcattcagctaacctttgctcaaggaagatggaacaacctgactgctcgtatagtggtgttggagggggttccacatggtatgatgcgtgttaattaggggattgctagtggagaaggtcgaagggcaccgcttcctggctttcatgcgatgaggagatttttaacgggccaagtcaattaaaagggccagagcaagcagttgtaagtgtgaggacagataccgttgatctagagacatgctcaagaatccaacggctgacaataatcgatgacgtggcgcaatgtggtgcaagctttatagcaataattattacagtgggtacgataagctgacccaattctatctagactctgtttaacgggcctaaactgaattcaagtgctggaactaaggcagaataagtccaccttgactctcttaaaagtgacccgaatctaatttatgaccctaaaccgtaaaaccggatatctcgacccccgaactattgaaaccggtgtaatttgactcccttgatggttttagagggcggtttcgctgacgtggcgctgacgtggcatgattgacctagtgttgacggaaaacatgaggcctgggagatatgcttaactccagtgcaggtccaaaactcgccttcgggtatgctagcgtgccagttgatttatcctgcaatcaacaagaaatagcgacaaagaacccgcggttaaacctataaatgatagccgatcggctaagtgccgatgacatatcatttatccttgagccgatgtcatatatgtatcgatcggcggtcataataaataagaaggaactagatctactcgatcggctgtagatattaacaatatatattccttatatcgatatatacttaaatcaagcgattgggatagattggtcgccatgccgagacaatataaatcacttagatcgaaatataaattaatgatagaattatatatgttcatagcatagccgatcaaatggatctagcatgtaccggctaatactccgacaccactctatactaagatattaaaacaagtagaatatatcagacaaaaaggtctgatatacttaaatgcggcaagatcttaacataaagggcagatttaacatatccatgaagcatatagagcaaatgtagttaaatcagataagatcggctgaaaccccaatactaccctaatcggcaactagaaggcaggctagagattgatattctaagcacgacttaatagatcaaactcaattgatgcagcattaagtatgaaaagaagaacaatatctagacaatcaagacgctggaagtttcatagagtggtgaatatcttatataatctaagtcaacatcgatatttaacctaatcggctgctttctcctgacagatgttagccgataacaggttaaatagcgatattgccagagattatgtaaggtatatgataactcgatgaattacataaataagattagagtatcataaagatggaagcactaatcccgagaacgcaagccatcataacaagttttacctcttgttgaagatcgaaaccgatgcagctcaacccgaaagtaagaactcgtcgaaataaaactaaaacaaaagggtggcgatgcgccgaaattgtattgaatgtgtgtgttaattgattacatggggttcggggtctatttatacccaaaaattacaaaccatgtccatatcggacacgactcttatctctaacaaactctaagataccataagtctttacggcagacttttgcccaaacatatctctaaggaagttacataaaatatcctaactaatagatataattgccttctcaggactctattcatgcgtggcaattatcttgaagcatatcaactcaacccgatatcgtacaccaagttgtcttgtcggaatcgactgtaccacccaaccaagtctaactcgaattcagctgatccaatcgtagccgatccggactccagccgattcttactctgttctcgtgataatccttatctccgattccgcttcgatctaatccttctttccgatgttgatgt

SEQ ID NO: 75412 - DNA, 43655 bp, Oryza sativa
accccaacccccaccgtccctagcttcgtggcccaccaaccgccgcgctgggaggcgccccagccctaggtagccaatgccgttgtcatcgagagagtaagtccccgtggccaaacacatccacgaccaccacatccgagtcacaagtgttcgccggcgaccacaacacgcagagctccaaccacatcgccgctaatctccagctctcgccgccgccaccgcttcagctcctgttggccgccgccgctctagcccccgcccgccgccgctccagcccatgcggcggcggccgaccgaaggggagagaaggagagagagagaagggaggaagaggggaggaaaaagaagagagagatgatgacaggtggggcccacatgtcagtggaccccacaattttttatttgtgtgaatgacaaacgggtcccacatatactttttaattcaaatgccagctaagcgctacgtcaaccctacagactaggtcaaccatgccacatcattgccacgtcagcgaaaccgccctccaaaaccactaagggagtcaaattgtaccggtttcaatatttcgggggtcgagatatccggttttgcggtttagggtcatgaattagatttgggtcacttttaaggaagtcgaagtggacttattccaactaaggctgattcagcaggccatacagatgcttgggctggcccaccatgtaaatggcccagcggcctgcagccttctgcatctgtctcccccccccccccctccgcatttcctttcccgtatcccgcagagcagaagcacacacacgctcgtcgattcccctccgccggcgaccaaccccgccgcctcccaccgccacgcccccgttctctgctgctacatctcgtcgcctcgccggcgccatccgctatctcccccggcggcggcagaggcttcctcttctctgctactcgtcgccggcagcggccgccgtctcgagtgcgacccacggcgggtggccgcggccgtcgtctcgacgacgaacggcgagttcgtcgccgccgtcgggcagtgctcgggcctcgtcgcgtgccgggcccgcttcgggaaggagcacgatgggcccgtgccagcccggcccgacccggcccaagtccagcctctactccccttaacatggtctatttacataaaagcccctttcatcaccgcggtaatacaaatatttctcctagtacaacgctttcacgaagttgggtgaggcctccacaaatccgaggtcttccctgcataatcctccctcctccgcggcaaagccctagaagcgccgccgacgcccacatggcggcgccctccggctccggcgaagccgcccccgccttctccacgtactacgacgtctacggacccgacgtatgttctctctcccaatctttctgttcttcttttaatcggttccccttttgatttcgggatttcggggtcttaagagtgataaaaacaggggggaggaattggcaatcgattatttgtggtaaatgttgcggttttattattttcgggtggtttttgctggtgggaacatatcgcattttgtgatttccgtggcgtcgaaagtgggaagcaactgtgctcttctatgttgttaacgcgttattatgattagatttttttttcttgtaaagctaaattcttgctaggattaaaacggagggcatccctgtttgtgtaatgatggtctctgcgattcttattgttaatggcaaaatctgagtgttactactgatagcgctgcgcttttgctggatactttgttcagaggggtgaagcgcggatatactactgtaacatacaaagatcctagttttgaagaacacactctcatggaagcatacatgcagttcattccttgattcattttattttaacagaggaagcattcgctactaaacaagtgacccgtcctgatttttgcactccaaattcctaatgtgaatatccctgctaaagataagacagaccagatcaatagaataatatactgctgctgtccttgttcatatcatcatttgtgcaaaatcaaaatactcccaaagtatcggtggactattaagtgaagcagcaaccaatttatctagatagatagttggctatttgttctgctgaatttactgatctatatttcctccttggctctaatgaaccaaaattctcataccaccgattctttcatcatgtccaggctaaacctgatgttgtttttaaggaggccacttcaaattctacgttaaatttgcaggttcttttcatcactgagcttatgaaattgaggtctgagaacttcccttgtaatgtgacattttgtttgttctttttagtgcaggatgttcaggggctagtaacttgggtcattggtgatggcatgctgccttcttgggtgtttgttaaagtacatattctcttccctatttcctcctaagtttcaatgtttagcacgtggtttacttttccttatctttgtccttctcaatgaaaattgttagtcttttttggggtccatatcttactgcatacttcctctgattctaaatataagtcattttagacttgtgaacaacaattaagaaaatagtttaaataactttttttgccctttatttattcatattggaaatatgattcattcatttgtgtgagaatttagttgccaaggataaaaagaaagaaaatatgaaaaagtgcccagaaattccaatatgatttatatgtatgaaagagttaaaaggctagagtattgccgaatatgttgttcttaaccactcagtttgatgttagaacatgcatagtatacctgacagcaagtgctttttcctgcaactgaaagaaaggtctgtactttgtttctaattttatggggtgtggcaattaactctgtctgctctacaacctggactacccaccatgaattttaaaacttgtaaaatactttatgtatttcatatctagagagatgttgattcacagtgagcactgatttttgtttgacgcatgtttgtcttatgttccaattttagattatttaattaatgcttcaagaaagatccccttatcactaaatttgttattcttttctgcgcagaacaagcctcttataccaaaagtcgtccttctatatgttcctggccttgatgcagctttatatatgtcgcaatcccgtcacctttcttctttgaaagaattttgtggcaatccaaaacctgttctagcttcaaggttggtgcactaaactggggagatggatgtttttgcccagaaccttgtggattattttgtgtgggcaatttaatgcctccttcgtataaatacactgtaccatgtattgctaatgatagcttttcttgcagctgtataccagatgaaaggcataccatcgatgcactcctaacatgcagagtaaagcgaaagcgtgcgttgaaaacaacggaccaatctcatgaatctgatggccaaggtacaagattgctgagggttatgtttcttttatttttaagaaaaaatgttgaattattcttcttatttgagttcttgctatgaagttgtttatattatgatgatagaatcactgaaaggacatatgattaccatttctacttttgggagatcatgttaattatcaccattctgccttgtgccatttatttgcaaagagatttttattcttgaatttacagcagacattatttttcattcttatcatttttttccttgtacctactacctagttgttctttctcagccttatttctgtaaaaattaactgttacatagcatctgcattgagatgcaatgatcataacagaagcaccagctcactgtattgccatacagcttttatgctggcctataagtgcacctacagtctctagatttacttaatcaatcttttccatgagaaaatggtacttatgtttttatacctaagatattgtattatgtgcaattttttaactgttttacatattccagaaaagttatcaagtttggacgatctaaaggatataccgtttcctattaaatattacacgctttctgaaaaagacttggaggacaatggatacaacttcagtttagaaggttatccttttgtttttctcctctcccgcttgccctttcatgctctcagctgaactcatatattattgccacataggttttgtccctactgtttcagctcctccaggctcttcgccatatgcaattcttgcacttgactgtgagatggtaatgtgatgttctgtacaatatgaggcccccttttgtgttttctgaaaataccaagtacactgactttcaactactatatgttaccaacagttttgcactgtgacatcacttgtacattatttgtgtctgagtttccttaagatctatgttttgaaagtttgcgaccttttcagtgtgttactgcagctggatttgaacttacaagagtaacattagttgatattaaaggagaggtacctactttgcgctcaatcctttattgtctcactattctccctgctgagtattgattttgttataatctatttcaggtggtgctagataaactagttaagcctgccaatccaatcactgattacaatacaaggtacatgccatgatgcctctaatctcctttgatgtagggctgttacacatctatgcttattctttcctttacatagataatagggtttggtgcctttctttcaatcatatgtttgatattcctttaggaagataaattggatctgatacctatctttgaatcatgtgtattgtattatggatatgaatgaagtgctcacgcatcatatgaatttcattgtcctaatttggccctttatgttcttcccttgtgatattctaaatgatatctccagtgggctctaacctctaaatgattaatcggaatatccaacagaagatgtaattattcttgaattgtgcaggttcagtggaatcactgctgaaatgttagctgatgttaccacaaccctccaggagattcaggtaattgttgtgtttttgtggccttgaatcttaattggtcttgatactgtgccaactctttataccattgtatatttgttttcaggaggagtttgttggacttgtgcacaaagaaactgttcttgttggacattctttggaaaatgatcttatggcattgcggatatcccacgatttgatcattgatactgcagttttgtacaaacataatcgtggccatcgctttaagatcgctttacgtgtcctggcaaaaaagtttcttaaccgggagatccagaacactgggtctgggcatgacagtgtggaggatgctaaagctgctctagaactcgctttattgaaaatcaaatatggtaaatatgcactttttaatgacttcaactgtcatctcagtaatatcttttagttatttttctgttaaaatgtaaatttggataactggttcaccaggtcctgattttggctccccaccatcaacttcacgacgaaagttggcttccatactgcatgaaagtggtaaaaaatgctccctcattgatgacgcctccgttcttgagcggtattcagatgcttcttgtaattcaatagcagttttctcagatgatgatgcactatctagatcaatgaaagaggttagtactacacattttaagtggcccttgtctcttccctgagagcttgaaggctttcattagtatgcttcttgaaatcttactgcaggtaaaaaatgacaaagttagttttgtctggactcaattctcgaaattgatctcgtatcttcgtacaagggcccaagatcccgataaggtgaaatcgtgtgttgcagaggctattgcattgcagacctgcgacagaaaaactgctcagaaaagaaaaaagcatcaaacttgtcctgaactaaaggaaattctgattgggttggacaagaaaattagaaaattatacagcatcttacctgataatgcaatgcttattatatgtagtggtcatggtgatacacctttggtgcaaaggtaaagttacctggagccatacaattatattcctcctcctagtttgtccatacagttcacgttctaaaatcgttgtgccaacttttcctaactgtacttcatgcagattacggaaaatgcttaagcaagaagaagaaacagtagaaagccgcgaaagcattgttaaagcattggaagatatacaagcccaggcagaagttgctctatgcttctgttgtgtcaaacattagctgtaagaagccttcttaccaatctcttttccctcatgctttgcaggctgaataattaaggctgaatttctttgttggcaggcattattcagacgatatacttgcggactctgtttattgtaggaaggatggagccccatgcatcccactaacattagaacttctggctaacatgaacttctggattcaattttgaaagctgacttgccagttttagaaggcttcacatatgctcatgctgctcttttgctaggctatgatgggtggcatgtttctatcatatcaatgcatcatttgtaacaagatgtatcagtagcaaagctaccagggatatattagcagatgaaaaaagatattctttttctctcaaatgtatggtgatgaaaacagctttggtaacaaaagaagctcctagaattgttctgaaaagacagatttgactcattgctgattcttggatgtttggatgatcattttaacattggtgcatctgggaaaacgtctagtgacatcatttacactattttgagtttcgtgtgcagacgattccacccgaaggtttgtgctgacaacgaaaggatgacaatatatatacctaaacgtgtatggttccgtcattttgagccatacatatattggttaaattgtcgaaatggtttgtacgtagcttttcatagatgccagacagtcgagcagataacgctgacgctaaaagatggttgcatttggttttctacttcgtcaatgatgtcatcacgaactgataaatatgaaattctttctatttttcagaggaaaaaaacaaggttttgcttgttccgtacttctactgtatattccgacaatagttaaacacttcccgggctgtaaacagtgtgttttatataagttctctatctaagttttctatatagtttctactcccttcgtccctaaatataagggattttagttgaatgtggtgtattctaatacaacgaatctggatatgaagcctgcatatatattagtttcttcaaataaataaataaatgaattaattttcaagttatagactgataagctcgcacgaagagcagagctgattcgaacgcagcttaagcatttgcaaaagtgaagctaatatcaattctgtatcttaaaaatgcagatggatgtgcacttagcagggtggtaggggacaagggtcaaatgaccaatggtaaacaagaactaaaagacgaattataagagctgcctatcaaacgattttgagccaaacttgcaatgacaagctagtctatggtccagacatatctgaaagcaattgaaatataccgtgcaatttaataagcacatgcgctctaccaacagacaaccaccggttggcagaacaaatccatcagtcctttacctataatgattactgactcattaaggacatttccacgttaattgaaataaataataaataaataaatctagccaagtgactgaattatagcaattccaaataaaactgctttccatatatatcagatccagtttgttaattatagcaaatttcacagttataataataagggctaaaaaaactaaatggagactctaagacgaagtacaactttctacttattaataatgaattatgaaaaagctgtatctaagactctaataagcttttgtacttactactagtagctataattttagaatcaattaattgctgaaaaactaaaaaagactccataataaagtacacaattgtatatttactaatatttaaattcgagattatgaaatgaagtaaaacatatagtactagaaaaaatgtattttgttggattttagacgttcatactaattgtgaaagggattgctagaattatggagttgcatttttcgcttaatttcagttacttctttttatgtgcttgttctctcttctatatgtaattatgattttatctctccaatcttctcatttaagtagataataaattacttttcttaattctcttatacgtttgtattaaacaaaatacaatgtaaatattgaaacttacagagttggttttaaaagttacatatttatggtgtaaaaatgatttgataactttttgttgaaaaatatggcaccataaatataggtactcccaattttgaatgtagaagctattattaaaattgaattttgttttgcactacttgaaaagaagctagatttgtttttaaaaaagggttaggttacataaatcaggatcctccacattattgaagaagaaaatgcagaggagctactatgctgttcctagcgacagtagtactgcatgtctgcatcattgtggcactagacacaaacgtttgtttgcacagtgaccctctgcattaaaatggatgatctataacttctaataaagtttaggtatagagcatatataatacaatagttcgtacgaatatatttaagtacataacgatcaactgggctttgtctaatccaaatcattcgttactctgtaattatcgcatcatctgtttcttttctcataggagttgtactttaattctctatattcaataaaatggacacatccttatgcgaattcatttaaaaaaagaaattcactaaaattggcagcaaatgagattttgcccaaatgacaaattgtactatgcaccatggcttggcctaggtaggtggcagaagcaatactaacttattatgcctaaaccaaaatgcatggctcttttgttgctttcatccaatctaaagttggtttcttgtccaatatgtagcaaagttctctggttatatatgtctgtggatagtacacatatggttgtgttgcacgagcgattaattaagtgttctctggctttgttatttaataattagttgaggatggttgtatctcctcctttatttggctagctttgtttcaaggaagtatcattttcttttagatggaaagattaattagttgaggccggatggttgtactctaaaacgtactacttaatttagctagctttgtttcaaatgaggtatcatttttttagatggaaggaaatacaaattgttatctatattctaattcagatgcaaagtcagaaatatctatattttgagatatagatagtaatgaggaagtaatgattcttagtgaaaacacatccacacatctactctaggttgtactaataaataataataaacatcataattccataaacattttgttttgtaatgaggtcacacagcccttacactagggactgccaattaataacatatccacaagggcaaccaaacatgaggaggcaacccttgattataatagtgacatgtacatttgttattgggttatcttgttagatagattttgcaattgcacgtgtattaacctcctgtgtgtgagaaaattgtatatctaccatagcataatattggatttgctggaataccaccctgaattaggcttcttcgtcaaaatgccatcctggatgaaaatgcccctagctcttcttctttctccctccaatgcctaaagggcttgccaacggccaaccccgcgccacctgtgctgcctcgccagcgactagggatgaaaacggtacggaaactatctttatcattttcgttttcatttcttttcagaatcggaaaccccggatacgaaaccagaatagaatattatcgaaaccgaaaacggagtgaaaacgaaccggcgcgaatacggtagcgaaaatttatcggaatacaaaacccctcaaactgataaatccaattctcaagtctcaacggtcaacaattcatcataaaacacaatcatataagtctaatttttaagtctcaataatacatcacaaaacacaatctatgaaataaattatctacgtttaagagagtaatgctgttgataaatcctaatgctgaaaaaaatattcttatgtaacttcaaatttacataacaaatatttttttttaaaaaaataaaagccaaacaccacggtattcactattcagtacttaaaaaaagaatccagggtatttcagtcaaaaaatttccgtaaattccgagaaaatttctagaaaagttttcgaccgattccaagttccgatggaaactgcccttatcattttcgattccgtttccgagaatatttccgaattcatttccgtttccgaaaaattccgaaaaaattccgatcgacagattctgttttcaaaaataggtccggaatctgaaaagtttccgtaccgttttcacccctactagcgactatgggggtgctgccctcactatcgtccgtgcctcccatcctgcccactctacaaggcattcggcctctatgacaccaccgttcctgttgacgttgacgccttgatgcgccacccctatcgctggtgagttcatccctgtcgacacactccatggctcattcgtcgtcaatgtcggccagttgtataccaaccactattctcgcggaaatttgtcaccaaatacacaaacgacgcgcgacctccttcaaaacatggaatggcggtggtgacagggcacggcactagcgggcatgacgaggagccagcaccgacatccttctccatctcctgcaccaccgatctccttcaacttccgcaacgccgcagcctcctcaagccccagcatgacaggcggaatgggaagccagaacagtagggagggtagcatccccattgtggctagtgaggtggcatcggtgatgcggcggtggagctaacggttggtgccggtgagctcttcaggcattggagaaaggaacaagaagagttaggggtatttctgtttaggatggtattttggcgaagacgtcctggagagtggtatcctagcgaatcccatttaagcgatggtactctagtgaatccagtcttatgtgatagcagatatgcaattttctccttgtgttctgttgtcgactgaagcattcaaaagcagaagcatgattcttagttgagctagcttgcttatataaaaacatgcatttattttgctaggtattatgtctagtcatgagttccctgactacaagtaacaccacatttttgtgtaaagctccacaaaccaaactgctgagcttgcttaagacataaagcctttgcatgattcggttaactagttgactatattgattatgaatttcatccaattaacctagttcccagtacgaagggctagcgaaagctatcttttcatgttgatgatgtggaattataacacatcaagatatggatcaaaccaccacatatataagttgttgatcattcagttgtttatacaatagattgttaagattgaataagtaatcatatatatggttgtcgttgtccatttgcattttggttaaccaccaaatttaacatgtactctaatttctttattgtttggccatttgttgcatgcgtctagctatctgctatcaattcacccatttcctttaatttaaatggacccttatcgtcttgaccatttttcatacatcatcctacccattattgtcaattgactgttagcttggccatttacatgtacagtttgtaacaattaatcaatgaaaaaaattacaagccaaaaaattaaccatagtaccttacatcattttagctcggaagctatcatgcattctgcggtagaatctagcatcaattgcaagcaaataaacatgacgtaacagagcatattctctctgcatatatagctccgatgcaaggtgacccacctaaagtgttatcaatcaacattgtctgtatatgtctttgtccagttgtattatggttaaccaacaaatttaacctttcctgctatttacttctcgtatcaatttaccactgcctttgaattggatcaagacctttttttcttttgacatttttcatatacatcatcctctgtacaggttctttattcttctatttaattaagtcaacttaccacttacagttttgtaacaattagtcaatgaaaaaatgcaaaaaaaaacaaaatctatatcattttagcatgaaaacaatcattccacggtacgaaatagcagcaattgttagcaaatagaaagggcgcacagaacatgcatattgtctgcctacataggtaccaatctgaagtaggagtatctagcaacaatgtctatattggattcaagttattgtatcactctaaagagataagacacttaatttgttgctatctctcaaaatgtttgcttaggaggtctctctctcatccaccaattttaggataggatcgagtacacatgtgtacaccgatgttcagtgcacttatgagttctaacattgtttcaagtgtgtagtcatcggcttatcgaaaaaagacgtgtgtggatatggtggtgggagtgtggtgtgtatgagttgtatatgttttgattattctattaaggaaggttgctaggttcatacgatagagttatcctagttacatttggtgtgttaacttagataaacaaattttaatggttgaaaatgctagcgtcttgccctttactgatttgccaacctcttttcatttgtcctttcactgattcaacaagaatattatgcttgtgaagtacttcattgatttagccctccgatattaattgttctatttcgtaacgccattagctcttaatcattttttcaaagtctcatcacagtttcaactttcatgggcacaagctaaagcggcattcagagatccccaaggtgtggaatagtttttagaatatgatattactatttgagttatgattatgtaagaagaaatggcttaattttataattgttgtggttgaaactggttttttcatgtctcaatgattgccaacttgtcatcaacttgcatgggtaaggagaaaatgacctgtttctctagaaaaaaaatttttagtctttgaacaatgcaaaatctatttgttcatttgtctttagatgaaggtaaaaatccatggaattggtgaccgatctgttcattgctgttaagtttagtcaaaacatgcagtgctgtgatgtgatgtttggttagttacatagagtacttgtctagtgcttcttttttcttttatttttttttgttttctgttgacatatatatgttacttttgttgatgccaaaaagtttatcctcttgatttgcactagtcattataatcggaaggcgttgctcaagcgaagttttagcgtcgacatttcaccacttatgttttactagctacagtaattaaatatcaaggagaaaaatattactagtggttgaaacataaggagaaatggttgtgtgcatctgtttggatgtagaggcctgtttaattcattattaaaaaaagtgtatttagatgacacaagattagaatagctaagttatatgaagaaaaactactaaatcagcccaattctttttttaacccaccccttacattttgtagaacaaaaaaagttgaatccattaccatccctaatcgcgccacgacctgtcacatgtaagctgtcatcgatccgtaaacataggtaatttttgtcctatagctaaatggagttggtcttcagacgacttaaaccaagaagaaattaatgaaaccaagaagtcgtctgagtcctgtcaaactaaccatgcattgtttatttccttcattagaaagataattaattggtgttgtcattgtcagatagatgaacacgttaattaatttgagaggaggcgatcgatcaacacactcaaagtcatcacatgcgttgcacctcgatcgatcgatcgagatcttaccccgcgttatcacttatcatcatcttcttaattacgttcttcttcgcgagaagaagcggtgtcggaaggtggccgcgccgccgtacgaccggccgtcgtggcgtgcaaaaagaccagcgacaacgacgacgacgacggcgacggcgacgataccacggtgactagctaattcagtggaaggagatgcgtttacgcacgtataccatatgatcgaataatgccgtcgtcaatttgtcgtcgtcagtgaaataatccaaacgaattaattgtacgcgagaattcgagatgccacttgtgttaatttagagcaattaagagaggcaaccactacataaaattcaagacaaaaagagagaggggaagagtagattagccaaacaaacattgggactactgtattagaattagtatagatgtgatatattgtatatgttacctctatatttattagttgatgatgtggtatgcaacatccacctcttttataaaacttgcccttagtcctaaacatatcccctcaacatgtgtccaacgttgtaaacgtgtctgtgattggctgggcgtgcagatcgataaccattttaattagtaataatgaagagacaatctagaagcacattgttggcaaggtcatttctgccctcgttttaggtgcaatattagatttttgacacataaccacaatcgatcacataattttggaggagggcgatggtagagtcgtatatgtataactctatatatgggtgtttaaatcttggtcccgataaatatgactctgtgaatccaccaggtgcagaggctgtgtgcagttagtgaaaatcttacttgaaatcttaagccacaaagctctatcgttcactctttaacttatcaaatttatactttaaaacttaattttagagttttttctttaatttttttatcatagtttatttttatattgaggcttttacgtcgctaagaaataagaacacatatataagtagtttaatgtataattcctttttattaatgtgttatgtacggcttatattcagttgtatgagaaataatttgactgaatgagattgtacaatagaatcttagtttttttaaggaaaacatgtttaattatgtacacaagaaattagaaacaaataatcagattgatgagcttgcgaaaaagtatagcagcaaaggataacagagggaagtaaatttaatcttgtgttgtttgctcataatttactttaagttggtgtacttaattactttgtttctaattctcaatctaactaactgtgggagggaagttgggcacgtgctccgatggtatgccaatgaaattaatgctgggaaaaacgttgcgctcatcctgatagaagcaaattaaccaagctattgcgaccacaactagatcctctgatctacttggccatgaccagtgccacaatttctgtatcagagagttctagctaatttgccttgtccagtaatcaaaagaggctgatttgtcctgtccagtaatcaaaagagggggaagaatgtatagtataattcttttgaggggaaagaatgtgtagtaattaatcaagttcttaattttccttttagtgtacacttattttttagttttattttgaatttttgaattttaattttatttcaatgtacacattatgctactatcaatctaccaccatcacctattgctatcatatgtatcatatttttttcatcaatccagcgccaggttacaagtttctgagagatccttatctttttttgaaaaattactctatctaattgaaccaaaaataataaaataatagctacgatgttatcttagaaattaccagttttggtagatatcctaccgccatggaacgcttttgcattgcccactagtattttacaaaactaatattctgtctttgtactaaagtctgagggtatttcctttccctttcaatagctactgtaaccgcgagagcttgtgcatgcgtccccactttgtttctccaagtccctctcgtctaaaagctaaaaattttggaaatttcaaaaagaaattgttcaccgcccaagtataatacataaacaaaaaaaattcaaatacttactaaagaattaatgatagttaagaggatactgcagagcataaatgcaatagatattaattgtctccaaaatctagcttagagcaagtttaatagtatagccactggtagctccaaatcatctatagccaatgtaatagccaatttatacaatagttgcttactgtactattaatatctggccccacctgtcatacacacgttacgtcttagagtccgtgctgcagctggctaccgatatatagcccgctgctcttctctctcttcctttatctctttaaaatatgtttatagctggcttatagcctgctattgtacctgctcttagtctaatattccgatcgaggtgcaggtagtaccccacttaaatttttattcccactgaagttaaactatatgattgcagtgccaacacttaagctgacatcacttacccatctactctctctatccagaaaaaaaaaaactaacccgggtatgaactctatgattagatttttttttacgaagagagtacaatttatagtggcactaaaccatccattataagcagactgagttcgggctacatggaaaacaatattacccattaacatgtgattaattaagtattagcctaaaacccttgaaaaataaattaatatattttctaaaagtcatttttcataaaaataacttttaaaaagcacactgtttaatagtttgaaaagcgcgcgggtggaaaaagagggaggtgagttgagaaagaaggagaaagaacacaaccttagtgtctcaactctacaattagtagctaaggccaaatgggcaacatactagtactactaaacaaaatgattggggagagagtgcagaggaagccaatgcatggggagatggtccgtgtaagtttagcaaaatactatatatgctagtagtagtagtaaacaaaatgattagtggctggcccaatgctcccacttgcaagctggagctctcaacactcttgtcctaatgagcttatcatcgtcaatgagacaaaaaaccattcaggtcgctcttatcaaagaataattatttgatcttatcgttggaatcatgctcatttggagaggaattccatgataggtcttccttcctctctttgttcttgggaaacatactcaaaaccattatcatgttcactttttttctaaagaaaatcattttttgacgcaaaggtagagagactctaccttaattagttaatggcaagattgagaaggcagagagagacaggaaaaaggtaaactgaaagggatgagaagctagcaaaaaatagagagaaaacaaaaaagaaatcagggtaaaattccctgagcctagtctattttcgccgccaagaggcgaatgtgtttcaagttggctgggcttgacgcgaaattcaaattcccatatgccaagacattctttgatctggtggatgtgcttttcaaagttgaggtttgtttggtgaaaaactctggcattacttgcttttcataagttgcgagaatcattgttatgttcatcgtcactagattcactttgactgtccatttcttactcaatctacttcaatgttaaggttgcaccaccatggaatgaaaaaagaagttcaaaaatctacagtaccccacaagttctctgaatgtgattactaacaaaaacacttaaatttttaaaactgaaaggaccttaatgcatcttctaggagattaaaataatagaatgaacctggacagtttcatgaggtttgatcagtctattctgaagatggaaaatgaggccgtaccgctagctacccccaagtttgaggaactgaatttggcactccctccatatcaaaatattttctacattcctcctcatctcaaccaatcataacctttccctcatttaattttttatctactttctaatcttaataaatcacaactatttctcacctcaacctttatctctttaaaaaaaatgcataaatagttatattttgagaccaacggggtagctgattacttgtaatttgtttttagctatgttagactagaaggagatttttatttccttgtgtaataaattctatgcaaccgcatatatatttaccatattaccatgtcacgcaaaatcctcctcaatccttctgtcacacatgcatggatggaacttcaaattgatcattccaagctcaccttagcataagaaatcgcaatgctaagtaatacggagttcatattttctttgtcgccattgactcttacatatatgtttaccctctctggttccataattctttacgttttgaacaatgacacagtctccaaatatatttttgactttattttttgttatgatatatatgataaataaatgcatgtttatttttattatagtactttgaaagacaaatatacatatatgttgttattattcttttaagtttaaatatttttaaagttattgatgttacattgatctctggccaccgagtcagacaattgcgcacataggcttggcctatcccacgcccacgcgcggctaacgttgagggccgattccctcggtctcgagcacacgttgctctctctcgtgcaatgatcggacgcactatctacgtaatgggctcgcccccgatcccttcagtgctcacatatatataaagggaatgctacccgttcgttggtggcgatcgatttacggcttagccaaacccaaactctcaaactatcgatcttaaggcgtgttgaaggggaacaaagggcgaaatccattgccactgctgcacggtgatcacatcaccggtggcctactactgcaacaccgacgccgacgccgacaaaggattaagtgtggtgctaatggcttctccaaacaccggttagtacatcaccaaatttcacataagcttaatggggtgattatgcatagcctgagttcatgattttaagaattaattccaataattgataaccttgcctaaaatgtcaagaattacgaaaccggagtgagtacgtttgatcgtttatcttattaaacttttttctataaatatgaaaaaaaatataaattatgcttaaattaaagacattcaatcaatgataaaataaatcacaacaaaaacaaatgataattacatagtgtttttaataggacacatggttaaatgcatgcttaaaaaatcgatggcattgtacgttaaaaatcgaagtgtaacatattgcgagtgatagatgaagttctggttggatcaattatggcattcatctccttccattaaattcttcgtttccccaagtcgttcggattcacacgcatgatataagatgggaaaagcttattccccgatcaatgcatgtcttcttttacttgacacgtcagcttgctgtaagaaaacagtaacaggtcaccattatcatgcatggcaattattatgctggaaaagagttagaccttcaataattagcacaatggttgtactcctagatgagatgtcaccaaaggattatccatatggtctagtactatggcccaaccatagttgtcaatttgattagctacacatagaagaaaacaaggtttggctaatccaacctaattgtaactagtggataagaaagcctgactatagctgaacacagaagagaagaaggttggctaatccaacctaattgtgactggcggataagaaggcctgactatcttatctgtgaatttgttgttcatatatgtttgctgtttgtacttttcaacttttttgacatttctttctgttactttgttcaagaacatatataagtatataacgtcgtttagaaatgtggttccggaatttacatatagctctacatcatctgcaactttctattatcaattctcaaaaaaaggaaaataatatcaaaacatcacatacaagcaggcttttgaattgaaatggatttcaaaattggatttcatttgtgagcaagtaatgttaattagttgaaccatcaattccttgtatgcatccaattcatatgcaaggaaccaaacagaactcttggtgtcctgtaccatttgccagctacctacattactcaaagccttttaagattcattgttaacttccaaaaagaacatgacataatgcagttaggacaagaccaccacttgattagtgaaggattaaggaagaggatgatagatacactgtgttgacgcacctgaaacagagattgccatagctttgcttttagcagaatcaggtaccctgaccctgctctgctttctagcagctaatctcctttcttttcacactttttaaaaagttacatgaccacaggggaatagtaaaaagcgactacaggtcaactataaatgtcctacctgtctcaactttagaactctcaacttcggtctctcggtgtgagacataggatgtgtttagttcgtatgccaaaaatcttttaattatacggacacacatttaaaatattaaacgtagactaataacaaaacaaattacagattttgcctgtaaactacgagacgaatctatgaagcctaattaattcatcattagcaaatgtttactgtagcatcacattatcaaatcatggtgtaattaggctcaaaagattcatctagcaatttacagtcggactgtgtaattggttttttttgtcaacatttgatgctccatacatgtgtccaaacatttaatgtgatgaaaaagttgaaagtttaaagaaaaaagttggaatctaaacacggccatagtctttaataagatgataaatgtgctgcaccgtttggtagcttatattatcaaacaataatttgatcttatcattaggactatggtttttttttgcgaggatcattaggactatgttgaaaacgctactagtcgtccgggctttacggtgatactggtttcaccgctgggctagtactaaccagacatttttactcgagttagttataaatgctttgcaactgtgtaaccacttatcacatctggcaaattaaatcccttcaattctccagcctcgcgtgcatatggatatagatggaactgcaagattgtctccattggagcattccaagaagctcatctgccacctagaccaaactgatcgattactaacatcagctcgtgaaacatgcatcacgttgtgtcggtgccagatcgatcagtttctctgcttcaattctgtcggccatctcctgcaaatttaggccatgtcacatcggacgtttaacacatgtataaagaattaaatataggttaaaaaataactaattatacagattacaactaatttgcgaaacaaatcttttaagtctaattgctccataataatttgacaatgtggtgctataataaatatttgctaatgatagattaattaggtttaataaattcgtctcgttgtttactgacggattctgtaattagtttttttattaatgccaaacaccctatacaacacctcatataatacctgacgtgacacgctaaaaccttacaaccgtggatctaaacaacccccttaactctgactcatcgtgtgctcatatcaaccgatctgtggctcctgctgccctatttgcatctgatctgacatgcactatatatcgatcacacacaaaatgacacaaacacagacacatgggagagcttcaggccctgtctcctctctgcttatctacaattttattctactacacatcctacgccgtgacacatcagctgctcctactgatcagctagaatcaatgtacgtacccagaatacagcgacgcctaaccttctccattgcagagcaacaacgacatccaactgtacacgataaatgctcatcagagtaagagaaaattagtgtctttagctattatcaatgtatcattatcaatcgataggagctgggatttatcatcgatagctagctggattagtcactgaaaagattccttcgtgtggtcctagttaatcttgggccccaaacgtggctgtcaattactcaagccattgaaaaaaatgcatcaaattaaatcgaagaaaaggagggagctagatgctgtagctaatcctccaaacctactgaatctgagtggccaggtataaacatgaataataatccgagtagcgtataagagggcccggctatcttatcatcatatgtgtgtggagaccatatatatgcactgatcgatcgaattttgtctgaataacatcacaaatttcgctgtcggaaaacctgtaggggatcatcatgtcgttcgcctataatttgatctgcagtgttcagtagtcgtctctgcgtatatataatatgatctcactggttggatgcaattatcagtagcaaattgcatgcatgtactgatcacacatcgacaacttgagtgcactgatcgtatatactccctatgtttctaaatatttgatgtcgttaacttttttaaatatgtttaaccatgtcttatttaaaaaaaataagtaattattaattctttttctatcatttgatttattgttaaatatacttatatgtatacatatagttttacatatttcacaaaagtttttaaataagacgaacggtcaaacatgtgctaaaaagtcaacggtgtcaaatatttagaaacggagggagtataatttcgataatagaatagactgatcgtgttactcgtgggagccatttgaattttgttattgggatggtattgtacatgatgagtagatccgcaagaaacaaaagaaaaacatcgtacgacctactgtacgtaccattggcatgggcagatgagatcaatgaaggaacagatcagatcggtctaagctaataattgtgctccttggctaggttttcaatatattcagatctcttgtaaatttttttatacatcgatctgcatctgccaattgcgttcgattgagcaagattgcttatctaccactactactgcaaatatagtatataatgcaattattgtcagtgagagttgaatatatattgccactcaagatgaggttgacacaaactctgcatgcatatctgataaagcgaaatagtactccctctgttttcggataactgatattgttgattacatacgtctcactttaaccacaaattacttttaaatgattgtgtcatatgatgaatgcaagctttatgtgtatcgataacataacatattttcaagtatttattttttaaaaaaaacaaagctagaggtcaaattaacttgaatagttaatttcatcgtccattatttgagatcgcgggggagtaacaatttacacacactagagtaggatatatatgtgtgcttctaggtcctttttgcttgctgtttggagagaactaatttgaaatgtcacaattgtgacctttcaaggcttattcctatgtttcttgaagtgtcgcaggatgaagaaatttgacttgatctttcggaaagtatcagaacatggagtgccttcacatattttactggcacgtaaattaaaattcttggtgaaacttagtgcgtgtgtcaaaaaaaaactgtcgttaattaaacaccattattcttgtaaattaatatattgtgccaaataatgtcaatatatacatagtggtctatacccttgtcatatccagccgtatggaaacaaattaatacataggatgattggaaattaatatgggatatcaaatatatatttgccctaatcccttgtagtcagagcgggagcaaagttgtagtttaagttttgagttggagcagagtacgtagaatctaaactccccaataagagcgtgggtcccttgttaaagatgccaatatagactatgataacataagaatatggaaaaaagttcaaatacccctctaaactttagatgaaagtctgtctaacaccctaagctttaaaaccggacatccatcccactgaactttgctataccatccatattatctcctaatgtggttttaaatggtggttttgcatattttggaaacttaaacgaataattttgaataactaatataacatatttgtgtatgatcagttataaatcatcaatttattcttcatatcatgctattattatgttggtacttgtttgtaagtgagagctaataaggagcacaaataaatattcaggtcaaaaatttaatatatatgtccaaagtgtatgacatatgatcaaactcatccaacttatatataaattagataaaatccactatgcaaaactatattatggggttatataaacggtattgtaaaatttaggagactgaatgtccggtttcaaagtttagggtatgctagacagatttccatccaaagtttaggggttattggaccttttcctaagaatattaagaacacaaattagtccataaataattcactagtagataaagtgcaaatcattttttatgtgcttcatgctaatgctgcatgggattcctcgagagatataaacaacacctacattatcatagtatattacgatagcatgctgtacgtactaagagttgtaagcccaaactatcctccatggccacaattaagcttctatgataatcttcgtcgtctagccttgaatatgaacttttgtatttttttcaccgaagaatattttcgttggtggtcatcttaagaatgcgcttgtgaaaattaattttcgctgatgaccctcttaaagaatgcgcatgtgaaaatataggatgttcacttgccattacttgctggtggggaactcggccgcctgcgcaaaacgtttttaggccgccagtgcaaacgcttttttaagtagtgcctattgtctcttctggttcttcaccatcgatcgctactagtagtgttggtcacaatcacatatgcctctccaatccttgcactaattgactgtgcttgccccattgctagtgctcaccttaatgttcacgctggcctagtgcatttgccgtttatgctgtactggcccaagtgcccgtacccatgctcacctacactacctagaaaaatcgttttttttttgggatggccaaaaatcgtttttccggatggatggaaagcccgcctagacgcgtaagcctaaaaaatagatcattttcacaggcgacatcaccatctttgcaggcgtcatagccacacgcctacgaaaatagtttaggcgaaaaaaaaatgccgccgctgcagcccctccccccctccggccagatctaggagggaggaaggccatcgccaggagctggcgccacctggagccgcgccggcaccggcgccgccgagaggaagggaggggagggaagccgccaccgcttggacctgccactgcagtccttcgccgccgccaccaccgccggtagccacagttgccctcccccctccccccttcggtcaaatctgggagggaggggagccgctgccgccaccgcccccctaccagcggagccgccgccgccgccgcccttcaccaccggctccaccagatctgggaggagagaggggagccgatgcctctccaccctccgtgccgccaccgcctggagccgccgccatcaccatcttccggcaggtgaggaggggagggagagatgagggagaggagggagtggagaggagaggggagggagagatgagggttgagagcctgataggtgtgatgatttagcgattttggtgggtaggtgtcgcttttaatatatttaatcttttttgcaggtggacaacgatcttgtcccacggttgtcattttcgcaggtggccatctagctttgtaaggcccacctacctgaaaaaaataccatcgtctggaaaaatggtttttctagtagtgctaatgccgacattggtgtactgcatgtgtcatccccaattacaatgcatgttgtatacgtccttgtgaagttttgcacatgtgcccttgctggtcacgttggtgattcctctggccttgttgtctatgttagcgaaccacacctatggtcttatatatcctaaggggtaaaaatggcttgaaaatagatggaaaccagctctatcatttctgtttcactttttttttcagaatcagaaaccctggatatgaaaacggaatcgaacattatagaatacggatacgaagtgaatatgaatcagggcgaatactaatttgaatatttatcagaatatgaaaacaactgtaactaagtttctcaaatcaactgagagatgtagctcattatatttttgtaaaacaatataataacattttaaatttttatcaattaataataatacaactagttgtatactccactttctaggagaattaaaataagcaagaactacataaaatagtatgacatagcctaatgaaataagaaatagtcattaaacaaaagaaaaacaagtcaaaagcaccggactagaaaaaaatatctccattcaacaattacatcaataatactcagtacaaatctaaacatcttgagtagagaaggatgaaggtaatcagctgtacatgaaaagtaattcgtttccgattaaaaaaatctgaatttgtttccaaatttatttccaaaaaaaatctaactgattccggttttccgacagatggtagccttaccgtattcagttccatttccgagaaagtaattccaaatttgtttttgtttctgacatttttcgaaagaaaatccaaccaacactttcatttccagaaacacatccggaaatcagaaactttccaaaccatttttgttcctacttatcctcctgacaccaccagtacggtgatagcctagtggatcttttctaacaagtttcatgctgattgcttgttgcagtataaggctttataattgactttaataatattttcagttcggtggtcaagcatgccacttttcgcacaatacttaccatgatgtgaaaaacatgttccttcatgacactctaacaatgacatattatactttttttcatccttttgggtttgttgattcatctcaacttgatcttgtatgtcacctcaatgagtcgttgtatgggttggagctcgcccctcgctcttggtatagtcattttccgctttgctcactctgataccatgaaagtggaatacctcatgcagtagattggttgcatactataacatgaatatgtatataaacccagtcttgccatatccaattgtactatgacttatgaaaacaaataccaaggattataaaggcatgcacggatatattatgctaaacatatggggctaatagccacataatccaataatgggagttaggtattcaattaatggtactatcaattgtgataagggaggccgatacatcacatgcaaatgtggcgtccatgtcatcagaagagtatagagacaaatcaagtgggaccagctcgatcacttgctagtgaaagggggaggggacgcgttggaaacgtgaggatacagctcaccgtgtaatgtaagccacattttattcttaatttcattgaaatttatagagataggcgctggatataaatactttggatgtggatacaaatccaacttattcaggcaacagattcgctctgaaaagacaaagaaactagagggccaaatgtttccaactcctccaaaaatttgtgagatcttggtgcttggtgggaatttttgagatgtgcaatatgctggaccaaatggacagggaactaatggcgataaccaatcctatctatatatatcattctaaagatatggagccacacaataagttcctattgattctgttggcaggagagaacgaacggcccaaatatggcgcaagcacagaccattaatcttcttcccttcaatttgcataccaaaaaattagttaccacaatttgtggatctcctacaattgcaaccatgcatttgatgcatatgcatgcacccaggagctccacacgacactccatcatttttgacgaccttacattggggagccagccagtttgtcaaaccattgggaactgcatgatttggaaattggataggccaacttttatacacaagagaagttccggacaaattaaacaactaattaggacacatgatcaatgtctagtcagtgatccaaaataagctcacctaccattctcaatttctaattccacagtccatgcatgcttaatttgcagaccagctaattaactctcatgccattccaatcaaccaggcttttgttagctgatcactctccttaatttcgttatacacttggagaggcacatcacagtattatgtaccatacagtacttgtcccaaccaaccaaaagagacagctagcttcacacgctgcacctactacattaccaatagtgaacaaatgcatggctgcccatgacttgtagtacatgggctaaaatttctggctcaaatgcaacctatggggcgcattgtgtgtgcacaataataagtttgtgatggtaacggagaattgccgtggtcccaatctgaaattaacttgatagagctagctagcaacaatgattggaatccccatgaaacctcgcctttcgatcgctatatgatcccatcatcgtcgcaaaatagggattactactatataaaatgagtgagatgtgagaaattaccataacaataattcagcgtcgcttataatcctcgtgtctatattaattaagttaagaaagaagaagcccatacttggtgtgtttggtaggaagaaattgttctccctcagttgttgaactattttccatattctattaatatatatttatagaagagaagtggattttatattaagccctataatatatgttcccttgtttctcatgtgcaattaaataatgttttaaaaaaatcaatatagattactgtatcaccaattattcaacaaacttttgcatggacaaaattaatatagaaatgaagaaacaaaaataacaaatttcattgcaaaataatttgttttgttttgttttcccctatggaaaccaaatttaaccttgcattttgcatattaacagatgacatcctaatctaccttgttccattttccaattattattttcagtaactatttaaatcacatgaagaaaacgtccatgtacgatcttgagggagtattttatttctagacactgggagcagtttaatttattttatacatgtagtagtacgtagtgcctaaggctgtgtttagttcagcccaaagtttggattttggttgaaattggagatgatgtgactgaaaaattgtgtgtgtatgacaggttgatgtgatggaaaaggactgaagtttggatccaaactttggatctaaacacagcctaaataattgttgcaaatctggatgagattcttcctcagtgatcatcccctcgagctcgagctcgttgcttaggctgtatttgggagtgctggcacgcaaaacggagcaacgtttaatgcgtgattaattaagtattagctatttttttttcaaaaattgatcaatatgatttttttaagcaactttcgtatagaaactttttgaaaaaaacattagttggaaaagcgtgcacgcagaaaacgagggagaggggttgggaacttcctataccgaacgcagccttagggattaccagtactccattttaagtgaggttgtaggtttctgtttcaaacgtttgaacgtccgtcttgtttaaaaaaaattaaaaaacttaaaaaaagtaagcattaaatactattcatgttttaattattatcgaataacaataaaaatactaatgataaaaaaatattaaataagacgaaaggttaaacgatggacaccggagcacacaactgaaataggatggtgggagtatataggagtactgtatcaatacactaataaactacgatcccgaagaagcatcttcccaagtcatcctcgttgcatggggattaacatagaaaatctgaattttccaaaacagttcggccacacacctaaaccaaaacaagaaggtcagatcgtgctagctagctagatcctgctggagtagtgctatacttcgatcctttgaagttaggggatcgtttttcggcacacaagggcggagctacatatgcaagggagagggtgtctaggaatttggttttaaaaatttagcaatagtttatctttttttattatatgtgtattcctctcactacgagtttatatatattcacatttgcctaaacttaatcaaagatgagtaaagtaaatgaggggtcctctagctactcatgaagctaagtactactccctccatttctaaatatttaactccattgactatttagcatatctttgaccattcgtcttatttaaaaacttttatgaaatatgtaaaactatatgtatacataaaagtatatttaacaatgaatcaaatgataggaaaaaattaataattacttaactttttttaaataagacgaacggtcaaacatgttatagcgtcgaatatttagaaacggagggagtattcaggaacatgaactgaacatgcctactctcatgaatcgtaatatacgtacattagcttataatttctgtgagggtgatctatcgatcgatccccgatcggatcggcctgcaggttaactataaccactttcgcattctctatcgttttgaccacaatgtatattactgtttattagttaattactaccagtaataagtaattaattaatcaatcaattaatcaattattatccgtgaaacacgcttgcatgcatgtgcgctggccacactcagctgctaccttggcgcgagacgcacggagccacacgtgagaccacccccaccccaccagcgtggcgtgggccccactcccggcccaccaggcccagcccgcgcgcgcggctctatataaatcctcctcctcccctcctcaccatcaccaccgcccacaacctcagctcagctagcaaaagtacaatatcccttgtacggacgcctagctaagctaagctaattaagctctaatttctcttttcttttttcttcgatctccggcgaaaaagtaagtacaatggccgaggtgaacggagccaataacggcaacggccaccacggccacggcaacggcagcggcgctgcggcggcggcggggcggtcgacgagtgtgtcgaggaagatcgagtcggagggggcggtgctgatgcccggggtgtacgacgcgctgtcggcggcgatcgtccagaagaccgggttctacgccggcttcatctccggctacgccgtctccggctccttcctcggcacccccgacgtcggcctcctcacgtaattaattaacacacaattaattaatctcatatatatatacacacacactctgtttgtgtgtgaattatttgctgacactagccgtttctccggcgaggttcatgcaggccgccggagatggcggaggtggcgaggcggatctgcgcgtcggcgcccaacacactcttcatcgccgacgccggtcatctctctctcctctctctctctctctaaaaatggcactttaatatatataagaccaagaaagaaaagcaaattaacaaagaaagcatcgtataatatatgcagtaaagttgacagtgcatgctagatttggaatgctaatgattcagctgggacatgtttgtatagtaatttaagtacaaacttgtgtgtatatgtatgtatgcatgcatggtacccctcgagatataattatatgttgcacatgaactttgctggaaagcacaattatatattagctgaaagggggaaattaaaaaataacactgtcctataacgctgttctggggtccatcaccatgcacaccagaagcttggaccagggatctgcaagtgaaaacagtgggtgttaaaatatatttcttgttctccaaaaaaaagtatatatgttggtgcatgaaactgtttaagaagagtagtttataaggacaaaattatatttttgttctcctggagacatttgctaggtgatctgtttccttcagtgctaaaagaatgttgacacaagtactgctacagctttttttaattatgcatgccatgacgatgattactgttgagatgacgtactttagccctttttaactttaaataaattgtattttaattagcatcacttactgtacatgattaatatgattttctgttgtctgatgcaaaatgtattctttttttccctccagacactggtggtggcaatgctctgaatgtgaagcgtactgttcaggacctgatggcagcaggtgctgcaggctgcttcctcgaggtgatggattcttcttcaccttgtcttgctcgcactgtgcaccacatgttccctttgcaactattaatcaatagtagtggttttgattttgacaaccaaaaaaatatatatcatattgtcactagtaatcagtaatattgattctgtcttctcttttgcaaattccaggaccaggcatggccaaagaagtgtggtaaggaactattcatctgtcacatcaggaaaattgttttttcctcaggattttcttctctcttttttttcgattgctaatttacttttgtgtctgtttgttcatcgatcgtcaaggacacatgcatggcaagcaggtaaatactgacaacacactgtttttgtccctacatgttctagacaaacatgtactactactgtatagtgatactaattctgtttagcactctgttcaccattgcaaatccatgccaatttatagcttaagtacgtacacttaatgcacacctgccaaaatctaatgaggaaataaattggtaaccgatcctgtcgttccgtgacatcgaaataataacaggactaatgtgatgaatcacaacttaattatcacaagttataatgcaaaaatagctagctaggatggttcaaaatgaccagaaaattcgccctagctatatatatttaccctctattatttcacatagcggagatttgatatatatatttatatctactttgaatatatggtgtcactttcactaaacatattgatattggaaatgaagattctgctgaattaattcagtgacacgtaggccccaacattttataccatgcatgcactgttaaatatggaggacccattacaactttgcttttgtatgtataaatatgtctctgatgtattaatggcaagttctagctagatccgatcgatccaacattttgtgcattaaacaaaaacaaactaccaacaacaatcaattaatgattttatcacagccattatatgttgtctagctagctatgtagtagagtggtaataagatcgagtgcaccatgttctgcatcttgtcaccatcatcgaggattacaaaattgtggccggcattaattaccttgatctctaactctccttgtgttggttaaaattaaattaggtgataccagcagaggagcacgctgtgaagatagctgcagcgagagaggtcgttggtgatcgggacttctttatcgtggcccggactgacgctcgatctgtcactggtcttgatgatgccattaggcgtgccaatctctacatagatgtaagcagatgaccacttcttttttctagagagagataaatcatgttctagagaatctcttcagagtcaaactctcgtttaaatttgatcgatctcaaccaccaactattaatcttaaacaagttcaagtctgtcaagaatcaatgttttgaaattaattagttctttcattagatattggtcaaagttgcattttgaaaactgatatatgtgaggcgaaaacactttctttttacatgatgaaatgaaaatggtttgtatctttgtcttctattatatattaggctcacaaacaatgtctgtggtatatttttctcctatataatggaatttaacccattggtgtttttacattggtctttactggttgtagaatccaatctaaaccgttcattttcttctaatcaaataaaatcctatcaattatattactatacgtacctcaactacggataatacaattatttcttttcctatttactagtaggatatattcataccagtagagatcaccgtaaattaagctattattattcaacatcatatcatatctaatatgaatatatgtaaaaaaaaaattgtaggcgggagcagacgcgtgcttcgtggaggcgccgcggagcgacgaggagctgatggagatctgcaggaggaccaagggttatcgcgtgtgcaacatgctggagggcgggaagacgccgctgcacacgaggcaggagctcatggagatggggttccacctcatcaagtcccccctcaccaccgtctacgctgccgcccgcgccctcgtcgacgtcctcgccgccctcaagcgcgccgagaccacccgcgacgagctccaccgcctcaccaccttcaccgagttcaacaacctcgtcggcctcgactcctggctcgacatcgaggttcgcttctccgtcaactcctcctcctccgttcccaagccgctcccggcaccaccggcgctggagaccacgacggagatggagaaggccaaggccaaggcggccgccgtcgtcgccggaaacggagctaccaatggggtacactaagatcgatcaagatcaagctaccaatggaataaattatcaatcgaaatgtggctgtcatcagggagccatgaaatatggtggattacattgattaattctcctgcattattggtgaattttgtgaggtatgtgttattattgcatggtacgtagctatatattgctgtgtgagtgagtgagtgattatgttgggattgggtgcgtgattccgcacataaactgtaaggtaaatatgtgttgagtattcttcgttttccaattttttcgattcagtacagtatatgcagctatgcatctgtctgaattttgagtcagtatgctcgtgtgtgcacggtccagattgatcgtcgatccatgaagcatctgtactgtcagtcagtgtcatgttcagtgtaccttcaaatttatttggaataaatcggcccatggaccgtctaccattgggctgttcgacatcttcttgtggactgaattattctgttgtattcagttatttggaaataaagaaacttgtgaaattttggccaagtttgatggccactactttgtttgtggaccagaattgcctattaattttctgctgctatgagtgcttctgaagatggaatttatgatttctatagattctgtggtttatcaacaagcattgcagctagcaacctgagcaagggtaattaaaaattaaattaatggtgatggttccctccattagtctagcaatgaatctgataaggaatatatgtgatgaatacttcacatgttgaagtttgcttggccctatcttctttctgctattgcaatcttcagacaagtccaagtcaggatgcgagctatagtttagcttttgatatctgtagttcctctgcacattctcatcgatatttgtagcttttgatattcatctatcaatcttgtaaatttgtaatagggggtgatctccgttggttctcggttgcagagtttccttatttaaaaacagttagctattacttcgacactagaatttcattgagttgccttggagtaaaaattctgggaatattaccatgagtagagcaagtcttggtaatcagtcattcagttgtgcgatgtttgattatggcaaaattgcaaaggagggtcataattgttatgattttattctagtttttgaccaatttgactgattcaattgaggaatcgtataaaatgataaaagtttaccaaccttacagactgctacttatgatgtatatagtatgattttttttccatttttttattagtacaaatgcatcactattttttttctgttcaaatatatgcatacaaaccgtaattatgaatgcatagaaaattcaaacacaggtattaaatgcaaaagacagatggacacccatgacattacccacaaatttaactttttttacatattttgggcctgttacaattgccgagtcattggaattcatctagtttgagtgattaagttgggattgtgcgtgtgattccgcacataaacagtaaggtaaacgtgtgtgcgtattttttttcaatcatttttttattcagtacattatatgcatctgtctgaattttgagtcagtgctcgtgtggacggtccactatgatcgatccaacatctgtccctgtatcttgaaatttatttggagcccatggactgtctacccattgggctgttggacatttacttaattattgtggaatcaaacctgtggtgttgtatattcagcaattctgaaacaagtttctgaattttgggccaaattttgatggccactactctgtttgtggggcagagttgcctcctaattttgtgctgctttgggtgcttctgatttctgaagatggagtaacttgtacagattctgtcgtttatcaaggacaattgcagcaacccatgaacaatggtacttgcagcaaattattgtggatggttctctccatgagtctaggaattaatctcctgatataaatatggctcttctttgtgccttccatattgcaatctctgagaagtcaggatgcaagcttgttgagctttagcttttgatatagtagggtaatatatattttttccatttctattactagaacataaaagctaaagctaaagctcattcgattaaataaactgcttagttgaacggtgcataattttatttctttcttatacaccgttcaactaaccagtctagttaatcgaatcgtagagttccagttaaagagaaaagaaagaaaaaaaaacttgatgttatatctattttaaaagataattgcttgaggtaggtagtattagagattataagtaagaataaaaatgtttagaaatggtcagaaatggtatcgattttttatcattatttcggaaaaatggatataaacaattagggaatttctatatttattatgattttaactatttattgtccacttcaatacgatgttaacagaaattttaaaaatggtactatatttattttgcgtaaactgtatcactgctattaaaaaaatttcataccatttccaccccgtatcggaacaaaggctgtgttcgcatgcttaggttgggaacatagtgcctccgcacagaaaacggagcggcccattagcgcgtgattaattaagtactccctcctttcaaaaatctaagttctatttttttttgcaccaagactaaaaagcaattaattagtcaccatgtgacaaaaccaattaacatgcaaccaataagcattaaaatagcttcttggattcctatcaacaatttaatttagcacataatgactataaataggacttagacttttgaaaaaaccaaaaaatgaaataggtcttacacttttggaaggagggagtattagctaatttttttcaaaaatggattaatttgattttttaaagcaactttcgtatagaatttttttttaaaaaaaacacacattttaggagtttgaaaaacatgcgcgtggaaaacgaggggaaggggttgtgatcaaggggttacaaacacagcctaaggagaatagggagacatagtttgatagggatagcagtgaccagtgagctacatccctggatgccacgtaggcaaggaatgcccacctcgagatccacacatccaaggatagccatccacgtggcacgtgggacccaccatccggatatagcgcgccaccacgagtgccaatggcagccaatgagatggcagcaagcctcaccctatccacacgccaaccacacccacaacattttccctcccaaatccgaatatccccaacccaactctcatcacacacaaaaccaataaaccatcaccacaccgtcctggtcgtcgtctccaaccaaccaaattcttgcacacgcgcagctcgagccatggccggagtgagcaccagcgtcgtcggcctcaagcccgccgcggcggtgccgcagtcggccgcctcgccggtgccgaagcgcgtgcacgtcgctgtgccgcccaaggaggagcagggcggtggcaggcgccccgcgctgctgggtctcgccgccgtgttcgccgccaccgccgccgggcaggccaaggccggcgtgttcgacgagtacctcgagaagagcaaggccaacaaggtgagaatgtgaggtcgatcgatgattcgttaagtctcgagttataattaattcatgatttcattgctgatcgagctcgagctagagctgagctgacgaggcgattgattaatcgtgtgcaggagctgaacgacaagaagaggctggcgacgagcggcgccaacttcgcgagggcgtacaccgtcgagttcggcagctgccagttcccctacaacttcaccggctgccaggacctcgccaagcagaaggtctcatcacttcattactttcacaaattccactctcttcatcctatcaaaaaccaaacctcgttcaggatgtatcacatctatactagattggttttttatggaacgaacaagagtactgcatgatttaatctgaaacctcttgtgttgttgcgtgcagaaagtcccattcatctcagatgatctcgagatcgagtgcgaggggaaggagaagtacaagtgcggatccaacgtcttctggaaatggtgatgatctgatgatgatcatcgatcgattggccagccatgaaaacattcctgtacctagaacctttgtgatatgacacaactgcatgcataattgaacgcttgtcgtgctcactgtgtatttgtatcatctgagtggagatttgtagcgaattttctctcgattcgtcgatctcactttgatttctaatcatgcatcttatattggttcaccaagaatagattcaatcaatgtgatccagaccaacaagggaaagggaaaagaacacttaatttactaatttgaaagaagtgagtatatatctgacacgtacaagcacaaaaactgcagtttatgttcgttggaatataagactcacctttaaacatgagatttttctaaaaaaaaattcctggcaaataaaagttaaagaattacagagaagtagagccatatgcatccttcagaaattcaattaaacttgggtgactcgggaggtgacaccccaagcccccgatcacctccccaccatgtgcgccaacgatgctccccggcactattggcggctcctccttccacactccacctctctccgccaatttatcctctcttcttctctttccccccttcttatttccttcagatatggtaagcttagaattccctctgccgctgaccaccttcactgtcggtggcgatgctccctgccagcgccggttgcacctctccttccaccatcgacctcccaacagccacccctcctcctctcttcttccctttcccaatcatgttttcccttcatcttcttggatttgaagagcttctcccccctggcttaagatttagtagcttctttgcttgggtcgtccctagacctgaccgaatcgaggttgaaacaatgcccaacacgtgtgtgctgacatgggtggcatccacatggagattgcactagccgatggccagtgccaccaaactccaactgacctccccttcactgctatgtcaagtggtagatggtttccttcctcttcctctctgttggtatcctccctctccctctctttctctctttgtggcactctccttgttcatattggaattagtcaacctagtctcacctctacgacactggtttcaccgcatcacatcttgtcctcgtagtcaattgcctccaatggaaacagtttgctctgccactaaggcaaagcatcgttcaccatccatggatgtgataagtgagggctgactgttcttagaactgccaacggcgggctttggtgtcaagtcttcttccatccactttatttaagaacaattaatactagttagaacaacaaaaagacatcaacatgtatttgatagttgtgcaccgggttttgaattctctccacgatgaaaaacttggaaaagtatttcgtatcaagtatctacacacatcacaaatcacaattcacatgatttctcacatgaagtacgtgcgtgtgaggtacataggattcaaacataggatcaactatatctccacagcctcccatctcaactataatgctctttttgcctaaatagcttatgctattattttcggtcttcaatgacaaatctgtagatctcatcgatctccacaacttccatatagagttcatgtttgtctgaagtcgttgaaaaattttaaaatttcgtttatccaaatagagccaacacttctaacatatattcgggcatataaatgacttacaatgaaaatattgtcaactaaaaattaatagatcgtgtcgccaatttttatgtagagttagtctcaatccaaggacatttgggaatatcaaaaaatttgtccgagtagatttgacaacttgggcatgtaaacaatctcaaaaatcaaaaaatcatcaactacaaagctgtagctttggttaaactatatacttttacataatgtttgtcttcacctgacttatgaaaaagttaccattttctttcaaattatcatttgagtactaatgacatatagtttgatactcaatggacatgatagtcttgaatatgatccgatccattgaggtctggtccattgaatatcggtgctggttgttgttatgaactaaccgtgatacattagtggaaacttaagtatcatagtaatttcttgttaattaattacgaaccatcagtgatatcagtgtcatctctaaaggaaccgatagtgatgagtcatctggtaaaaacaccaacgacttgggctcattgacgaaatcagtcgtgtttgtgttcttgcaacttagggcttgtttggttagtgacctgagcaacatgattgataaaaacgtatgtctgagagctacttgagaatttggtaaaatatgcttgactaggaaagcctgagttcaagattacacattggtaattaagatatgtatcaacttaatagatacatattaacgtattcattgattttatgtatagccttatccatgaccaagaaaaaaagaatttgtaagtagtgtgaaaaagagttgtaggataccaggaatccaaaagaatgattttttttcttttttgccttattcattcaattcatttcaaataagatgtaccttgttcaagccaataaatagagctagggttagagttaaaggagcaaatagaaaaccaaattaattagttatagtaagcacgaaagggttgaattcatttttttactacactacatatgttggtaaaacacttacctaagttatggaagattcatcattcatcgattatctcttgtctatcagtaacaatgaacactgataaactcgtactcctcaattatagcaattaacaagtattaatttagaggaaaaaaactaaggatttgaatcaaaatcaaaacaagctcatacttccgatttaatcaatatagatgggactattgccaaattttttattccgaccacaatgtcgcaagcaactgcatgcatggagttgacgtgcctgaagctcgggccagctccaaaatgggaagccggacgcaggctaaaggatgcaaggcagtggttcaagtcaggcatcctgaaaatcctttaggcctttgaaccaaacaacactcaaccatgtgacagggagggattaggccaggctccttttcaccaggatcatgaaccaaacagccccttaaacattgagtgatttcctaacgacaatttaacactataatcaccatcgctctggtcactcttttatccttgtctatctcttgatttctctcaaataaaagtacaaaacaaaaccaactgtggtagggcttcggtgactaattttccaattgggcgagtatcagttatgttttattcaagcaacatattctatgtcatttggatatatgtaccattgttgttgagcgaaacacttgtcacgtgatacatccacgcacacaactgaatatgacacagagaaataagcactaggtcactcgcttattagccatctcattagcttaaactctcatgaaaaagacttcgtacagttctgttaacgaccaaatttggtatgtttttttgcatcgacaagttctcttacaaagacttgatgaacaaaagaattaagcgtcttttaattagttagtattgtgttttttagttgcgcccatattgaacttgtgtcacatatattttatgcttctacaaagctgaacttgcatcaggtacatatgttaagtcctgaagattatgcaaaaccataagtgggcgagagacctgagacttcagatgcaacttcacgcactgtaatctcccttaggctcagctcacaggaagtgccttcacacattatactctctcgggtgctaatctcgcatcttggtggcacgagcaacctagccagagcactaactatgactgcatgcaatctcatccatcttattttttccagtaatgggccaggatcaaattattcaggtaattgaagaacaatggttgttctgtagtggaatgtgtatcaacatgctcataattccaagaaagatagtcaattatgtctttcaatgtattgcagtgttgttctgaccttgctacctacaacaaggttgtggtactcaatatatatctcagtctacaatgtggcttgttagtgttattgcctcatgccattatgcatattgtccaatgctttttctatattcatgtatcaagcattgttgttcacccaaatgtggaggacgaggctactcaatcttaccaccaaagccatacacttcattgctttgtctacctcaagttgcctcactcatcggtatgtactgaacagcccaattatcatgcttcttgtactttccgcccacaccgcaagtacacaacaaacacatcctgccaaaggccatgtcctattttcccctttttctagcacttgtgagccaatcgacgaaggggatgacctttatcactaagccagtttgacatggccaagcggcggccgagagatggattatgttgcctactttgccaagtgaaaaagacaataatcgccatctttggtcaatggttcaatcacatacttttttgtagtaattgtgtgctttttcttttttgaaatttagttcattcctatgaaatagggaaaagaatatttccaaatagaaaaataaaaaaggtgttacatgtcttagtatatatataggtctttacctcgtctcagtcgcacctaattcttagctaggggcccatccttataggtcagtggtgcaattttggacatttgtcgcctatttttagggctaataaggaaagaaacaccaaaaaaacttattttggcctatattgagatgg

SEQ ID NO: 75413 - DNA, 11208 bp, Oryza sativa
atatatgtgtacctagatttattaacatatatatgaatgtaggcaatgctagaaagtcttataacctaaaacggaggagtagtatttatacccaccaaccaatctatattgaccagttagtttcttgtgacttgtagtagtactttttattatggaggttataacttgtacggattttgactttttcttgtattatttgaccacttgtcttattcaaaaaattttgtgcaaatataaaaaacgaaaagttgtgcttaaaatactttggataataaagtaagtcaaaaaaataaataatgatcccaaaaatttttgaataagacgagtggacaacagtacaagtaaaaagtcaaaatcatttatattttgggacagaaggagtactaattaactcttgttgcccaacaccatttcatgacagattggaggcatcgttggttaattataagagaaaaatattacccactgacatgtgggaccaatgtgtcagtggtcttttcgctgtttttgtcgcactgaaatggcatggagggtgaatacttgacccctagcctactctgtttcgtttgcctcaatttgtagagtctattggatggtctacctctgttccaaattacatatagtcctcaatcaaaaatgtctatttttttatcgttaattttaaatatccgtgtaatttaacttgtgaattatatattatgaaagtatttgttttgatgaatctaaaaataaaatcttatgatattaaactaaatcaatggttaaagattgaaaatgcttaactttaaataaacctaaaacaactaatttgaagcggatggagtattataaagttgaaaaacagatttaaaacagttttcaataattatatatatatatatatacacacacatatatatatatatacacacacacatatatatatatatacatatatatatatacatacatacatatatatatatatatatatatacatatatacacacacacatatatatatatatatacatatatatatatatacatacatacatatatatatatatacatatatatacatacatatatatatacatacatatatatatacatacatacatatatatatacatacatatatatatacacatatatatatatacatatatatatatatatacatctatatatatacatgcttttgctaaaatagtgtcatttaaaacaaggtttatatgtatcatactttttctttacttcacccctagataaatctggtatcagaaatactttatagtatctttattactatatcttaatttagagatgaaaagttaatggtcaaagtcacctcaaatactctagtcaaaacatcaatcgaaaaggtaaaacatcaaattatcactatgttcaatcttgcatctacaagacgctaaatccataccaaacaaaactgaactctatagcagacaagctgacctgccgacatcaaattcaacaaatagcagacaaactgatctgccgacataagaaattcaacaacttggtctgggaccatactcaaactgttgctgttgctcagaagaatctctgaaggatgactgaaacttcgaaaatctggtgaggttcatgtcattaaaatctgatagcaattccttcattcactgatatcagcaccaacaagctgatcatgtgtttggtcatgaggattgtacctacctagaaccccccataaggccataacagaattctcatgaaaacaacattgcacattttagatgatgaagtacaattcccagcatctgcattatcgagaaacatcatcgggaattatgttacaacaatacaacagctactatacaacttatcaaggactggatctgctcttggtaactatcacaaggtgccacctgggttgtcgttcgattccccgtgtatttcgcaaactatcaatttttttataaattaagactgctttgtgtagtgcattcaaaattcaatggttaactcagcaaactgaatgggcctctcatcatcctgtggtgctaggggttaagcagcagagccaactgtttgtcttccttttccttgttcgtttagactctttgtccttgtggaaaccgttctgatgtaagccattggtgtcaaggctctcttctccgtgcacccgtgtcgtgctcctccttgtcatggacatagtttttgttacggtagaagctgttgtgtatcgttgcgagtcactgtcaagagcatctttctccctatgattaacattctcattggacaatgaataagtgtgctgggtctctctgcattaagaaacataccatgtaataactgtgcatcaactttagtgcaaatgtaccacagaagaaattaatatcatttagtgctgaccttgaatctcgaggtggcaatgtagcaggatgttcatttggaatattgtgtgaatttctagagtcagtggtactgccatctaaagttacatcgtaaccgataaacttttggaccacactggcacttccagcattgttgcctcggataattgcaatagctttgtccaatatgttcaaagcctgctctacctcaggactaatgtaaggcttattttcaacatgttgctcttgctcagccggagggtttgaagggcctattgcatgatgatccagcttgaataatgccttctgttcactctcctcttcgactatctcactgttcgaggtgatattagtaaccgcgagaacattctgcaaagtgggattgtcagggagggcttctgttgccctttcctccactggagtgacatttgcgatgtcagtagaaccccggtgctcacggattctaacatagagtggttctctcaaagctttcttgtaatcctcatcacaatttgccacagtactgactgcctgcaaagataagtcaatagcaagtgtttaaacaggggatctcttgtgtcagaatttgctcaccccacatagcagtaccacgaaatctatgtaaagaccatactgcaatgggaaaagcgctatgcatattgatatcaaatcatcacaaaagtatcgaggtagtatgccactgaccttctgatagagtttatggccgctgccaattagttgccttgatatgaagttgataagccatggtggaacgaagtctagcttaatatccatattagctattgccctgagtggaggatttggttaaaaaatggagtatcagcatatttattaaactgaaacttgttgagcaaaaagaatcacaaatgaataaattttaaaaactacatacaattatatctttcttaaagttcaaacgtgatttaataacaatctgttcaaaaaaatggagtcaagacatcatgtaaactagcattcaagacgcaagaatgatgaaaattatatattgctaaacaattaaaattaagcaggtaaaacaaattctacagctcaactcacaagtacaggaataacatggcttaataatgaaaaattaactagtaaaataaaaattatagcatgtatccagaacatgcatatcaagtcagaagtacgtcatagaaaaatgaaaaaacttaatggaactctacctttttctaggacaaagtcatccagtccttttacagtcactaaaaaatcactttggttgacagaatcactaatttgattccaagtttccaacaaaagtgggtacaatttcaatagcaaatggagcgatctataatgcatcttcgtgctttatattaaataattcaatgcacaataggattggatgttttacctgaaaagcttttctcctttgtaatcctttgcaaaacaaagcctccgactacatctatccgaacggtgtcaccagcttcaggaattccatccctactaaatccatgtgtctctatatttatattgtccgtatccgatatctgcaacaacgcaataagcagaaataaatgaactggaggcatggacaatgaagtctgtggatcaaggttcataaaaaataaatagcccagaaaattcagcatacgcacagttttcatgattacaatgacaagatcttctttaagatactctaattcgaagtagtgaagaagagcttctctctccgaaactggccatggaaccttcaccctttcttccaaatagtggatgcagatgttagtcacaacatccatcaaagagaaaatccaactaaaatttgtagaaaaatcatggactgtaaagaagatttatctttagccaacctgaccaaagaaatttcttcaccaacccgaaccttcttcaaacagcctgactgagcaactttaaaagttggaaggttgtattgtggaaacctggaacacaaaaaccacatcagcatatgagaaagaaagtacccatttgtctatcctttttgtttcttgggttcagtggggctgccaaaactttagtataccgctggcaaacatgttatgtttcataaaaagtagtcgaaagtaagccatagaattatccccaatttttttttgcaaacattgttggcaacaattagtccaatctttatgcatatggctgaaatgaacattatgttgtctttgtcagcttactgcagaaagggactttacatgagcaatggtgcaacatcaggtagttgctaaagtaggtacatgtgggccatatcgcagagtgactgctataagcaaaataggcaatatttgagtacacttctcaattaagaacagtcatgtgttaactcaacaagaaattgagtcatgtgagtgcacttcgtgaagaacaaaaaacagcagtaaagaaattgagtaaaaaaacacaagaaactgataatctgaatatctgaaattgttgtgtatagattatccattctctaagtagttttcttagtatggttctatcaacttgatgtaatcgtctgagattaataaaagcttcctttatcaaaaaaaaaaagtagtaaaaagctgtactgccatgttctagataaaagtttttgtgttgattccacatgctaaagtaaaagctgagtcaagcaggtcctgatgctgcctccatgaacttttttttagtaacaaatatagtgtccgacgatgcaaaattctaggcgaacaacatctgaagttgtccttaatgaatgtgctcaccattttttgtacagagacgattcccatgaaacacatgtacctatgcaaaaaacagtgtgcttaagtgactgtgtgtattgtgagaccatagcattttactcactactagttagatttcatacaaacatcaattggtccatcagcaaagccttcagcaaggagggtgtgaaatggggtcccctctggtccctcgcgatacataactcgtaattggtccgtgtcttgcttcacctacagaacagagagtaactgcatatcattgcaccaatatagtacaatttgcatgggaatgtaacagacaatttaatcactcccaaaaagaagggagaagaagacatgataacagcaaattctgacgcaaataatataaatgaggcagaaattgcaagcataaatgcatccttacgctctggagattgatcataacatggcatatgaataagtaagcaagaaaacaatgaatacatcacattttttggtgcaaagtaaagatccatttctttgtgctctaatcacatacacgcagaacatattctttaaatgttttactttggttcaatgcataccttccattctttatgtgatgcctcatgaatcttcgaagatcgttcattccccgaagtatttagcatttcaagaaaattcgagatctctttagaccttgcttcagcaatcaggtcaatattgcctaaaaatgatacaaaaccaaatcataagaaaaaccaacaacagagagatcacacaagcagcctgattatgatcaactcaaatagatctttcaaaacaatcaactgaaatagtagcaatcattcaggaaccagtaggatattcacacatagacgatgaaacaatagaatctaaacgacatcacatgagagaatattttctcaactgcaaccataacagctcacgtgcagcacagataaggtaaaactaaagtacacaaaaatcacaacattaattacatcaacaagctaacctactcgatccagagaagaagaaaagaaaccaaatcaagcccccaaaccttcatcgttgccggcggacagcgacgacgcaagaatctgcctcttcacgagagatctcagcaactcctcgtcggcgaggtcgggcagcgccagcgtccggtccatccggtcgcgaagctcccggatttccctccgcttctccatggccgccaccatcaagctctagctcccctcctcaccaacctataccttcattcacccaaagccatataaaaggtataagatgagacctttttctctccaagagcaaagaaaaaaccccaagataggaaaccacgcaatcaatcccccaacgattattcctttttctccccacaaaaaaggctcccatcacccttgaatgaatgccaataggagggaaaaaaaaaacaaagaaggcaagaaagctggagactttatgctctcatggctgcaaaggagggaaagcacacgctctccaccacctccataaaagttgccgaatttatctccaaggaatcgatctcactgagatgccaagattgcctacttgtacttgatactactactacttcttcttcttcttcccaaagccttttccacataataagcgaatatatgggaattgggaggagaatccaacccaagcagaagctagagatactctacttaccgctcttgtcaatggagattgctccggcgatgcgcggcggcggcggcgaggatcggcgaggaaggaggaggaggagaagtagtagagagagaagacgcaaatgaggagctttggttggtaaatggatgctggatgtggggcccacctgccggagttttattattagtggcatttcatttctccgaccgagtattttgactagtatatatattttcgtttttcaacctgactgatcgcaactgataactgactaatatattttcgtttttcaacctgactgagggactattaaaaaaaaaccttatataggttttcttatatagttatcaaaatattggcagaattttttatataggtactaaaatttagcagaaaactaaatgtagccatttttttagtaactttaccaaaatttggtaaggttaaaaatagcattgaacagctcataaattcatcaatcaaagctactctatctggtagctgtacccagaatttgtggtgctccacttgacctttatgtacttaccttgacaattcgtagaaacttcggtaggatgtattcactccgtttttaatacatatcacttttaaaaatatatatccgtattacttacgcacttcatgctagaagtaactttaataataaattaaaacacaataaaatagataatactacctccctccgtactaaatataataaaatataatttatatactttaaaacaaaattagtattttctttttaagctgaatgtttaaacgtttgtttaagagttaacggtattatctatttaaagtaaaaccggagataataatcatcgacaatgcgttacgggcaatggtaaagtgcacaaatagacaatgtattaaaaattcgagaggcaatttcgttggcctaaccgcctaagttggccggtcatacaacatcgcgcactaatttgattgtaattgtcgttaattatcacatatcaggaaatttgtatgacactctctaattccaaacatattattttagaccagtgtaatggaacttagggaaactgctaaagtgaccatgtaactacatggtaagaggatacctcttttattaatactattccctccattttataataataataagtgtagttttagctcttttcatttttcttaaaataagtttatgtttagtaataagtggatcataatttatgaaagtagaaaatatttatattacgagtagataaagtgaaaaataattatattggaatttgataaattagaggtattttattattttttttctattgatatgtgtgggatgggtgaaaaataaatataggttgtgtttagttccacgctaaaattggaattttgaagaaattggaacgatatgatggaaaagttgaaagtttgtgtatgtagaaaaattcgatttgacggaaaagttggaagtttgaagaaaaggtctgaatctaaacagaccatagatggaaagagtatacgatagcggcaaccagaagcaatttacatttagagataaatggagaattatatgacatcctatgtttggaatcaaatgaactgtaggctaaaaatctcactggtagacgtaggcctggtttagttcccaattttttcttcaaacttctaattttttccatcacatcaaaacttttctacacacaaactttcaactttttcatcatatcgttttaattttaatcaaacttttaattttagcgtgaactaaacacacctgtatccaacaaatctagagccctaaccaaatactattaccccatcacaatcacaatgaaggcacacattgagctataaattaaaggattcctaaattaaatgcaccggctagagctagcaagaaaacggccgcagcttcaggagggggaccaaccaccatctaccagctgatcgaccatcatcttctgcttggctggttcgagccacaccacaccgccgcagcagacgaagtcgctttcactctcgcctccgccggtggtgccggccggccggcggtgcgccacgccgcggcatttatttcgttctgtccgggccgggctgttgagaagaaatggggatttgggcggcaagctagccggcaatgccatggaacaatagatgtggttttggctgtgtttagttccacgtaaaaattgaaagcttaaaagagattaaaacgttgcgacagaaaagttggaagtttaaagaaaatgttagaatgtaaacagggccttttttttattttttttataagaaatatgtagatgcccacgatgcgggcccatttatctctatgaacacacacgtacatcttatcactacgagcaacctcgaaagactggaccgacatatttttgtttttatttttttatttttacttttcggtggttgctaaactgttgtaagtaagatgattggataaagagggggtcagcgaattatgttagccgtcatccctccgtttcgcaataaaataaaaggcgttataactttttctctatgttaaactatcatgtttataaaaaaaccaatatctatatcatcaaattagttaaataaaaattaaatatatattttggcattatatattttttaaagtattataatttttctataaacttagttaaaattaatgaagtttaatatagaaaaatatcaaaacgttttactccataatataaaactagatgaggaggagtctgtccgctccatgtcacattagtgcgttagtgggtaaccacagcctcttcgagaaaaccagaaacgaaacaaacaacccgccgaaccaatattaaccaagaacaaaaataaattgagatgtttagttgacaccaaaattaaaagtttggttgaaattgaaacgatgtgacggaaaagttaaaaatttatttatgtaggaaagttttaatgtgatgaaaaagttaaaagtttgaagaattattttggaactaaacacgggcgtgaatcacatccaccaacaaaaaaatcagaagaaaaattgtaaataagcatactttactaggaaaaaaaaactaaagcataataaagcatagagtggaataagattatgttgtaacacaccgacagctagcaatcttctctgcaacggggataaacaacctttttctttccttgatgtgtacacctaaatttacaaagttcacccccttgctaagagttataaatcttatcgataacttactcataactaaatgtccctatgataacatctcccacaaaaatctacaagactaaaatacaaacacagaaagaattaagaaaaaaggagcagcctagcaatgtcagtgggcatatggacaagcacagcagccatcaatgaaaacaggcagcggaactttcatcacagttgagcgtaacatccctgaatgtctcactctttctagcacttcatacaggctaactgttttgctgaattaacagatttagctggcagatcttgaccgatttgttatctccataaaggccaatttggcggcagaatagtcgccactcgcccaccgtcaaattcttgacttatttggaacagtgtgaagaaaagaaaagaatcattcaaggttggtttggtttgtggcctaaataggccttaccaatcattcaaggttggtttggtttgtggcctaaataggccttaccaatcattcaaggttggtttggtttgtggcctaaataggccttaccaaattttgtcagtgccaaattttggcaagttttggtatgactaattttggtaaggtaaagttgtgtttggattgaagccaaaatagcctaagttcactattgaaatggccaattttcttaggcatgccaaaatttggcttcaaaccaaatagacactatacactattaaaattgccaaatattggtaagcctaatttaggcctcaaaccaaaccagccctcaatccatctgtagaaactataccttttgagataaaatccattgtacttccaaaatctgatttcaagccaaacagattctatagtaccacatgcactgtatgtatttagatagcgagaaccttgacgaaatttattggaccgactgcggcagtaataattaaacaattccaaaattgcactgtcaagcgttaaacattccatgttgctttccaacgatttccaggctttgatggatacaatgaaatcttggtttaatagtgattttcacggctcaaccaacaactaaccaactgctgccgaatctaattcaagctggtcaattggctacttctccggtggtgaggtcagctgccttaagttgaactttgcgagctctttgtacctctcgaccaccccaatcatgcatatagtctgtccaaaaatcaaacaagtccatcagaaactgaaccgactggcttagcacagttcagcaggtgaccagatgcacaattcacacaacttaatgtgagctat

SEQ ID NO: 75414 - DNA, 55660 bp, Oryza sativa
  unsure (1)..(55660): unsure at all n locations
cccaaatagacatactactccctttccaaatgtcagtgaaaataaggcataggattgaaaatgaattctttttttaaaaaaaaaatctcccttttaggtatgttctaacttctaagtaatctatgatctctactattatttagtattctccataatgttgtgttattttttagaactccatattgttgtgttgagttgaaataaggaacaaacaactctaaagagcatttttttttcataactggagtggataaaggtgttactggtacagaaagggcaatccttgcccactgatctctatcggttcggtgtgagccaacagggattgccaatctttaccagttcatggcgttggagtgaattttcccgcctaaacagccatgaaccggcagtgatgctcaacttctttcaaaagggcagggcgtcactggctgaacaactatggtgccgatggggggaggagggggtatgatttagagtaggataggtaatacaggtgtgaggggaggtttgacatgagtttctgattttatttttcatggatccaaacaaagggcttcacacattataaagaataaaccacatattcatgtattccagcaaagagctttaaataaaagctcatccaacatgtcgattaagaaaatataattatttaaacaactctggagattgcataacatttagcttgcttcaaacataatgtaacattaagtacacaccactattgtagaaggtaccacaatactatttgataggcatcattccagtgcaaataataattagaatggtgccatcaaatctaggaaggccttgacgtcattagcaacgtttttggcgtcatgagcaataccagataatcctctcctcgcaaacccaacacagtagagtccatttgaacctttccagtgatttgggaagtccttcttgggcatgccttctttgttcatcatatcctcaccattctgcgtttttaatcataattattttattaacaaatatttccacagaaagaaagaaagttaaatatgaagatagcaccattgtcttctaattataactataattttataacaggttttatcactaattttgttgagtcaatcacgcaaatgcttttctttctaaatctgtctaatagtattgtaggcactcttaatttgatgccccacttgaggtatgcaggagagagaaaataacaactaaatctaattgcaataatttttgtatttactatttaccatatgagcaacatattacataccttaagccagttgtttgcagtacttgtgtagcctgtagcaaaaacaatagcatcaaagtaactttctttcccatcatcaaattcaacaacatttcccttgatgcaagatattgtaccaaagacctacatgccacataaattccttatagaacctgtcaagtaccaaatagaatttatatagacttttctatgttgtgtcaagaattttgttaccatgatatcacctttctttattatctccacagtgccaacatatataactgctgaccgaccagtattggccttaagaagcaatggccccttattgggcctcacgatgccatactttgagagattgccaaaccagagatatgcaaggaccacaagaataaaatcaacaaatttcactgggaggctccagcttgcaagtttcatccccatgtgaatcagctcctttgtcatcacatgcagctttagaataattcaagaatttgtggtgtaagaaaatgatttaataggatacttacaataacttgacctggaaaacagggaggcaaaataaagaaaggaaacttttatgcaaatgtattatttacttacagggctgcggatgactatggaggtatttgctccatggcttgaaagatcataggcaatctccatgcctgagtttccacatccaacaacaagcaccctttgcgcagcataggaatctgctgacctaaagcttgatgagtgtatgacatggccagagaaatcctctagtccagggatgctaggaatgttccctgcactattttcaccacttgctacaactaagaacctagctgcatacttggacaccatgccattcacttggtcatgtgttgtgacaacccaatatttttgcacatcatcatacaaacatgactcaacagatgagttaaatttgggacaaatgttgaaatgctccacataatcatccatatacctcaaaaattgaatcttggggatgtaggttggtgtgtcttccggatatggcatgtggggcatctcgcagaactcctttgcgaggtgaagcttgaggcgatcatatgtgtgcttacgccacagcgacgcggtacaatcctcacgctcgataataacatagggtatagagagctggccaaggcacgccgctgttgcaagaccagatgggcctgctccaacaatcagaactagagccttctccatgagaaaataaaaggaaagggaaggaagtgaaactaatgttgggacactattctgtatatgttgttttttctcttggtgagatgtataaattctcggagagcacatgctatttatacggaaatttgtccgttactattgactgtaatgcatatccctcttacatgtattttggacagattcacttcacatgtattaagtacattatttatgctaccggccaagatagaatgacacatatgtagacaaaagtacaaggtttcttatttaatatgtcctctcaattaaagagcatatacaaatgatttttttctacattaacatgatcattaagtggtacttgtatatttaattattgattaattcatactttaaaatacttatcttgtatataatacttatcttatatgtcatgattattgggaagtgttgaatacgacataaaagggggggcattgtgttgtgagtttcccaaaaaaaaaatccaaataccttttacaatgactggaagagcctctgtttgcttttttcagataaaaccaactttattatgcatggatgccttgtttgaggaacatgtctctttataagtactttcggtgggagatttgttttatttatcttcagttactaccacattagctagcaaatagagcacgtataccaattggattctactaggttcttgtctaaagtgcataaagtgttgtaatatggcatgaagctgtttgaaaagttcaacttattgtatgcagtggacacgaatccaaagcatttcactactgaaatgtggtaaactgtgaatttggtttgcattttccccatctcaataacagtatcctcaaaatcttaatttatatatgtatccattttaaatatatatggtagtgaacatatatggttttagcaatcttaacattatatcaacttattactctacaagcatcactactggaatctagaattttcttggtggcccgttagtttttttggcggccaaatcccgacaactaaaagtgcttgttacctttgcggttatccgccaacaaaatgcaaaatggactttccctcgctctctagacttggcaggtattccttttcggttagccgacaaaacatattaatttggtggttttgatactatccttaacggtctatacatgtctctcaagaaaattatggaatatggtaaggcatacacatttgaactccgtagattttctattagttctaaatttaattaattagtaatactatcaataaataaataaaaataaacaatattaaacaaagtcttgaatatgtatcctttaattattttaatgtattagtaccattgattatttgtagtttcatgtgaatgtatgagctattatttactacgaattgatgcactaattagttataactccatgcatgcttggtgattttaatccgacctaatttaatgagatgacgtactacttgtaatgcaaaacatgtttgtgtatgttgttctaattattgtatcatctgcctactgcacaaaaacagaaaatctttatcttaacaactaaatgtataaaaacgcatggtgagttgtgataacatattgcttcatttttttaggcaatattagaaaagtggagggggtaggaactagataatacgcacactgtcctgcttttgtttttgcaataccttgtttttctaaatattatgtgcaattcttgaactaattgataggacatacactaccttctactaggacaatagattgctccaagtgagagctagattcctttccatttttaagtatattgtcaaacatgtaacttgggagctcttagtcatcatactttcgtgaaagatacatgtttgacaatatactaacacattccccagaagttaaagaggaaactgaacttaattttttgagaaaacttgctttgggcctggaattaactattaataaattaagttagaaacttttggagatgaaaattagaaaccgaagcttggccccacatgttagttagatgaaatcaaccatgtctggatacgtactgcttaattaagagtgacgatgcatgttgatcatatttgttgtgaaatgataatgcacttaagttggaagttttgcagatcgagtcatttaattttgtcaatatgtgtacaggtgtatggttagctatcaattataaactgaaacggaagccaatacctagggatgtttgtgtgaaaagtaaaatgtttgctagtaaggcttttgcttgtttgtttgttccttctttattcctacatatcttcaactaataacaacccgtttttccttagatacattctttatgaatatactattcaagagcgtgccataataatggaagataggactgagcttgtgtttgcgtaaagcatacgtgtataagacagtattaatggtgtgatttttttggggtatgccaactaagacaaattcatcgttttctttaaaagaagcatgttcaactttttcatgtgattacatgtgttctttctctaaattaaccctgcactgtgggccatgaaccctaggaataagtcccctttgaatcccttaatcaaattaatataggtccaacctgattcatatccgaaactacatcaccggatgttttaaccactaactattaaaattgatataatttgactccctcgatggttttaagagcggttttaattggcatggcacatcgactttggttcacctatgctggcatatagcaacccagatacaaaacaaaaatggaccccacgtataattgacaagaaaaaaatataaaaattgtggggcctacttgtcatacgccttctcccctctctatattttccctaaccaccctgatctcgttggcttcttgctgccaccttgctgggtcccaagcttgcctgccactgccgccttgcctaggtcctccgagctcacctttggtctaccaagatactccggcctgtagctctatgatgtatccgaacatggagggatacaacggacagacagggctatcaccacctgccgctaaccacacttttcgtggagaacaaaacaaacgaaggcaaccgctaacctaggcaacacgcctaagttattgattactactctagcctcgcgtaagaacttcattcttcatccagagtcctagtaccagaacacttaatataaatactaaacgacaaacccacaacgataagaatatatctcacttaaataagctaattaaataacaaaggaaatcttgaacacttactttattgaagaagcattctccgaggtacaagagaggatagagcaccgacaactcgggcactcctccggacttcccctcactctctactcattttctccatactactaaagtgacacccaatgtatgaaagtgagatgtactctactttgttgtgtgctataaagtggcttgagctcctccttttataaccgttaatgatggttgtatgcggtttgggaggtcagtgcgctagcaactgccattagagagttatcaaggatgaccatatggaaggccaggatgagaggtggtgatggtggtttggtcgaccccctaggttggccgacccatgggccccacctatcagctactccttttgctaggaggctgactggtgagcccctatgcgggtgcaccatggataggcttatttttagtcggttttgactcatgcgggcccttcaattcttgtgctcgcgtacgattggctagaggtacatttcgtcgcatggcgggtgtagattcattcaaaattacctgtatacaaatatttaccaatactcgtaaaaacggttagtaataaacctctaccattaagtttgatattacattttgtttcttttatgcaggagttgacagttaaatagtgcttaatgtccgtcaactgagaggcggaagcagactcctacttgggttgttcacttgttggtggagaacaactcgtggtggcagtaggggggtggtcattcacgagctcgccattgtccatccgccgtggaaggaattgcccctttctttgccggccagcttgaggttgtcatggatttcgtcgagggcgggggattaaatccggtgaggtgggcaagagcccggcccaggcacaccccttcatccttcctcctgtcagcctctccacgccactgccacacaatggagaggggagaaagagagagaaaagagacaagaaggaaagaggaagggcaatgacatgtgggcccgaatgttgactcacccagttaaactagtcagcaagtcatgtcaacgaaaaccactctcaaaatcgctaaaagagttaaattacactaatttaaatagttggaggtaaagacatctagtattgcaatcgaggatataaacattgaacttgctcctgcctaagaatgcatccgggggcaatgagccccacattgggccatggctcgatccagtccagtgctttggcccaacacatcaacgttacatcacgggctttaacgttacatttgttggtggactgcaattttctttctcagctttaattctaccatgaatttgaatgttaagttcctcacagtggaacctgttcatcaatgtaaactaggtcaaggtcaacgtgcaatttaaatatgagtttgaatgttaagttcttatagtgaaacttgtttatctaaatttcaatctttaattcgacacgaatattcgtatttatagttagttatctttttagtggtaagcgatatgacagttgatagcgtgagtcgtttatggtagtttcgtccatatccaatccagtctcatggatgtgtttataagggtatgttattcgtgcgtgcattcattgaaactatatcgttcataaaagttagggtgtacgtgtgtgcagttatgagtgtttgaatataacaattaagaaaatgaaccaataacctaaaaaaacaaacatgcgattggattaaatatgtttagattcgttgtaatagaatatgtcacattcagtattaggttgatttttaatgaggcagcgagtatataatatcgtttggaacgcatgcagtcagtaataattaatttctgagaaaacgacaggtcattttacttatttcctccgaattaagcctcacatttttgtgcagcctctcaagccttatcctcgtctcgcctcgtgctctccacgacacctccgcgcgcgcgccaacgtacttggcgcgcatgtgacccgcgcgaacgcacgcgcctcgtcgtcgtcgtctcgtcccatgcaaccgcccgtgacgccggcgagctcggccgccggcgcgcccccgcccccaccaccacccaccaccacctgttccacctcctgccgcttcgtcttgcccccgacgaggaggcatctgctcgcgtcgtccgcctcctccctgctcctcgccgccgccgccgccgccgcggcgccccgcgcggcgagcagcgaggacgacgacgccgtcaccagctacgacccggtgacagcggcggagcgcgcggcgagcgcgtcggtgtcgcggcgcgtcggggaggcggtgcggctgctggacctggggcgcgacctgcaggcgcgcggcgagttcccggcggcgctggcgtcgttcacggcggtggcgacggagtacggggacctgtcgctgtcggggtacgcccgcgtggggcgggcgctggtgctgtacgaggtgggcgaccgcgacgacgccatcggggagatggaggacgcgtcggtggcgctgcggggttacccggagatccacgcggcgctggcggcggcgctttacgccgacaagcacgcggcgctgctcgccgagaaccagttcgccatcgccacgctgctggacccgcactacacccgacctcgcctacgtcagggacaccaagcactggccccccagcctcgtcgactcgctccgccacttcatcaccctctcctgatcattgcttgatcaattgagctttgatttgattaattaatcaagctatagctgttcgtaatccacaccacaatttgatggactcttatcgtatggttttggggttcatctaaattatgtatctatacgtgaaattgttcatgtctgaacgatttttgaacattggatagtgggtatgtataatgggcaggaaatgaattactagagaggagaatcaaagagttttggtgtttggttataactttgtgaatgtataatgggctctcatgatctagcttgattgcttgattaatcaagctaactgttcataatccacaccacaattcgatggactcgtaatctcgtatggttgatggttttggggtccatctaattctgtatctatacacacatggtgaaagtgaaattgttcatgtcttgaacgatttttgaaacttggatatatatagtgagtatatgtataatgggcaggaaatgaattattagagaggaatcaaagagttttggtatttggttttattactttgttagtagaagtattatttaactttttttatatcgatgcgcttgtttgtattgtttttccatttttaaaccgatatttgtaagggagttaacaaacagaactggctcgactgttgaaacaaattaactgtggcaaatgcaacagttgagctagtacgtgcttctagacagtcgatacttagttttctttaatttgcagccagttagttaattttcttggcggccgcatataatcctgatcatcaaaattactcgttgttttacggttatccgtcaataaaataggcttcttcttgctatctagacttggcgtgtatatatttcttatcgtttggctgacaaaacatattaatttggcagttctgatgctattcctgacggtatatgcctctcaagaaaattgtcactacaacaaacatgtcttgtaaaggcattttcctaatacaggcatttttaaaatgcctttacatcattgtagagacattttgaataatgtctcataattgtcttttggtgaattgtattcactcttgagttgatcatttttatcttcaatacactaacaacctcaacctcacataattactttaaatatgtgtttcatgttacttgtatctagttacttttatatctagttacttagtatgtattaatattcggaaaagtgtctctaggtttaaatgtctaaaaaaatgcctttacatataaagcaaattttaaagtttcgaaaagatgtctatacaagataaattcagcaaaatatgctaaaagtgtctttagagtaaaagtattttaggtgattttgaaagtgcctctaaaagtgtctctagactatagaaatcgcctctacacaagggttttttcgagtgtctagaaatgataaaatagttaaaataataataataaggtaataaaggctaagccattaatccataaaataatttcgtgagcaccaaacaatgtgtttcttccttgttgggctgatcgaaattcttttaattaatagatcgattgtgcttcaggaaggcagtggtgcaattaatggcggagtcgtgggtatgtgatttcacccatcggagtttaaatcaagatgccaacaaatatttttgcatatgtgcttatgctatatatcaaataggaatttcgtgaggttgaagatttgccgttatcctccttccgtctgagcatgtgctggaggacgtatttgatacgtacatagtgattgtgtactacatgtttatctttcgtgtaatcggggaaaaaattggttctacttacttgtagccatcattctctgttcggtggtctggatggccctagtgagcttcgtatgagtcattctggattaggctagcttaattagataaaatcataaaggaatgcaaatgatctttttggttgtttgtgtgcaataaatatggacaacacgtgtaatcgatagtgtttgcttggatcatggatggatagcgagagtgaagctcctatgagtcattttggatgaaggaagctagcctagataaaggtgcagatgttgcctctatggatggagccagtataacatgactcatgagctggtgtttggttaattagttgcatgaaaagcatgatggagttgtatttactgaagatgagagattattttggtcgattttggtaggtcacatgaaccctgagtcagcaagcccccaaggcccaccgcagcacaatccacccaccggatttcagattaaagttcactctagttccctcatcatctaagagttagtttcgactttataacgtattcccatctttcgaaaccagtgtaaatatagtcccaaaacaatttagatgatgatttcagctaacatgacaccgacacggcatgttgacttgggctctgtttacaagacatggtgtaggatcgaacacaagtaaccaagcctaccagaggggggtgaatggtagggaaaaccaaaaacccaaaaacttttagcggaaataaaagttaccctcaaatcgatggaaatctcgacgtagtcctgtcgccgccggtcggatcacctccctaccgcctgaacctggagaaacacaaatcgaagaactctcaaagtagatgacaactttattgcttctctctgtgtttacaaagtgcaacaacagcactccttacaaaaatctcgactaaactcgaaaccctaactaaactatcaactccacgctctgaaaaacgatacaggaaacctcacactccctctctatttataaaaaaaaaactcctacttaaaataagtgtagaactgctattttcaacaggactcaatccaaaatttccaaaacacacagccgcaacctacccgtgcgcctgccatttcctgctcggggtcggacatgccatccaaccgagccgctgctgctcctcccagtccaagtcacggacatgcatacaccatgcacacatgcatgctatctgcacacatgtacatcacgtacatgcaaactacacgctaagtacatcgagtatagcaaccatgtactccaccgtacatgaacatctctatcttctctcattcctcctcgcgaacacccacgcttgcacgcacatctcgtgaagcccgttgcgaagatctctctcacatggtgtccatccaccgtataccatctcgtatccaacttcgtcacccggtatccttgaccgtctggatctcaactcctccctaagtcttgtcccgatccccaccgttgaccgaagttgacctccaagaattctgactctagtcaccttctcacatggtatcccgaccgcactagacctctgttcctccctgaacatagtcccggtcctcaccattgaccaaggctgacctcaagtcatctgcacacaatcagacaaaaaaaccgtttctgggcacagatatcacaacctgacccacattagtcacacgcactcacaccaacatccacacatcttttcaaaccaattcattgataaaatcatttgcacagccaattgttcatcacaaatattaatcatgacaatgatttcacacatggttcccaactccctactctcgcttttcgcatgcacgcttttcaaactcataaacggtatgttttttttcaaaaagtttctatacaaaagttgcttaaaaaaaccatattgatcctttttgaaaaaaaacgcaaatacttaattaatcatatgttaatgaaccgctcagttttccgtgtttactatttgggttggaaacatattcatgcgaacacacccttgatcttcatctcatgtggtatagtgggacctacatgtcactcaaaagggggaaaaaccatgaatccacatgtcaccgacatgggaaaagaataaatttagacggtggtttcaactaacgtgacactgtcgtagcatgttgacttggtcttcatctcacgtggtggcacttacataacataacaatcaaaaaataaataaatatagtggaacccacgtgtcactcataaggaaaaaataaaaaccatgaagcccacatgtgtcatcctttctttctttctttcctcgctatcctctcttcctcatcctcttatctagttggagcaaacatagcgattgaagcgctcggccttcgcctctaggatggccaaatcgcgctgggagaggacacctggggcagctagcgtctatattaggtagcacaccacggcgtcgcgggtgcgttgcaacggcggtcgtatgctgagcaacaagaggagcacttccgtagctccgcggccttggcggctggtttcgcaggagcggcgccacttccctctgcagccgccggagtcagagagatagagagagttgtgccatggagtcaggagacttggagggtggggtttgatttggtttgcttctaaaagatttcctaaaggggaacgaacatgcatttcatcatgggcttacatccaccgcatggacccgctgctgccccatggttaacctcgagctagagacaaggagcctccttgtagggatgcagctcggggataacttgtagtggatggcacttgtctcactgatttggaaggatgggaagctcggcgtcgaggtgcgccattctataggaggtggtggggagggtttcgtgctcctagcctcaccttcctctcgacctccggcctctagaccttccttccacgtcttggcagccctcgtcttggcggaggatggctctaaggagaggaccgaggagacgagtgagctctctcagccaaattggtgggtttcccatcatcggccttcgcctcctcctgcgatctcccccgcagtcgagcttatgctattgttgcttcaccgccgctgcctcctcttgtcaccccacgccacagcgatggtctaggaagcgagaaggccatgtgagaagctcctcgcttgccacccactgctggtcgccacgcttccgccttcccatcgatgagctggcgagctcgaccttgccggcctccaccgctaatgtttgtgcacacagaaaaaggagagaggaggtagggaaggaagaaatgatggtatgtttcactaacacgtgcagctcactgtaattttctttttctaattgatgtgccacgtaaacgccacatcagctaaacccaggctccatgctgccctgggatctcgttgacactcgtattagaacgtgaggatacgttgtaccaggttttgagattaagggacccgcttgaaactgactctaagatgagggacatgaactgaacttcttgttcctggactaattaaaatctgctcgagggagcccatcatggccagaaaacaattagctcctcggcccacgtgggacacacggcccaagtcgcgggcgataccttccctcccccttcccgccgccgctgtcccttgctcccacctccgctcctcgccgccgccgccgagagtagtagtgcgggtctcgcgctgccgcttggcttggctcccatggacgcggcggcgccggaagcgacgggtggcttctgcggaggcggcggcggcctctccaccggccggaagctggtgccgtggtcgagctgggcggagtggcggcacgtgcgcgacggcctcttttacgcctcccccgccgccgctcttcgtagggtaacgctcttcttcccccatcccccacgccgcaaaatcccccaaaaaatttcagcaaacggagtgtgatttgtgactgtctcgcttgtttttttttcttttttttggttcagatcgcggcgtggaggagcagaggcaccctcccggtccccgtcgatgtgaccgcggctttcgtcgagatacggctgcgggatcccttcttccggtaatgttattattatgtttgattggtgcaaagttctttacccttgtgggttttgtggctgtgggagttggggatggtgtgtttgtattgtaaggtgatgatggagtgatggttttgtttcctataggagtgtaatggctgtggatgatgcgctggagtcggaagagatgctgtcgatgctgtatagtatggcgatcatgaggcgagtgcattcctaccgcgatctgcgcttttgtgatgtatggggaagaactctcaaattggaaattgtaatgtgtcaaattgtttcgtagcattgttatgctgctgaaggaaagactactattgtgtgggtgggtttcaaatgttgcatggaacaacttattttgtgcaaggaagccgactttttaagttacagtggtttccgcaatagcatattgcatggtttaggagattgctaagcaattaatagtgcacctatggataatatagaattagagcttaacagtacttaaggtggcaatatggcaatgagaaaagtgagtctttttatagcacagctgaattgttgatcgtactagttcaaagctcctttttgttggtttatctttataatgtatcctattttcagttgttacttaagttggtttttttatgaaagagaataaccatagaattttctacttccaggctcgtaaatggttttgtggagaacccacataagaaaactggctattcaatatctgaattagctgaggctgttggaataccacgagttcttgtcgacattcgtcatggttagaagattttgtttgttgcatcaacctttgaagtggccctgttgcagtcgagctaataaaattatctgtcccttgtagagagttcacatcgcactcttccctctcttcggctgctacgattggcagccattaaggtataatttgttggttaatgtttagaaggactcttaattgctagttattttaatcctgctgagtgttgggttttggttattaggaatacttttcagtgttatttgtaagttttgtttactgtatcttgcctcaccaattgagattattttcaggcatttgattggttgaagtgtatttactgggattcccagactaatgctattcctgatgttcaagttgaagtaaggtcaaaattgcatgagatcaataactttatgaagggaaaagattcaatgaaagcaaagtcgggttcaaaaaggaaacgtgagtatcatcagcttatagtctgaaattgtgattcagttagatctgggtcttgtctgtttcttcaggacctatatagccaaatataggtttccctacttggggttgcattaagatttctctgcaggcaatgagaaatcggtcttttcatgccatgtctctgaaaacctcctgattagcattcagaattttctggtcggccttatgtttgaatattaaagttacaacttgtacatgacttttatcagccttttctgttcttggtaggttttgtttttcacacttcgctagttctcttaggcaaattaggaagtttgtgccttacatttttctaacaaatttaactgcaaataggcaaatctgttcccaattgtgtgatttagctatcacttaatgttacacttgatggtacgacaaaatcttggtcacatgtaatgtgatgcccaattcaagcttgttggagtacaatgttaccgtcattttattctgtatttgtgttggtttcatttacttatagttgcttcggttttgcatgttagaatgtcatgcttctttttatcgttgtactgagaaaaacttaggattatacttgataatgtggtcatacagctcatgaaattcttctgttgcatgtctcttttattaatcctaactgcactagtgcagaattattgaacatactatagaggattacaggtgtaactacaagcatcatcattgtttgttaccattcagtatctgatgtatgaacattattgaattagtttggttgctaccatttgacactgacatgataataaattatgacttagcattcatttcagatggataaagttatatgataattataatcatcttcatgaccctgtattgcaggttctgagaaaatgatttcgagaaacataaaatatgtacgccggctttactacgcatgtccttctgaggttgcctttgttatattggactttttccaacgtggtgccccagagtcctctgaaaatagcgatgtgttagaaactgataaggatgtagatcagtcatctgatattcacagtgaaatatcaaataatgatatgagaactatcataactaaattatcagaaaaggaaccaaggttgctgcttggcatactgaagtcagtaattgaaacaattgagaccatggaagaccttgaaaacaaaggtactgttcttaaggctagatgttatgttttcaaaggtactgaagtcagttcacttcatgcactgtttccaaagccataatccggccatggaaagattattgtttttttttattatttcactgttgttacttgatgctagcatttcattcctggctcgttttagagttgtattagcactactccagtatgaatctgcccttactgttttttgttatatttataggtgaatacaatgctagcctgccagctaaagtggaacttttaagttcccatgttctgtggcttgtgacaaagttaaaagaattgaaggattcaggttgcattggagttgtccatgagataggagtgctctcttcagacaggaatgcagtcccacgtttctgtctagcaaaacttctgcggaagctgttgagtttgtctattatagatgaaagatgtatcatagatgcagccctagtgctgattgagatggccaccaacaatgtgcaggagaaactgaggaagcttcctatgttatccctgggaaaggtggctagagattctaccctcccagagcccaccaaagaaacggaatcagttgaggaagcaacagagaagctggaaatgttcaagtcgcggttgaaacagaaggatttacgtttggcagaaaatgacaccggggcttcattgaacacaatcatgccagagaaacgtaacagatggtctacagcaaagtcttggaccccctgtccaataggaatgataccttgttcatttagttcagtggctgttcttccgacccttgacgtcgtagatcatgaatcaagagatgaaatattagagcaacatgtaagtgttgagcctgatgatcatactgagaggatcggctattattctgacccagagaagcaattggatgctgaaagaattccggaattatcaagaccatcacctgaagaatgtgagatttcagatatgccagaactggcatttcctctgaagggtaggttgctagttggtggggtgtggaagatggtgagcgaagaggagctactctttatcaagtcaaagatgaaaattttgttgtaacaacagctagttcagttttgtcatcttaaatcaacaatttcaggctgtaaaacgaacaagggtagtactgtgctagttaagagaaaaatgtatcgtttaccccccagttttgcttagcctcttctgttgaaaattgagataaagcagcagctttattagttccggcaggcagccattgctgctacctgctgatagatatattcagttctacacttctagtcatgtagtttcagttgcagctagtctgatactaaatttcccaatcgatgtatgccaaaatgccaatccaattcaactctgtttttcagatgataattatattgtaacatggccacttcatataaattaacaatttactcgcagctgtaaaggaacaaagaataggtgtgtacagtgtacgtcaagaaaagaatataaaaactaaattaacatcaatgacgcaaaagaaccccccacgacaaggtaaaacaagcaaacagatcagggaagatgtgtagttattaacaatgttcatcacattagatccagtgctcaacagcacaaacaatacaaacagtttcacagtttctctgcttaatatttgcagagtctgaatatcagagcagcagggaagggaggagcaagtagcatgcaggttcagacacaagactccaggcagttcgattacattgatccttataaaagaccagcaaccataactatgacgaagctaggcgaccagcgggtgaagactgaagaagactgatgagaagacgaaggcggcacagcgctttaccaggccgacaacctgttctaccgtctcactgaaggacgaggcagccttccgcgacagcaggaggggcaatggagacaggcgtgtaggtggcgtcctcgtcttcgctgacttcctcctcgtcggactgaaccagaccagcggcatcaaagatgtaggccttcacttcctcgaagcgttcctccgacagggaaacctcagcgaggagtctccacgcagaagcttctgatgcctcctcgtaatcactccttcgtttcagcacgatgtggccactgatctcccacacagctgggttaacctgcgtgtccagtagctcctggctcacttctcccagagcctgcttctcggcatagcactgtatttcggaaacagatgaagcttagaaagaaatcacaaacatttcacacaattgttgatagcatgctaaaactcatacaccatagttttttttgttaggaacaagtaaaagtttactagagcgaccttatacagatcagctaggtgacaacaagtctgagatatcaatgttagtggatagaactaagtaaatgcatgggcatatacagttcagtcaatattgaggttatatgcatgtatcattttacctgagggaagaggaagatctttttgccgcagtcagagataagaacattgtaaggcacattgttgtcctgcagccagatacaagcgctggaaaccacattggccagatcgctcagtgagttgcctccctcaaaaaccagtcccctcacagggtagttcatcagcttggacacctttactccactattcattgtgccctcagcaaggaaaatcctcttggtagctgccttctcaacagggaaaggcactgtcaagtagtatgcctgtggataaaagaagcaggtaatgatttagtatacaattgtaaacacaacactataacatacactcgtacaggtagctttatcagctaattgttcagatcaaatgcacacataatgggaacgctgtttttcactaaagaaaatatgactcctctagatgtatctgtatgggcattgggacaagggaaccaggagttttaacaagatcgacatttacatcaaagtaaattaatctagcaaccatacaaacaataagtctatttttggtttggtctgcagatacgcaaagttcagtgtcactgtaacaactgaaaatacatgtacccatataaaacacagttcgtgcaattttgcatgctggaagatttatgatttatctaacagctacaagtagatacaacagtaaacaaattccaaaaccatgtgaagagtacctgaaagtggaggtggttgatggttgcaaaggcacccaaactattatagccaagcctgaagtatgggcttgcggcttcagcagccatgtgcagtgcaagcaagaagctctcctggtcaatcctctgaggcaggcggtccagtacacggggaatgagaagaacatggccatattcaattgggcttacctgcagagtgtcaaatagaaatgttaacaccaagaatacataaatatcagaattaaaatagattaccagtgcgaatgtagcctacattgattgcaacaacattaggagcacgatcagcaacactgattggggagctctccacaaagaagctgtcatcaccaccaccattctcaaattggaagagcacctcctcctggccaactttggtgaagttgaacttggcagcatcaaatggttgaagcacacggtccacgcggaattcagtagggcgcttcttgaggtggcgtccttcattcagttgtgcaacaaacccaaggttgcctgggataaccttggtctcacaggcagtgacatcatatcggaacaaacctcgggccatcctgtcttcccactgcaataaacaaacaaaatttgaacttcagtattcttacataagcatcgtaacatggttacacagatgcctattataaacacaggacagattatatcataaaacaaacggagggattagttatttgttacttgcataatcagcaataccatctcgcaaataatgctgtctggtgtatatttggctagtaataacttcatgcatatattatttctattgcatggaaaacatagtaagagcatgcaaaagcaacaaaaagagaatatacactcaaacatgaatgctggatgctcaaaattgaagaacatttctttaatgcgtgcatgggtgctcatcataacttccatgcaggttatacgtcataaatatacgcaattgttacttcttgacaatatttttccacaacttaactagtaggttgataatcacaaaatataacgtctcacatcttagctcgcatgtaggaggaaacgagtcagaatcggtaagcatttccagtggatatatagggagcataacgatcttttggatccaattacagagtatccgatacttgcccatttgaaatttgaaacaaacacatgtaacaggcttggaccaaactggtgatgacccaaaactgcacaaccgaacgctactataatacatagggcaaatatcttatctaattgcctcagtagctctccagagagctaacaagatttcgtagttgtgcgcaatacagaacaaatacttgaacttctcctgtgcgaaatttaaagtgtaagcttctatttagtatttaccaggccgagcaggagattgacaaagaactcatcgttggaagcatcctcctgcgaagacggctttttcggactcgccttgaaagcatacagcggaagcttggaatctgctcaaggaaatgcaagaaaaaaaatgttaattcacttaaaaacaagtggtagtaagcctatccacacattttttttttgtggtgcctatattccctataagattttgaagcatctaagtaaaataatatgtggctcctatttttatcctaccaagttggaggaaaccaaactacaagtggtgaacccaaaaacattcccagtaggccagtaacaatattttaaccgcaggggttaaaaatagcaaaggtaaagcatccttcctactagtggtgacaggatcctccaactttcttggaagttgcaaagatgttcttattcttcttttttttttaatttgcgacgaaagatgaatttaatattcaagttatacccaacaaaaataagcacaaccatttttctaatcaaacgaatcaagaaaatcatcacagaagaaaactgtaaccaggatttcggaatccaaggtgtaataataagacaataaaataatctaagagtttttttaatcctgatttgggaggaagagactcaccgggcaagcagcaatccccgaggcaatccctcccgcagccggcgcgggggcgttcgccggcggtggcggcagcatcctcctggtagttggaaaccacggtgggcacccgcttgatggtcagcttcatctccatgattaaatctcaattccttcctctctctcggggtcagggtcaggtcagcgaaagatttttgttgattggatgttagagaaggtggatggggggggcgagcggtctcagaggcgaccgccgccggcgaggaagaggaggtcagaggggctgccgccggccgagggaagcgccccgcggccgccgtgcggggctgggctggacgccgtcgccggagaagcgatggctcccccactgggcgtgggcggcgcagctgcgtggccgcgcccgaccgcttcaacgctagccgtctttgccgcctttcaactcgcccgtctagggatgagagccctcctcacgatcacaacccactcccccccacctctcgtcggcggcggaatctcccctcttcctcttcctcttctcagtcggcggcggcggcgacggtggtggtggtggtaggcgaggaggggagagggtggaggaggcaataaataggcgagaaaaaaaaagaaaaaagaatttgcggcttttgtgtggtttgtgatgtgtggtggatctcgtgttgggattatctgtggacagactagctttactgtgtgtgtgttctgtgttgtgatgagttttgcttctgctattttagggtgggggtttgtgtacgaatttgtgcacgttgggggcatatggttgtggttgtgactgttgttgtttattactctcttcgtcccataatataatggattttaggtttttgcttacaaacgtttgatcactcgtcttatttaaaaaattttaaaattattaattattttatttgtgacttactttattatatacagtactttaagcacaacttttcgctttttatatttgcaaaaaaatttgaataagacgagtggtgaaacgttacaagcaaaaacttaagcacgtgctggggttggttactgtgcttgattcggcagctgtacccgttgatagtgagatttagtactaagaagtattaattgtgtttgtgtagctaggtcttaggtctatgcgcatgtataagagcaagtttaatagtatagcccactactagctccaaataatctatagccaatgtaatagccaattcatacaatagttgcttactatactattaatacctggtcccacctgtcatacacacattacgtcttggagtccgtgctgcagctggctatagatctgtagcccgctgctcttctctctcttcctttatttctttaaaatatgtttatagctggcttatagcctgctattgtacctgctctaatataccaatgctaaattttgagccacggtttaggagatttctgttatagaaatactaaaatgattgggctattcatataatatgttatttacgttttaaatgctacatgtatgtgcgaaggttcaaaccaaattagattcgtacgtcccattgcatgtaatcttggtttggttgtattccttgtagtacatggaacgttttatgttggactcacaaaggtattaaatttgtaattccttttataatctcattcctcctctccttcccactttctagcattctttgttgacatgagcatatgttatccaacactatcaccgactacaaggagatacaataatctgatgatccggtggagttgagctctcatgtagccaagaggaactccgatctaggcacaccaatctaggagcgtggaactttgatctgtgatgggcgcatcaattcatcggcgtggagcttgatctgacgacaagtatgtctatcgagcgataggaaccttgatccatccaaggagacctccatccggtagcattttttgtcctcgttcaccactacctcctcctatattagcgtctaccttaccctactatactttcacacttgatgtgaaatgacagaatataactgtttggtttagttgttctattgatcaaaccaaaccaagtcttcttctttgtgcttgcttcgttctattttgaggtaacactggagatatcgatatccttactctactttctctttcataattttcgaactactactgcaagtagattctacatctcccctccatggtacgttcatcttagcacaaactaaatttatgcctctttttttatcatgaggatcatattgaaacatgaaaacaccatgcgctgctagctagtgtcactctctattacatgaggggtgcacaaatttggttataagatgatgtgacatggagtccatacgcataactgtgtatgttaggcttgaaggtcgtggcacttcgtcaaccttccttcttgtgcaaaacaaggtaatggcgatacatggagctccttttaacctagtgttctagttggatcttagctttaattatcaactccgatccggtagttagatagaatttgattgtaacaagacaaggacaactcaatgtacatacaattctactacacatagtgtaacaaaattacgaaaccgtaaagatgatctcgatctggtgcaaacaccgcatgacagaggacagcataggttgattcattgagtgggttcagcgatatgcggttgatgcacaacaccttaacattagtatgcatcatgttggttgttagttgatagcatgatgtgagggcaaggtaagatcatgtaatcacagcggccctgccatgtactccctctgtttatatttgatcgacgcctcaacaaaaatgaaatattcaaaattgatcagtgcattaaccttaggtgggatgcatggctctttggtttgtatgctgatttaatgcttttgcatgcattcaaggaagtgctggtttcctagccattcagtttgcatgcaaggccttggttgaataaaaattgaatgcctgcctaccttaaaaatcgcatgcaagaaattgaagggacaaattaaatgattaatagaagatattttatttgtcttggtcttgctgcacacttgaaatatgacgatcaaatgtgaatagagggagtactattttggatcagcgatctagccaactcccagactagtcagccggctgctaagacttccccatcagtagaggtgggcagaaaaagaccgaaccgaaagaccgagaccgagaccgagaaattcggtcataggcagtgaaagactgaatttttgttcggtcaatttggttagtctcctcggttaaccgaaaagatcaaattaataaaaaatatctaaatgcaacctacaatttcactaaattcaataggattaaactctaatttttacatctctacctcttctaggcatgcaatctaataagagtccttactcatacgtgcttatgatttttttggtgatttttgtgttcaaaatttttattatttctttgcatatatgaaaatattgttgaatttcagtcatgactgagaccgagaccaatttatcggtcctgatattttcgcgttaaaattcgatctttactttttaaaaactgaaataaacgaaagaccgaagatcaaaaccaaaatttttggtcagacccacccctacccttcagcaaagctcttgatcgttaaagatcaacaatatcactggctccgtacctattttggacccatgacgtgtccattctatatacacgctatatatggtttggcatgtatatatacgtaagcatttacaatgtctcttcttcaccggcaaaccaatatttgccttctcaagacttgaaaggcaaaattggctcttttggatcagcaaatgcataagtttctcccgtacatatgtacattaatattgttggccttattctgggtaccgtgtcgcactgaaactagctgatatcagcttgtgcaatttcgcacacatgcatgcatgcacgctagagctaagttttcatgacttcatgagataatcgatcttgtgcatgatgtaactgtctcaattattcaaaacttaacactagaccgatatgctacctctgtttaaaaagacaactcctgattttaagtctagacatgttctacgtacatattcgtgttgatatggagggtttctttttattatgggagaattggaggaggggttaacataccgtggcccagcggcaagcccggtaatcacagtaatcatgtagttatcatagtactagaataaaaaaaagatgaatttatcaaaattaaaaattgtattaaatgcccttttaacttaggaagctacttagcctctatcgttagcacacttatcctgatagtaaatctggttatcattaagaaaacattatattcgataacaagaaaaaccaattcttatggtctttttttattaagatataaaaattttacatcggtattttattagcacgttttttaaacggtcaaacagtgaatttcgtatgaaaattttcttttatttaaattgttttaaaacattggttaacttttatcaaatttataataattaaaacttaattaattatacgtaaatattgtttttccgtgacctgattttatctccttgattactgcaaagaacaccacctcacgttacatgaaaagtaactcgatcttaggaaaatatatggtggaaactacaaatattatggaaacttgaaaactactattggatagaaatagacgtctgagattcatctacgtcaccatgagtaaaaattttactcgtagattcactcataataatatggatgaatctcgaatgtccattttttaatcaacggtagtttttaagtttttcctgtacataggatttgcactgtatatttcccatcgatgttagctcgcaagtaaaaagtagtggcgaccatgtacagcgggcggccaagtaagaaacgaaagatggcgacacggcaaacgtggtcgaatctcgagccgtatatacgctcctgtgattcgagtggctgccgtaccttcttcttctctcaaatcaaaatccaagttagacccgtttcgctgtcgacatctctacagtagtcgatgtcaggtgatctggtccacacagcaaatgacgcactggcacgacgccacgtcatctcgcctcttgtctcaccgcatgctgcccggtttccttttgatgctccggatgaagtactccctattttctaaaatataagtatttttttagctacgaattttgacagctgtagctaggaattaatatttggttcgatcgactccagtagctaggaaccttcctcttttggcctcacctactttataattagttaagaaaaacgtttgcaggttatactcgaaagtaacattagtgaattatcaaaggtttttttttcacggtttctctgaaagagtatcatattttagtagggatgagaataagacggcattattttgttattattatttttagaaacggtcatgaaatttaaatttaagagtcacatcgttgacctaataaacaaatgaaaataccaaaatttgaatttttgaatttgattttgaagttgattttaagatattttctacgtaatttcgttttggcaatggcttttaagtcgctacgaacaaatatataaaagttttacctatgaattaatttttattccctaataagctatttagacttgttaaaaaatatgtgcaaccgataaggcactaactatatcaacttcaataagatgctgatataaattagaaaaactaaaagttttaaaaagtaacagtttataaagatattattattattattattattattagtagtagtagtagtagtagtagtagttttatgaaaaaaatatcggtacggttgagaactttccgtaccgttttcatagtactattttatatgcatggtattagtttatgatatcgtctgtagtatctctatagtatacacactcagaatcgtaagagccaagagtttattattccagccacaaaaccaccgtaaagagactattggttttacatttttttatgctgatctcacttggtttatactaccatttcaactagctagtagtagaggaataatttttcttttggtaatacaacttataaatcaaatgatttcgatccaatactagtataatacagtaatacgtactaggtcaccgtacaaacatactccgaaaaaattgtatccctttatataggaatacatatccgttatcaaccataaaaatgttaaaataattaaatatttaaaataactatatggagcttgactcattagggatgcaaacgcttgactgataagcaagcctatcgatcagaggaaaactatctatactcccatatgtcctaaaatataagaaataagaaccggataggacatttttactatgaatttggaaagacagtctgttcagattcgtagtattagaaaatattctatctggttctagattattatattttgggatggacggagtatatagacttctttattctcatcactacaaagagcatcagtcactgttaattcattcattattccaagcacagaccagctgccaaaaaatatgaacagattgccaaattttgatgatataaaatacggggaaacaaattaaactatgttttcttgatctgatatggcacaaaacactagctaggatcggatgaaagatctcctatatggagtatcaaagtatagtcaactctgccttttctttttggccaatgattgttgaaaattaagctaggctgttggtccttttgacaaaatgccaagagagcgaatagtttgcactgtgaacataacacgcacggtccatacacacacacacacacacacacacagttgtttataggacttgatctttagttctttaatcagtagaatactttaatgtgtgcacataaagaatcttgatccaaaacttccatgagaataatatataagagagcaagcacgcacattctctccatgtcaaaactacgtacaagtatagatgacttctcttttcttttgtttttttatttacacggaggatataaacgtaaacactgctgcgtgcgcgcaccatactcttacaacacaaatgcatcttcaaacgcaggctcaaattaaatagatggagatatggacaaatccctgaaagtgtactcatgtatgtgttatgtttgtggacagaaggatttgcacctgggcccccatcgtttggcttattcatggaataagccaaatatttgcaaatgaaaaagtaatttgctaataaaacttttatataccactggtggagaaaggggctttactcccggttaggaacccccctatagtcccggttatataaccgggagtacgaatccgggactaaagatacccatctttagtcccgggtgaaataaccgcgactaaaaatccatctttagtcccggttgatgttaccaaccgggactaaagatggtggagcagtcccggttgattctttttttttgttgttgtttctttgctcaatcgatttgctccctaaatatcccaaatcatccacaagcatcatagatctgggaagaaatacatcacatattgcaaagaaatgcatcatagatcataaatacatcacatcaccaaatctcaaacaaaaaatacatcacaaatcctaaaagaaatgcatcacaactcaaatacatcccagatcagatccaatatcacatacatcacagatcaaatccaatgaaacacaaaatcaaaaaaaaaatcggcagcaaatgggtgggcgccgccggcctcccggtccccgtcctctcggcgtccgcgccagcttggccgccgacggccggccgctgctctagatcgaggggaaggggaggaacggcaggggaagtggagaggaaggggatgaaggggagaggaagagagagtgaaggagatattaatgagaggggaggagatcgagaggagatcgcgcgtggctctcgggatagtctttgctcccggttggtataaacaaccgggactaaagatctatttttagtcccggttatttataccaaccaggagtaaaaataattgggatctgtcttgaactcgacaactttttgaaccgggactaaagataaaaaagtaccactcaacttttcaaccgggactaaagatgctttttagtcccggttttttttagaaccggcactattgtggaatttggccaaccgaccaaagatggtttctccaccagtgtacgtgttcttagcgatttaaaagtaaagactgaaaaataaatttcgatgaaaaaaaaatcccaaaaacaacttcaaattttggctgataagtataagcgaaaagatgaagcataattgtgcaccaattactactatcatactatctgtgcttacccaatataaaagacctctcttgtgcaatgttgcaatcaatatatcaaaatgaatggagaaaaagaattatactggtatcctatgttcatattcgtagcctccgttttttatggcacggaaggtgtgtactacataatatgaagcagctaggcagtttccttctagagttttgttggggaaatattcgtagatagtcaactgtggaaaacccaatggctctcaagtctcaagcctagtcttgtccctgatggggcacatattgcaagttgcaacggataaaattttgacgatattcatgttattacaaatctgttatactccaagctttcttaggtcctgtttcttttagcttgaaattattataatccagattattaagagtaaactgaaagaaacagacaacttattggagtagcttattataatatggagcccagcttattataatctgataagctcatttaggtgagttttttttccagattattgggtgaaaaattacccaccatgccaccccacttcctctttagatttacaaacccaataatctaggctctaataatctagaaaagaaacaactaaccgcttattctactacagattataacaatctagcttatagtaatctgactcaataatctagattataataatcttaagctgaaagaaacagggccttaattgtctagatattcttgtaagaacagtgctatacatactaaaaaataatccttacaaaattcttaattagtaacaaatctcaactgtttgatctaatttggtggtatttatgtacagaaaagttaagattaaatcacaatgtgacatcagcatttgcaagaaagaattattttttatgtatatcatttcccttcttataactttcacttataattaaatttgttgattttgaagataaaataatatcacttagtggaacattattttacaaaacttactaaatgttgtatatcatggtgatatatgagaatgagatgtagatcctctgctactaacatgtgagctccattctcctctagcactatgcccatatatcggtggcaattactactatataactgtaattacactcccgttcgttggtgatccttatcatgatcttaacatattgctctttttttttaaagtaaagtccatcaccggtccctaaacttgtacagctgtgtcatcccgatccctaaactcgtaaatcgaccgtttaggtcctcaaacttgttcgactgtgtcatcccggtccctaaacttacagatcacttatgtcctctaatttgttcagttgtgtcaccccatccctaaacttggatttgaatatcatcttgttcaaataggacggtctaaggactttatatttaaaaataattcataacattttcatgtaaactctaatgaagataaactttatatcaaacttgtagccctcgacacgatctacaactttgtagttgattttttttttattttaagtcattttttgtcccaaaatgtaattttaaaattaaaatttcaaaatctataaacgtgcaacaatattttgggaccctaaacagttttaattcaaaaaattttcaaatacaaagttgtaggtcgtgtcaagggctacaattttgatatagagtctgtctttattagagtttacatgaaaaaattatgaattattttttgatataaaatttttagaccgtcctgtttagagaccggggtgacacaactgaacaagttggaggacctaaacgagtaatctgcaagtttagggaccgggatgacacagtcgaacaagtttgaggacctgaacggtcgatttgcgagtttaaggaccgggatgacacagcggtacaagtttagggaccagtgatagactttactcttttttttcatcaatcattaatatatccggccggtcactttgccttctatacgctttaatttcaacagtacaatatttacgcaacagtgaacacacgccgtttaaaaccgagaaaatgtcatttgacagctataaagcatgaataattcaccgggattgcaattcgatcatttgtactctatgtgacaagtgattgttgggaccaaataaaagtgtgggcacgttttgtcttcacctatattgaggtgcccccacatgatgggatggtttgtggctgtgaaaaatgaacatggccgtaatcctatggaaaattcattgtaataaaatactgcgtggctcaaatttgcttttgtgctagaatttcgtgcagtcatatcaataattttgtcaaaagttatatatttgaaaggtatcagttgatgtactggcatggattttggccgcaaaattaaacataaagtgtaatcgttctctatgaaggagatatgcaaatgccttttggccaccttttgatatgactatcaatttcaggaggggaaaaaaaataaaaaacgattccgatcggcgatattcgctgaaaatggactctgaacttctgaaaggagatgcgtgatgcatccatatcagaccatctgtttagtttgttgaagtagctgacctttttttcaccgtggagtattagttaattacctctgttttttaacaccaaatcctttcatgcctgagttatacaaacacaaataccattaacgtcgacgatgctcaagatatcacatacggccggagctgaggaagaagctaattaagctagctatagctagcgatgtcgtcagccatggcgtaggtgatgacgtacgcgcgccacccagcttgtcgttaactatctggtgagagagtagttactcctaaattaatggttgattaacattgataggagatctagactgtggagatgatgctagaatcttttccttcacacgatatggtgagatcttgcagcagaaaataacaatacagagtttatataacatcatgcacatgcaatacctagcttattattctatcctttttttaatataagatgacgtttcctttaaccatagtcttattaactttttttatataaattgcaaaaaataaaaaatgtacttaaattgcttctaacgcatgataaataaattataaccaactaaataactgataattagattttttttggtaagacgaataatcaacgtttgtaaaaatcaatcagtgtcatatacgtacataaataagagatatctatgatgatgcaattaagctgcattcgccggccagtgatgagccgatcgatctagtgagctcatcatatatatattatatttacatatgtatgcagatataaataatctttggacacctacctgctacgtaatgtggatgatcttagctgctagaagaccaagagaggcggccattgactatttgactggctaactactacaaagcatatgcatgccaaatacaaatgggactttacgtttaatttttatttcaaccttaaacaaaaaagcaagtattctttgttcatagtctttcaacatttgacttaattagccgcgtcattcaccctaaaaaaaatctactgtaaaaatattataatataattaaccatgtaaaataaatgtcgcttagctttgcgactgataattaagccgtagaaaaataaagataacatgtgagtttatctttaattaatcacctcagtcatacggtttccaatattgcttcaatagtatatataattaactaaagagaaaatagtatatcatagttgggcgtatatagctagtcttgaaaaagtccgtagacctatggaatctaagtactccctccacaaatataagcgttcgtagcatttaaaacatacccataaataacaggaagtagtactgttatcctattagttactcactccgtctcaaaatatagtaagggcctgtttggcgtagctccagctccagttccaccccttctggagctggagctcagccaaacagtttcagctctaccaaaactaggagtggagctgggtggagctaggtggagctctctcacaaaatgaactagagttgtggagctgggtttaagcagctctataactctactttagacccaactcctgtagctaaatttaggagttgtagctgtaccaaacaggccctaaacttgtaatggacccatgtccaaattcgttgtactaggatgtgtcccatccagtataatgttgctatattttgaaactgagggagtacatttcttttaaccacccacctaccctcatccatggcaatgagtggcactaaaatcgacttttcttattgactttaatctatgagataaccaatttagaaattttaatttgttgaatgaagggagtacaactaattagacttaaactgaactgccatctactgcttatggaagctctaacaaatataattaatggatatccccccacaaagaatgtcttgattgaaataagcacgcttttgtacctttacaatataattccacatatgtatcttataaaaactgctaggaagatattcacacctttatataggttctctcatttaatagaaaaaaaaacttatatatatactccctagattgctcacacgcacccacctcaagaagattccatcaaaatctataggaaacaacccggacctcctaaaattcatgtaaaacagctgcatccaagttgccatatttcataaaggttccgaacaatcattgagctgtttcttgccgcttcttcacactatacttctctgaagctaagcatgtgcactttatgtaggaccacgtctatcatgaggcgagtgctctttcatttcgagcacgttttacacacgtgcacggtgcacccaatcgaccagaagttaccttcctcaaatcctagaattttttacgtttaattagtcctttttttaaaaaaaactatttataaatagatctccagaaaacttatttcaagaatgaaacaattttttgcgcaagtgaccttgacgccgaggtttaacgtctcagcaccaattacgctggtgctgagacgttggatcttggcatctaaaatatggttctgaaataagttttatcaggaatctattgataaaataagttttcaaaggactaaaatgtaaaaaatctcataaagataatctcgtaaagttttatgtggtttcttcgaaaaaaagtaatcttgacaaaagataatctcataaagagaaattggaggggaaacaagcaatattgttttttaatacacaagagatcatccaacatcttttctttgactgtcatgttacacgttttgcttggcgatgtgtcttctttgccttcaacattccccctccccacaatgcaaaagatattttttggtgactggctaaggggagtgcctagacccacaaaaaaatgattttgtttggagctagtgctttatgttggtcaatttggcgttgccgtaatgatatagtttttaaccataaaaaaatgcctaacatcatgcaggttatcttcatgtgttccaattggctccactcttggtgtatgatgttttcacaggaacaacatgatactatgcgcaatggtgctacatgcttggaattagtagccaaggaacttttattccattttggatggtgtagtacctacagaatttcgtgatagaatctacgtgattttgaaaaaaaaaattattttagtagatcatatcatcggcagaagttggggatttgtctcatctcgccttttttaacttttctgttcacgtctgaattttttggctgtgtgcctaccggcagaggccggagatgtaacacatttccattatctaaaaaaaaatgtaaaaaatctagcctcgaatccgtcgcagcatagctcgggaatttcggaacgggccaaagtccactaaaccagcccaccaaacagcaaaagatcagggcccaatggagcccaccagatcagcccatcaaagcacagctcctgcgcccaattgagcccaccaaaatcagcccatcaaaccgcaacgccaaggcccaccaaatcagcccatcaaggtttacgtgggcttctctcccctttgcctcctctctttctctctctcgcctccggccatggcgaaccctcgcggcggcggcggaggaggagcgcgccaccacctcccactccggccgcggcggctgctccggtcgccgatctcgcgctgcgcggtcctcctcgccgcctccgccgcgctcctcctcgtcctctccctccgccaggtccaccgcgtcggcctcccaccccgcgaccacccgcccgcccaggcccgtctctccatctctccctctgttgcattgcagcgtctcctcctcgccctaggcggccgcaagtgcaaccacggaagttgccttcgcgagtgtggttgaaattttacctcatttctttggatctttggacttgggaggtgtccatgaaactgatgatagtagtagtggtagaccatgatgaagttatctttagtagtgttattagttataaactttctaggaaaattacctcaagatcattgggagttttgagccggcgaaactcgagcatcgcgcatggccgtaaacttagatgcgtgtgtttttttgctttacttttagttagttggcattgcgatagtcctatgggcaccattgtgatgctcagtaatttttgactcgagctgtgtaactgatctgcaggaaccaaatgagcagctgtggggttctgatggttacggttctcatgcttgtgtcacaccaacatctagatatatgggtaaattcctttcttatgaagcaatttttcatcgtatatgcgatgactccgttttagtttactgagctggatatatatggctctttgcaacttgaaagtactagctgttgttaatttgaagtcagaatttggtggaaagtttctcgttgtctgttctgatattgacttcactaatatgcttgtagtaataatctataacttggtttaactacctttgatctccctgtaagatagtaaatggaatgttcgttcagtacgttacttttggttttaaaaaaacacgtgttttactgcaatagggttggcacaacaatggttaagttatagattattattttattgccgggccgacgatgagaagccggccaagatttattaaggctgaagaaaagtttggttacagtgaacagcagcacagtcgctgaaaagataatctcagtaccaaggtgctaagatactataaagcacagtcaaaagccgaaaagacacgaaccagagcatttctggtcaaaaccagcacgaatatcgaatataacaatggggaggtatggctatggctatgtgattggcgtgccaagcccgacaatcctccaagtctaccatttgtccgtaatggcgtcagcgttaagttatagattattcttgctgtctttctttagggtgtctctattggcctatccatgtttattatctacatactctagtatagtgctcaagcgaattcagtgaacatacatgcatatgtaataatcccttccttgatatggttccactgtatacagtcctaacaccatcatttgtattgtcagctccaaaagggtcagagcgctacatgacagttaggagtaatggaggactcaaccaaatgcgtactggagtaagtttgtgacacaaaagcttaggccttaggcttatatctgtcttacttttatacagttttgcatcaataattttgtagctgcccaataccttcatttgtctatgttattttattcattctaaaaataaaaattcggcattgcttttgcaaggttcatcctgcagaaaatttcttatgttatatttgcaattattgtcatttattcatcttttctttgtgatcatcctcaataaatttactgtaacatggttaatttgaggattgttcttccctctgcagatctgtgatatggttgcagtggcccgtttggtgaatgcaacacttgttattcctcaattagataagcgatccttttggcaagataccaggtgcctaccattagaatgtgcttggtgccttggttagttgtcatatactgttccctccatgtttagtgtgttaacaatttactctgctttttacagtacatttaaggacatcttcaatgagcctcgttttattaaagctctggaaggggatgtcagcattgtgaatgacttgcctcaaagcctgcagtctgttccaagagctcggaagcactttacttcatggtctggtgctagttattatgaggaggtgaaacaactttggaaggatcacaaggtatttcttcagttaagcagctctccttcacaatgaaccgcctcagcactgcagagttttagatgcccataaaaatgatttcttttgtttttaaataaaatagcgacctttctgtgcagagtatctttgtgctattagctcttaaattttgtacttcttgatattgaaatggtttaatgtagttattccgaaataggatcaagaatgctagagctgtagttatgatttacatgatatatatgaagcataatcatgaatttgcgtgaaaaaaatattactcatataatttatcatgatggtcgtttatttctctgtgctaccagcattattgcattgagcacctgctggcataaaataacatcagagattctcaactagatacaaaatttgttgaataactctgattttccaactgaaaagatgaccggagagaaaatatctgttttttttttaaatggcacttttgccttctttgaaacctgaaagccatttatgcgagctcacaccaaccatatttgttacaggtagttcacatcccgaaatcagattcacgacttgctaacaatggtcttccgattgatatccagagattaagatgccgctgtctttaccaagcactgcgtttttcagatccaattgagaaccttggaaaggcatgggcattctcttaataaccttatcctttctctaactcaggatctgtattacagttttcaatttgcatttggaaatttatggcaatctgtaaactaggttctgagccaacataacacttacaacagaagcttttggagcgtctaagatcacgtggaaaatttattgctcttcatctccgatatgaaaaagatatgctagcattcacgggatgcacttatggtctgagtgaatcggaagcagatgagttaagaattatgaggtaccaataatcaatgaaaatcagttcctttattttttccctatggttgtatgaatttgctttctccatctgaacagggagaaaacaagccactggaaattgaaggacataaactcaactgaacagagatctggaggtaactgtccactaacgcctgaggaggtggggatttttctgcgagccatgggatatcctgaatccacatggatctaccttgcagctggtgaaatttatggcggtgataagtatatatcaaaattgagatcatacttcccgaacttggttagcaaggtcagctgtgctacctttttttaatcacttctgcgaaccattgtatactatatttctgaaccaaagatttttttttgcaggaagtgttagcaacaaaagaagagcttggtaaatttaacgaccatgcttctcaagttgcagcccttgattacatagtttcagttgaaagtgacgtgtttattccatcacattctggcaatatggcaagagctgttgagggacatcgtcgatttctaggtcatcgtaagactgtcactcctgacaggtaaatattggaatattcacaaaaacgttattttttttcctgtatcatgcatctaccaatcttggcctggaggctagttgcttgcttagtttattttttttctctcacatctggattaaaatctttgtcacatttaatcttcaggagaggattggtggaactctttgatttactacaaaaaggggaacttatggaaggtccaaagttttcctcacttgttactgagatgcataaaaacaggtgatttgatttatgccacatgtactcttctgtttcacgctttaaggattggactgagattgtatttctctgttttcaggcaaggagctccaaggaagagatatggctccttgccagggagcaagggcagagcacgtctaaggaccgaggaatccttttatgaaaacccatttcccgagtgcatctgcctgaatggaaagcactgatgtgatgatgtaggtttgccacttttattttgctgtatgatattattttttagttaggaggtagaatactgttgattaaacaagtatgaagtaattcctgtaaatcaatcattgctgcatacactacatttatctcattaattctactggcaagctactaaaaggaacatgtgattataaagaaatggccagggtgcaaacgcattatcaataaaattgtgcgtcacaatcacatttgcttagttctcaagcaacttttggaaaatgtctgcttaggagtttggactacgttcttcttgagtgaacctatttgttccagctctcctttgaacgttgattaccctattttcttgaaattcttttatcaaagaagaaagctggtccttttccaattaaacgattgctaaatggtttgtcgcatgttttccatgaggtttttgcatgcatgctgtactggtttcttctcttgtagttattacccatgccatttctagccagtgtcgtacaaaccttagcatcctataacctattgaatgaaatggtgtatgttcttaatttcagctctgcatggcgacctaagtccatttgctctctgtattggtgtttctgtcgacgaatggagctccagtgacgcatcagaattacactggtactcgactcagtcatgcaagtcaggcaagggtatcattctttcagtgatctacatccaagaatcctgtagcctgcaggtccagaattcaagatgggaaaattggcaggtagagggaagaaattgtacattcatcggtttgtcacatagtcacagagacagaaattgcaaaggatgtgtgatatgtgtgtctgaatttttaggttccttagatctagaaaattttgtatctagtattaggcatttaggcctcaaaaagggaagtttacgtacaatgttcaaaagcttcagctttaacaactcatattcaaaagttatgttttcttactcattgcccctctgcagtctgtataatagcacctcattttctctaatggtatgcacataaacagatacatcgtgagcaatttatttaaaccctagacaacacgaaatgattcagctatttgcttcaggtcattgtaattcctcttccattgtagccctgcaacgatccatatcttttattcagcattcggagttctaaagaaaatgtcatacagttttgagataggaacagtagttttaccatttgcagttacattgaacaggtagagcctgtttccagcggcagttgcagtgatgaagatatgaggtggttccagctcaaactggtagtaagttcttcctgaatactctgctgttgccatggacaaaaccttcccttcaacattttcaccgatcacctctggtccgaaggcgtcgatcaccttctccggtgtaccgatcttttcaattgtcgcatcgtcgagttcttcgcacagttcatcatgtcagttagtagtgctaagattgttaccatcctaggaagatcttacagaaactgcattctcttcagaagaatgtgcttctcacctgcaaacctgcgaaccggtgctacaacgacgaacaaacgtccctgcttggaattcgcaaaccgcaggtcgatctcggtgccaccaagatcagcaatcgacaccgggacctacattgaaaaattggaacagcatcaattttgcatcggaaagattgtgacagtgttctataaatctgaatttgtgacagtagcttcagtttttcacctcttcccagccatcacgaactttgaagctgtagggaatgattgggctccatccaactccatgtccaccggacttgtcgtctggcctacggtatgttctccaacctgtctgaacaaactatatcatgaaaacaatccagcagttcctttttttcagatagcatgcctgaaagatgatccttatatgacaaaaaatggaagctactgcaaattttgtacaaagatattgaccatatatcacttgcatgttgcctatgtctcatattaaacatgatgctataattctttgacagcaaaaacatgtagtagtatttacttgtggaaacatgcatgatatcgaagtttatggctatgattcagcagttacagtattagcatctatagcacttggtttcacagtggagattactgggaggtcattaaagtatttttaatcatgggcaataggtagaccattttcaaccatgttcatttatcctgaactgaagggttctgaatatccttatgagcacaaaacaagcaacaaaactattgtctcaagaaaggcatgaagaacattagacaatctgtctctctgtctaaactgtctaaatggaaccttcaaataaacaaaaacattgtaaagcacatgaattaagggtcaaaatggtagaaagaaccaacctttttcatcagggtcagagagcccagggatccgcccagccagaaggccctgcttcactgccatgctctcacctgcaaaaccaaacactgaaactccacaggcagcagcagcagaagccattgcatgcctcctccccatcaaggaggctacaccatcctcctcctcatgtgcttctgacagattgggcccactgctgcacctaacagcagctgctgctgatgctctgcccttggttgcaggtaccagctgctttgtgaggaacagggatgagcttggcaagaacagcactgagctgttcatcatctctgcaagaagcatggatagtttattgggagcaagttcttctttctctgtgatgctctagctctggctctatgatgtttcttgaataatttttttgcttcttgtttttcattgagagaattatcttttctttggttcaatactccttaggctgttctggaccacaagccatgagtggacaggatgatttgggagttcagcgttcagacaaaaaacttctgtcctagattggttgagtgtggctgcttcacttttttgctttcatgtatgcttgttttgcacatataagttgaggtgttcagctacacccaggtttggttagaacttacagattaaatcaaatatcagctgaatatagaatatccttattttttcaggtaattcctcaccactattgcatgtgtgttcagttgtaaaattcagattctctttattttctctctctggtttgatactatgttaaaagacatcaaccacatggcaagaaaaatcattcttgtggcccatgattgatatccattagcttccagagcatccatgtcaggcagccttgtgaacaaggatgattgatcatttctcccaagctctgttgctggctcaaagttttcaaaggtaaaaaggcccaaggtacaagggcccaaaaactctagtttgatttttttttgcttctaccagtccaatataaatagtaattacttgaagaagtaattaaatattactacaagaatgatcttctggtagaggaaaagaaacagaaattgtgctgtgcagtgtgcacacacactacacaggagagacaagaccaatacagcgatcaaactgaattattttgtggtcggcggtgaagaggagactgaccaaagaagcttgcaacgactgactgacgtatatactgacatatttagtattcaccattgtgtcaatgtaaataagatttacaaagacttttggcatatcatcaaatgttgaattgctatatcgtttcgtcattccgcgtgttcgagaattaatagtcatgcattgttattctgtattgaacgtactactaatctcgatctccaaccccaggtgatcttttgaattttgaagtgcatatatatgaatactagctagctagtggatttcatttctgtggatacactatccgaaaccttcacgaattaaatttgactttattcttaaatattattcactcttaattataactttctagctcatcctgcgttaatttgtgatgttgaccatcacactccacgtgtagtctactgcgtcatgcagctaaattaattgattctgaggtgtacctaacaattaacgtaatccacgttgcatttctcgctaattaatattctgtcacgtctacgcgtatatatgtacgtattacgtatatatatacagtacttcactatcacagtatgtacgtaccatagctagcttagctacatacggtcagtccgtccagtcgtctacgactgtcacgtacgaccagaaaagtcattcttccctctgaaaaattaggaatggtttagtttgattttccatcatggatttgttggaatatactagtcttttctctgttttttttctcccctccggccgacaagaatagtcttaatttctgacttcaatatatatctatagtcatatatatgatcgatcttattgtgcgttatacggtgtataagtactatgaacctatatgcatataaactagcacatgtgggtgtatatatatattcaaagtgtgtacttgtcctattaatttctgatattttaaatgtgtgataggatccatccatgtacatccatgtacataagtgtgtgtggcaatgcatgcataggtataagtatgacgtgtatacatttatgtccaggacttgtccacgtacgcaagggtatgtccaagacccatccacatacataagtgcgtgcggcgatgtgagtagagatgagagcagtcgaaaacaatactagtttttattttacggcaatgttattacggttaggaatttttcatatttataaatttaactatttagtagcaacttcaatacaacgcaaatagaaactagaaaagctaaatttcataacaataggaagtgatattattttttacggaaacggtattggtgcagtcggtaaatttccgtaccattttcatccctaggtgttggcataaataccatgtgtatatgtttgtgttcagaatccatccacgtataagtacgtactccctccgtcccaaaaaaagtcaaaccctgagtttccgtgtccaactttgacggtccgtcttatatggattttttttataattcgtattttcaatgttgttagatgataaaacatgattaatattttatgcgtgacttgtctttttaatttttttcataatttttttaaataaaacggacggtcaaacgttgggcacgaaaaccagggtttatctttttttttttggacggagagagtatagtggtgtgtgggtgtaaatgcatgtgtcggtacgtttgtatacatgatccatccactacgcaagtgtgtgtggcagtgtgagcataagtacagtgtgggtacgtttaggcatatatgcgtgtgtacgtttgtatctaggatccatccgcatatgtaagtgtgtgtggcagtgagctcgcgttggctctgtttgagctcaccacgaccgcgcccctgaatatgccacgccgcttcgatgtgaggtcgcgtcgcaccaccaattattagtctcgccacgacaactacatgggtataggaacgatgatatgtgtatgtctgtgtctacgatccatcacgtgtggtggtgtggccataagtatggtctgtgcacgtttgtgtccaggattcattcacgtacgtaaatgtgtgtggctagtggtcaacttagagaaaaattaccagggatccaatacataataattatctaattattagctagtatattagtttaaatggcacattttagttagtattggataaattacctggtcttgtaaccccggtaattgaatgcatgtgggagcgccactgcatgtggcgttgtgagtataattacgaggtgtgtatgtttgtgtctaggatctactctatgtatgtaaatgcatatcgtagtgcatagataaatacattatgtgtacttttgtgtctaggatctttccacgtatgcaagtgcatgtgacagtgtgagcataagttccgtgtggtggtgttggcataacagtgtgtatatatgtgtgtccgttctttagggaaaaaacttatatacatactgatagggatgaaaacagtcagaaacgatcggataacagcctcaaccattttcataatcatatttttctcggaaatgaaatcgaatatggtaaagtcggaaacgaaaacgatatcggaaatatcgaaaagccggaaatggaataatacggacggaaaaatgtcggtatagatcggaaaccggtaaaaaatacggaaacattaaactatagaaaacatttatttaactttacataagtatgttatatgtacaaataaattcaagctatactacataaattataaattaactctattttagccatacactcaagttagggatttgattgaagagtcaatcaatctctaaactgtgggtcaagtagagacatgccctataaatatcgagatatttagaaatacggtaattattatattataagaaacggtaatttccacaagaatacggtaaatacggaaatgattagtaaaatagcaaaaccatttccgtttccatttccatttttttttctgtcgattaccatttccatatggctcggctggtagaaagtcagaaacgaacaccggtcggctgggaattaccgttaccgttttcacccatacagactgataattcattagttggagtatatcattgcctatctttccaattttccgagcataagttataaacaagtgaactggatttctacatgacaagaatggcatgcatatacatacattagcacaaattctatccaaagttgatcaaaaggaatatgtatacacacacgatcaaatcgacaaactataatacttattccatgtttattttttttgctaaatctcaaaagagaacatggagcgcctattttcatttaagaagaagagacttcacccaatttttaagaaaaaaccgagcccaaaatatatcacaaatgcacgagtaattgcagaaaccgaccaaaatcccacatggagaacaaactagacacttgcagtggcacaactgaagctagaaatacaattcatcattgcagagctcaaaagagcaattccgacttcatatcatcaagccacgtactagacaaccaattatatcaaccaagaaaccgtagtgcagggtcttctaaacgaagcctacaaggaggaagatagtgtccaagacgtgaacaatgttcgtctgagcatcgtaacaagattttcacccaaagaaaagatgagagcaaagcaacgacgtctttcaagatggaaacgatgcccataggcattgacatgttggctatagtcaaagaccaaacaagacttcttcctaggctctcattgcgtgtcaactatgaaatctaaggccgctgcagtgctgccaagatgaaagcagataagggatatcattgctaagcttgccatcattgtagagcaactctgattccatccgaacacaccaacacatagccacgttgggaatccaactgcacaattactcctttgatgctaccaggatgaaagagcatgagggttatcattgctgagtttgccacacctgactaagtagctcagtctccactctgacacaataactgatggttgcaccatgagggcctcatgcactacctctccaccaaaccaaacacctcgctaccgcaagaactttcaaaacacaaaaagtgttgatggccacatgatcactaccaaatagaacccttctaactgaaccggagcctcaccgcttgccatggaactccccacgaccagagtctggaagcaaactggtcaaaagaaggggagaagctccatggaatggaagaagacctagccggccagggaatgtttggacatggtgtaatgaccccttgcggtcgactaggccaccatccacactgttgttcactatgtcccgtggctttccaaccaaacaaactacattggcggctgtccatccatctcaactgcgccctggtggcaatctgcttatttgactacctcgttcattatctaaaaagaaaaaaaatctggctacctcgcaaaccacctccgacaaaagtgccaggcacctggacaccttgttggcctcctgcacatagtttttggacacttgcgcctccatctccgattggctttcacctccacctccaccagtcacctacacctccaactctgactcgctgaccatctccaccttcacctccattggccacttgcacctcgaccaagctgctcccaacttgttggatccaggacagggtgtagctagtttggtcttggagaggccggtttggccgtcattaacgtccttgcgcctttgccttgccattgccgttttcttcctcgctgcctccaccccgttccactttcgatgtgcctcgctgttgggtccctgttgtcagggctggccctggggctatgcagctgaggcgatcgccgggggcccatgatggtgggggggccaacacctaatactagtagtctagtacttgcctatggcctacctggaagcagaaacgcccgagagatgggaggagttgtagcgttggcaactcggcagatgacatcgtatcgcatagggcacaaccgcacaggcgcacatcgtcgtcgactcgttcttgatgattttgcatcaagaaatgcccgaagaagttcattagaaacaatggatatgatgggattctattcttcgttaaggtaatgaatattagttcttaggtacaaatatattgttattttggtcgactttatttttctcgataattaccagacatgttaaatttaatatatggatgtatttgttttcgttttgcaagtaaaattagcgtcaattgtatcataaaattttatatatagcttaaagggcccatcacgatgagttcgtctcgggctctcaaaatcagaggatcgccctgcctgtggtcgccaccatgcatcatcctcttctcccccgctgagatccgggcccgccaccatacggccgtctacaccgtgcttatgtgtacatgcttgtcttcatctaatctctcgtacttttttttgtcattattttccagttgcttaatttcttgtaaactaggttttccatagttagctagcctgcctgaatttcgtcaactgcatactggaatgatacatagtaattgtccactcttaactataactagatttctagcacatcctgtgtttgtgaagttgaaccatatgcatgcaccgatgaggtataatgcattctgagtacaccacgtgtaatctcgtgtgtcacatgcggcatgcatgctaattaaattaattaattctgagtgtatataacaattaacgcaatccacgttgcatttctcgcgagtaatattctgccacgtccacgcgtatatatgtatatcagtggagtacttcactgtcacagtatgtagctaggtcgtctacgagcagtacgtcgatcgactagcaagtcatacaaattctttcctctgcaaaattaggaatgatggttggtcagcttgttgtttgaaatagtcttttctttattaatttctgactaaattaatttagttctccataatctaactatacagtctataacgtgcataggcgctcataagaatatatgaacagcctataaacacatgttagttactccctctatttcatattttaagtcgtttgattttttttaatttttttaagtttaaccaaatttgtagaaaaatatactaatattttcaatacaaaacaaacatattattgaaatatattcaatgctaaatttaattaaactaattagtattataaatactgctaattttttctattaatttggtctaaagaattttaattaagaaaaaaagtcaaacgacttataatataaaacggatggagtactttgatagtagatcaaatagtattactacctccatttaaaaaaagtacgatgtcctaaaataaaatacatgctatcaatgcaaacctcgaaatcttacatcatttagaaaaaaaatcacgacttaaaaaatgtcaaagaatatttttttatgaaaaaacctttttataattatatatttaatatttttatagattaatacttttataaaaataataataatataacatgtatattgaatactgtcgatttctaaaacatcaacagtaaaaaagaaaagaggtatgcacaagtacacgcgcgcgggtgcatttagtaatagtcaaattgtgtactgccggcacgattttaagtcttttaaatgtgcaataggtataatatgttcttttcttgaaaaagaacatatgcacataccgagaattctcagtttggtaagttttcttcacacgacgcttgcatatgattgtatcattgcttgtcttttcaattttcaggtcataagttataactgcgtgaacggcatgtattttttacatgacaagaatcgcatggatgcatgcatatacaatcaggacgaattctattagatcaaagtctgcaaaaaggaatatatatacaatcaaattgacaaatcatacgcttacaccatgcttatatgtgtttgtcttcatctaatatctcatacgtttggtcattattttccagttgcttaatttcttggaaactaattaagttttccatagttaggctagcctgcctgaatctcgtcagctgcatgctagaatgatcttgatttttacaaaacatgtacaaatcaagacggtgtgccttgcaagtaagaaggatcacacatggcatgattattatacccatgtgtaccactatgctgaaaatatatttattataaaccagttaatcatttgactagcttgcaattattttggaattcaaatcgaagtacacgtcacatcatatctgtacatatatatatgtgccttgaaaaatattgttgcaaaaatcttaccttgtcttaattcctttcagacttactggccatcaaacaaatatatcagagatcgatgtcgcgatctttaatttcatacctgtgacaactattcttggttcagattgtgaaatacaacaagacagtgaaatctgcaagtacaggaataaaaaaaattaaagggacaccgtaccaatgttgattgcagaattgcaatcacatcgagatgacatactaattactcctattaccacatgccatatatctctcgagcatttagttgaaagtgttctcctcctgtaactacattaatccagctagctggttaccttcatatgttgaaaactactttgccaaaggtatgtgcagtgtgcatatatattacatccgtgacacttattttcctgttaaaaatttctagctagtcttttagtaattatttttcttcctacaaattttttttctgaagcatttaatttgcaccttgctctcggctaaatcatagcaatctgcaagcatttcatgagaactgaatttttttatttgattttttttcttgatctgataagaattgatcagccttaaatttatttgattgatcaaaaatgtttttatttgatttttatttcatgagcaactcctgaaatcatatttctgaaacttactttttagtttgcttgaacttttctctagtcaaaggtacgcgcgcagtatctgataagaatatagttagttcatcgttctgattatactttccatgaaactctccagagaattccggactattctgaaaaatcaagtacgcatgatgtgatactgatctatattgtggaataataattttaaaaagggatctcttgataattgagaaaaaaaagagctccatcacactggcacatggaataaaaatcaggtgtcgtaatcatgtcacgcctgtattttgacttgctgcaaccgtccctggttcggattcagaatcgagacagtgaaatcagctgtagttgaggcgattagtcaagtcactctatatgattgctataaatttagttatcatgcacaacattctgtttgtctcttgaattgttcgaccttttttttgtggacgcgactctccgtcgggtgcccgatgagaagttaaaatcgggcgctcttaaattatttattcaaatcatgatccgattgtaccattaaattcgttacaattaaaccttcaaaacaagaccacatatggatatattccgacgaaaaatttttttagcttattattgaattatttttaaatgttgcatgatgttccatcagatatatcggaattgtttcactaagtagatcgaaaatgtttcactcgtttaaatcgagtgttgtttcaccttatataaaaaaaatgtttaagcaaatagctctgcgcaataagtagatcgagaggtcgttccgccccttgtccccgaagatgggtaatatgttctcatacaatgttgctccaactttttcctagagggcctagctggtgagcgatcccagtccgcggcagagaacagccagaagcaactagtcgcctcctttcctccgccgaaagatgcttagccagaagcgacgaaggaggggagctggggaaggctgacgatggcaatgaggggggaagctgtcgtagaagctttgccgattggtttgaggaacgtcttgagattcaggcaattgcagatgatataactagtaaatatgttcctcctcatgtcaacatattttattgtttagggggaattataattacttgttttctagtacaagttgctaccggttttgctatgacttttgactatcgcaacggaaagaaaatccgctgcaccttctccacatctcattggtttctattctgcaacatgagatcagcaactaactgaactggatcatcagtcattctccctaacggcttcattgttcagatgtttcagttcactgcaacattagatctatacatagtgaaacattgtgagtacactatgtgaacatgtttggtgaacaaaaaataaccaattngtcttaatagagagtttccaaaatatgtgggtttttttgttgcaatagagttatctgtggataagcggcaggtggatagggacacgtgggggggcctaatggggagacacgtgcgctggggagcgaccgatccaggcggctggcggcggtcgaccgagcgtgggcattctccttttttttgttctgtaattgcaaccgtaagaactacaaaaagacatataagtcttcaactcttctgatttttctccaaaaaaaggagaccccacatgcgcacaactgtttctgatatggagttcaaagaacaattgatattacttcgatatggagatcattttcgtgggaggtagtattgttaaaaccaatttctaaatcaaaatacaattgatattacttggtaccatttttttggcacatttattttttaaaggtttacatcacatcctctaactgtgtagtcggctatcactattcacatatattatcatacaatgaatgtaattttctgtcaagctgtagcctaatcatgatatctaaaattcactatatatgaaaaaggaccatgtcaggatctacgccttttgggatgctgacaatctgctggttgatatttggcaaggaccgtgcaattttccttgcattctccaaataggtttcaaatctcatatggttgggctcaggcttcttgtccaaattctttgcaattcttgacttaatattttctgcatattgcacactagtggcaagggagagttcctccctcaaaacatggtatttgattgcctgctcacggaaagtccagttaccggtgatccagtcaaatttgtatagcgggagaaagcggtgaccatatgccgctatgaactcaatggcggaaaggatgaatttaaactcctcctttgagagatagtaagcaaagctcagcctagtccatccaggcttcagtccactgtacccctgaaataatttgaccgtagacagtagcactagttagtaccttgatatatactaataggtttaaatttactgtaggcaatctaatcatacctcaagaatagcagaacggatgcgaacagagagttcgttattaacatcaagcaaaatgtgtccataagggcctgcacaagcacaccctccccttgcttggatgccaaaaagatcgttaagaagctttgtaacaaatctcccatggaggggtagtctcttgtttgtcttgttttccaatgaattatagcaaccgggctcaacccgaagaaaaagtgaatcttccactggagggtagatgaggaacgagaagattggaagacgatcaactgttgtgttgcctaggacctttatattcagattatcaaggagccttttcattgccatttcagagtacactcgctcatgtagttccattgtttcatatccaatgtactccttgacccaaaatgctagggatgcacggatcttttgcactatcggtggtgtgccagcatcctcccgctcctcgatatcgtcatagtagagggtatcctacacatcacgtgtacctttgttcattagtatttatgaaatggccatgcttaatttggcacacaaatacttgtaatttctttgtctatatgctaacctcttcgttgaagccattgacataggcaactgttccacccccgcacattgagggaggctgagaattgagtcggtacaacgatttgttcatcaaaaggatgcctggtgtccctgggccaccaacaaatttgtgcggactcaagaagactgcatcataaccatcaacttcgccagacttcatgtctatcttcacataagggccactgcaaacatgggtaattgttaaatttaggtattcttttataaatgtacaagtgaagaaatataattaatgctagctaccaggcttaataatcctgaccatagctagtgaatttcaagtatgaggttgaacaattctgatcacggttatataattcaaaatgaagtgaccagtaagtttaagttgaaagtctccgtcaagaaaaaagagagttgaaactgtagacaaatgaagtacaagattgtagaaatttggaagaaataaaacattcagattaattgtttgtgccctgtcaaagtcaaaaataatttcattgtcgcaatgaactacttcactagacttttttggccgattaatttcctcaatcctccccaaacattagaatatatgcctcaagtagttcatcttggttcaacaagcaaacaaagatccacagagtctcagtactttagttcataccttttgcatatatagacaatatattcacataagtcaatcatcatgagatcatatgcttgaatgtttggatgagatagatatattgctgtcatatttaatgcaaagtatagaaaaaaactactagctagctgtttggtactgtcaggcaaattgaatgaagacattctgttgttcattaattaga

SEQ ID NO: 75415 - DNA, 24855 bp, Oryza sativa
tagattctgcaatgtgctacatgaggatgatgtaagatgaaccaaaaacctttatcttgctttagatttgctgttattttgtaccttgcactttgtttttgtcatactcaggtcgcggtttcagttgtgacatgaactgcatttttttttcagatcatgagtgtagtaagaaaattaagcccggtttcacaacatgttaagtacttcttgcagatacatgttcactttttttctcaaacaaaataattgtgcattactcgaataaaaatgaggatacaagacattgcaatgatgcaagaggatcatgctcacaaaacaaacttcatgagtttgaacctcaagacagcagtgcatgtactactgctattacatagaagacatgtattctgttgcctcagagaggcctaactaagaatcttaaacaacgacactttaattttgccccaaagaggcctgattaagtagtttaaaaaaactaattcagttccttggtgccctgcaatagcattagcatatcccccaccggaagaaaactctggcagcatatcatagaaccaccaagtgcttgaggaaggctgtaaccatcagcaacttgacctataaatttccatcgatagtgtccaattcagcaagccagtcgatgtcagccaaaaactggtcatcaataggaggagaacacaatggttcagcagtagcaatgccatcatcgctgacatcagccaacaactccaaaaggaaactgtcgctgaaggttggggtatggactgcattgtcattttgaggttgctctacgggagtgcatgcttgcacttcagcgggtggctgatccccaaaacgcatttgccattgcgtcagcaggggaacccgccgatgattgattagtaagtggctgttgccccaatggagcatgcattggaggaggtgccactgtgttctgcggcggtgatactgggggtaattgttgggatggcactaactctggagaaggaaacagtggtggccgtagcggaaatatctgagaccatggggagcccggcactggaggcggaggtatcatcggaactcctgatgtccctccaggaagtaatggagtgaatggacggtgtgaggccaagaagcgagaacacgaggctcggggaaaaaaattttggggttttgggggccccccccaccaaaaacgggggcccaaaccttttttggaaattcccccaaccccaaatttttgggcaggctttgctgcccacgacgtaggggaggcagccgcttcttgaattcttgctggagcggcaagagtacatctaaaagttcacgcatatcatcgtggctgagatcctctagcctggagaatagatgcttggccatacccatacctaagctctcttcttgggcctccttgaagcgctggattgattcttcagtcttcttgtccttctcttcttcttcattctctagctggaccagctcactttgcattgacgtaagcttggccttcagttgttcatcggcaaatggctctgcctcagatacaaaagcatcgacaacaggtttcaccgatggtgccccaaagaattgtgcctgttgtaaataatgcaataatataaccaaatatttcaaacgaattccatttaacattacaataataataatacaattcaaggtacagcatgatgacatattcataagcatagtgggacaacagtaccttattgctgtcatgtaggcaaattgcgacgcttgcatcagtgagaagggagaggtcatttgcaagcttgaacagcccatcacgcctcttgctgagggtgaggctgcgatctctatcctcttcgatgtacctcacgcctttccttctacccctcctcaccatacttgactagtaaatagagagagaatactgtatagtatacggtgtagcttgctggctacatatatatagcgagaagggcatcctcaaatagaaatcaaattaatacgataccaacaatatctaattatagttttatggtgagagacatttttggatgttgaatggcctaaaaacgaaagcgattaactacataccatgtagctaggttgatttatatggtatgaaatgcatcctccaatggataatgggaactaccgcgtgtaagttgcaaatagttcctacaaatctacagcgagaaagccattttccaatggaggatgggaactactaatcgattatagcttgttggagacctattttgagaaaaccatactccagtggagaatggaaattgctatgtttgcaaatagcttagtggagatgtatgaggggaagacattcgcaagggagaacgagaattgcaattttattgctgcaaatagcttgctaaaatctatgagaaaaccatactccaatgagattggatactactatgtgaatgctatagaaaacttcctatagatcacatttaccaggaaatgtgctccaatgattgaaaaagaagtttcaatccttggaaattgatgcctaaattctgtctcataaatgtcctggaatggagaatgaaatccactaagctataactgcaaatagctttgcagagatctccgtttagcaggtatcctcaacaattggataatagatggactactattagtattaagtgattactgcaaatagttttatagagatctacgtttagcaacaaaggtatcctcagtcggataatagatactattaaatgattactactgcaaatagttttatagagatctgtgtcgagcaaaaatgtgctcctttgatcgatagaagtgataggcaccttatatagaaggaagtaagggttgtacatatcaagatgcttacgttttatttgtttggtggataaacactctcataaaagctccacacaatatcactgacaggtggtacatccttcacattggcatggtgagctccattgtaagtaccagttacgaagtctttttgcacacaacactttgtctttagcatggtaacataattccaattcatcgaagtgtccacaaatgcgtaattctaccaatacatgctgatgagagtacaacttttggacattcaaatatttgcagataatccacacatgccaaaggaaagaaaaagaaaagcaacagggaaaaatagggataagttatttgattcataggttgaagagtagcttttatgtattattctaaataaatggattgagattaagtgtctggcattaattaattgaatgtctattggcagtgagtagaataaaacttgtattagatgcaaaaaattccttggggtctctgcctagatcatcccttgatgtatcagcgtgtataaatcgtttgatcattgaataataaattatatggtgtatgtttaagcaacagtgacagaaggtagaagacagattgttgttggaaagataagatttctgccttgatttccttctctggtattcctaaagaaaaaagaacatacttgctcagatccagactaatatagtagaaaatgccaccttgttgcaggaccctattgtgcaaacctaataatgctaggttagtgatccttgatttgaattatgatatatgtttgcttctaattggctgtggaagttggagaattctgatccagactagtatagtaaaaaaatgccaccttgttgctggaccctattgtgcaaacctaataatgctaggttagtgttcgttgatttgaatcttatgatatacgtctgctttctaattggctgtggaagttggagaattctgaaggacctcgacaagagatgataagtatgcaggcaaggtccactccattgatcactgcaaatataaagcttctgattctcgttttatcttgtttggtggctgttaaggatgtgtttttgttcttttgtaaaaaggtaactaaccggtaatgatctgcataggcatttcttggaagcagacaatttccttaacacttaagttaattttgacgggttaactttgggttttttggtgatctgaaaaagcaacagtgctgcttgttttcggaaagcgttgctcactggtctcactgagattgtgttcaaatgtgctattgtattgagttttggcttcccttgcagaaagaagaacgtcgtgtggaacttcaagtgggattacggtgagcgagcgggaagccactcctgggaggcagtctgtgcatttaactggaatggtttttccttttggagttgctgaatgctgattgttgacttctagaaaggtaccaaattggcaaatttggctctccatctctccacagaattccctctccatattccagtgcactccaacagtctctccatatcccaacggctagttcgctctccatattctaacacactccaacagactctccatattccactctccatatcccaacggctagttcgctctccatattccaacacactccaacagactccatattacaacagctagttcccaacagctattttgcaacactatatataggctccttctctacctctctaccaggctaccacaacattcttcttccttgtttgcttcttcacctccacaccacaaatgaatcactttggcttgagcttatccatgcaaattgtgttggagtcgtcgtcttcagatgacgacgatgaattcatggctgcaacaatactcctagtacacgcacactgccaaaccaggagacgacgacgacgacagtgatctgaaggcagaactaggcggaggcgacagagggaggagctggcgctgggtggagccggctatgcgtgggacgaggcggctgagctcaatgaagctcaggaggacacgccaccaagggaagaggcggccctggtaggggtgaggcggcagcagacggaggagccagagctggggggagccggcaatgcgcgggacgaggcagccaagctcaatggagctcaagaaacgcgcctccgaggcggcatgggacctcgagcctcagctcggtgctctgctagaagatggagatgatcatcaggatggagagtcacaggggctgccagatttagccacctgattctctcatttacatttagccagacagatggaatagcaatgcaaaaaaccaatctgttggagcacctgtttttgcatgtttgcttcttcttcttttgttcttttggcatggagaatgagatagcaagtcccttggagatgttcttagtctggctgttgatgcttgtggttagtataggttgtagtgctctgcatatgttctttgtggagaattctggaggatgttgagtagcatagcaatgtctgtccaattgcatcagccatgcactctgttttctactcattgttcaactcctgtcaatgaaatgggtccttgtcgtctgattatgaaagaaacaattggggtccctgcgtatgctctgattccttgctactctggctacatccatccagttctgaagttccattgacatttgacaaataacgagccatctgatcgagtaaactggtcatcaactgcttattttgagaggtcaattcagattttttttttgtttgtagcattgatgtataagtggttcatctcatatcaagatggtttgaataataattactgtcgtaatgaattcgtccgtggtgtcagttctgtacaacaagcatttggcatacaatatttatgtatatatgcttagaaaattttctgttcatattcaaattgatggcatatatagggcctgtttagttggcaaaaaaatttgcccctacatgtcacatcggatatacggacacacatttaaagtattaaacgtagtctaataacaaaacaaattacagattctgccagaaaacttcgagacgaatttatcaagcctaattaatccgtcatcaacaaatgtttattgtagcaccacattatcaaatcctggcgcaattaagcttaaaagattcatctcgcaatttcctgtcgaactatgtaattggtttttttttctacatttaacactatgcatgtgtccaaacattcgatgtgacagcgtgaaaaattttgtttgaaaactaaacaggcccatatttacatgtcgactggtactggtacgacgccaaaaacttgtgtgttttttctccaagtggtcagcaacattgccctgcaagccattttactgggtcaagcaagacaaatgatagaacggtaaatgaacatgaaagaagccagaattactttactttcaaaggaacaaatgaacatcatatacatgtactattgacttggtataatcttcaaaagctcaatgtcaaacaggagagttttatctatcaacccttgattcctcagaacaaaatccagagccctttgtccctgaaaacaatgttatgttggttatttaagaaaattgatcgacataatttgtgcatccatgccaaaaaaaaaaaagaagagaaattaccgagaatgtcgttggttttggacccaacttgttgtagtcattgtctgggtatccaagatctggtggtactattatcctgaaatgcataaatttcatccatgttacatttacatgtcataaatataaactataaagatctacctatattgaaactggttcttcaaaaaagataaaatgactcctgacctcctaactccacctggagccatgtctgatatagcctcctcaaaagctggtatgacctaaatgttaaaaatgcaatttgtcagaaaggcacttgtacagagttacagacagcagctacaagattctcaattgggcagaattgactacatttctatggagttgaaattttgagcatttgtatacgaacaattgaatagttagttttcactaacatggccatgataaaaggaaaatagtatgaaccaaaaaatgatacactagatgctggctagattaaatttgtcattcacctgtcctgatccaatcttaaatttaaagaagtctttatcaccaccctgcaattcatattacagatgtggaatcaatcaaataaaataaataattcaaatcaaatctaaacaaatatctgtgctgcaaagcgttccaatattattgagtgtattcctttctgtagtgtaaactacagtctacaggtggcaatatgtacctcaaaggaaccacctttggtcttgtttcgagcttcaaaaatgcgaccatagtatccaattgtgtagccatcccaatcaaccttaagtgcactcacacaatccaaatctatatcagggttggcataaatcaacaaatgataacactaaagattgaaatatgtataacacatgcaaatatacagattatctatgggtgaacatcaaatgtggtgcttataactcaccactactgtttcccctttctttggagaaggcccatcaccaactctcaagtcctacaatttaccattataattatgaacagaaataaggaacatgtgtgatcatgcctggataatgctacaaaatgtaaatcactccataaaagtatatatatattcaccttgtactgaagacctgattctgtttcagtgtaatctgggtacttcatcttcgtctttccataatccttcccacgaagcgcaggcactgaaattgtgacatgaaagaagcaagacatgattaacagtatgtgctaagagtgattccattctacctaaaaagtaaacagatcactcaatggagtatcgagtgtgataaatgactcactatcagcaaactcagcttttgctgcccccttgtcgaaggagccaatgctgatgctgattgcaggaatcaacagcagtcttcttctatccaacattccacctgtacagaagtaattaacagtgtcttgtaataagcatttaattttggagtcaaaataatccattgatgcttttgcctgctcttcaaaaaaaaaaaatccatcgatgcaatataattattcttgcaacagattctcttcgcttattatttttcttcatccagtaaacatgcatatcatgcttaacatcattgttaatcccaagaaatttatcttctcataactcctcaagactacattgagttctcatattgcatgtacttgggacttggggatgtactattatgttgatgctccaaatgtttggccatttttttttactagtcccaattcagaattgtagtataacacatagtttaattggacaagggaaattaaaatgcatcccgaggcctaaagtggcactatcacaataaccaatggcttcttcaatcctaatcattcatggtttcaagacaagtataacatgagaaaatgcttggaaatgagttcctataagctattgagtgtattggcagcaccacaggactacaaattcccaacaaatttctgcagcagtatttcacactttcaaatgaagaattcttttctttttcccccagactgcgagctgcggccttgaagaaccctagacctctacacgcgacgcgagtttacctggcaccggcgccagaacggtcgtcgatggttgaggcccatggcggcgagcctttgtcagcgaggagggagggagagggtgacgagccgggatggcggcgagcgcgcgcaccaagtccatcggagtcgccggagctcgtcggagtcggaggaggaggaaggcgatggcgccggcgtgtggcgtcgcgtagccgcgagaaggagataggctttgcttgctgctgcctcatgcgtcgcttgggctgggctgggctgataaggcccaattagcccatttcttctctcttttatatgttttttctcttccaaaattttactactccctccgtttcacaatgtaagttattctagcattttctacattcatattaacatcgatatgaatgtagaatagaattacttacattgtgaaatggaggaagtatataggagtactaatgttatctagatttttatagctttgtagtactcttatatgtagttcatcgaaaaaaaattagtgttggctacttccttagccaattagcgcacttatcgaatagtaaattagtgtacgtttataaggatgagtttacgcgtgttatgagcgcatgagaggtttgttctgtgtttcttattaaaaaaatggtaacaagaacaatgcaatgcaagattccctgcaaatataggagagaaacaagttgccccaattaaacatttgctttctccttagtatttgaataatttggtcaaagtacaatcactaaccaggcttgactacaagctcgatcgatcatcttgtcctaatccctgcatcctaatcgccagtcaggtcgatcaggattaattactactcctaatccattgattaatcagctcaaggtcttcaagtttttgcaacggttcacctgtcgccgcattgcatcggctaccggtatcctcaatgcagtagtggtcaaagtatccaactcaactgaaacaaaatctgcaagttaattagcctctgacacagctctgacctataacaagttcacaacgagggtttaaactaatcatgccatcactgatcgaatccttgtaaactgtatgtttgattacatttctctcttcccatttgtaattaatcaaatcgggcgcatgctgcagcagtaaactactcgcacgaggcctgcaagtttgtttgtttttttcagaggtttgcaagttgctgtaaattgcagtgcaagcacactactcgatcggataaaattaatcacatgatctcctggcgtaaagccaagcccagcttggtgattagtggcgtggttagtagtagtttaaattgtacaatagacgagatcagaagagcacaggtggaatcctatgttgttgtactgctcagcttgttgtgtgatgcctgctcagatacagcatacgcagcttaattactgaattattcttcaattgaacgatttgtgctaattgtactcactgatcaacattgccaagcaaagcataagatctttaggccatgtttaaggagcttctggtatggtttcttttagaatctccagctcctcaaatcatctagattgtcttctagattctaaaaatatatgattacataataaaaaataaattagaagtgaaaaaaccatacatattttctcatggatcctagaaatatatgattatataataaaaaaatgaattagaagtgaaaaccttagaatttcagctttggttattcatcagtcgtatttcgaatcatgagctccttcaaacaaaaccttagcttaagacagggcgattacagattaatcacctgacagagtgacagtagtacaattgaacctaacggtagatcatatcaatcatgaacaacacagcgacaaacactgaattgccttcaaaaactaataaaaagcccctagtactactatagctatttaggatgcaactaaggatgcacttttggatgattaaaagtgcaccctttttcaaaacgtcaaactgttgataaagaaaagaagaaggatgctgtgggtctaagctagtactactactgtaatctaatgaagctgaatttgcagacaaaagctcttcctgctggggccaaatgacaaagaaactgaacccaaccactggctatcagcagctaattgccaatcaatttagggttaataatttaaggtgatggcattaaagaaatgattgctagctgcaacaaataattggatagtagaagatgatgtgataaccaacagctatggagcaagcaggagaattagtggccatttgttgctccagctgggagcaatcaggacaggacagagagcaagtcagaggacgtactccctccgtttcaaaatgtttaacaccgttgacttcttagcacatgtttgaccgttcgttttatttaaaaatttttgtaaaatatgtaaaactatatgtgtacatgaaagtatatttaacaataaatcaaatgatatgaaaagaataaataattacttaaattttttgaataagacgaatagtcaaacacgtactaaaaggtcaacggtgtcaaacattttgaaacggaggaaggtcatgcttagctcaattagcttggtattgatgatagtgcaggccccaaatcagcaggctagctagtaatctgaataacacaagatttagactgccatttagaagggcagtctagctcaacagttcaatctgaattacaaaatatcactcccagaatgcatataactttatgtataaaaataatctagataattatatataaaaaaactactcccttcattcctaagtactacttatcaccaagaactattcaagtttgggccacttatctttttttttttgcaaaaagaataataagcacttaaagataccatattatcaaagattattatgtccttagcattagcactaatcttcgttcatcgtagtctaaccattaaaaaattactattattagtcagtcagtccatttcaaaatataacaaccttaatactactactaaataaaacatcacataatataattaatctgaaacatgtccaaattagtcattatctaaaaaaaagtccagattagtagaattagatgatattctattgtgttgctatgtttttttttacagatagagtagtagtttaagttagagcaacgatttttttttaaaaaaagtgactggtatattttacaagttaaattatacattagcgttaattatattgtggaaatcgtggcaatgtggaaaacaacaatcacaggatgcgacagcacacgtaccctcttcctacctgaaaataactgtagcggcacgagcacgagctggtcagtgtagtagtacgtacaggtgggccccacccccttcggttggctctgcaacccaaacaaacagctgggaggtggtccagccagcccagcctacaccaccaccgcagcatgggcatttcgaatttgaaagaaaaaaaaacataataatttcaaaaattttaaatcaaaactagaacaaacccccatccatccagtacagcctgttcccagctgcccccctcctcgtcaccccttcttatcctctctctctacacactctcgctgacaggtggggccagcatacgtcgggccccatgacattgacagtagggtaacgtgagctcgcgggacggatagatgcggctgtacctgtacgcacgcacgggttccttttttttttcttttttcccttttttttctcatcatgtgttgtttggtactggtacgttctgcctctatcccgtgccctgctgtctgcactgcacgacagcaagattatcaaaaagggcaaaagaaaaaaacagagatagcgtactctgatcctttttgtgcaggtcaaatcgacaggctgtttaggtttcgtgattcgtcgagcaggaatttaaaccgcactttccgtatcagccactggcattctgtactccccggtaaaaaaaaacatcagtaacctccgtctaaaaaaagataaaccctgattttcgtgtccaatatttgaccgtccgtcgtatttaaaaaaattataaaaaaaattaaaaagataagtcacgcataaaatattaataatgttttatcatctaacaacaataaaaatacaaattataaaaaaatttcatataagaccgaccgttaaagttagacacagaaactcagggtttgtcttttttttttttttgagacggagagagtatgagtaaaaaatgcagtaaaagaactttctttttttctattgcaactaggagtaatccgttcgtcctataatataataacttttaatacttagaatttgcttaaaatataataatatcttcaccaacattcccttcttaaccaatcataatcctgcactattcatttttcccatataccttcacttctcaataattttatattttacatatttaattttacatattttcttaataatcgtctctaactttaaaattttttatattttgggatcgagggtagaattatttttgtagatggggttccgttatttttacccacgaccgttaacgacttgactccacttcaaatcgcaactaaccacccgagccccgcgggcgcgggagttccacgtactgaggctgacagtggggcccacgaggagacccccgatcccactccacgcacaaatcatcactcaccgacaccgtgggtcccaccgaactcccgccttccctttcctcctcccacgcaaaccctctcctttcttttttccttttccatccacttcacccacggtaaaaactgcaaaaggttgaaaaaaaagaaaaaaattaccgcggagttcgagttatttccggccacagcgatggccccgccgcaaaagcggcccgcaacccggatccggtgcgaccgcgccacacgcatccccacgccaccctaaccacacccacacgcacgaaacctaatagccactgacaggtggggtcacgaaacaccggggcccacatggaagtgagttgggtatgagctggatcgcgtgaaatagtagtagcctcgcgcgggagggggatccaggctggccacggcaatggcgcgcgagtcttataccctatgatccctcgtcaccactccttccacctcccccaccgccatcgccattgccgccgacgaggaagaggagaagcttcgagtggagcgatctcgatggacccgtgcccgttcgtgcgggtgctggtcggcaacctctcgctgaagatgccggtggcgccgcgccccgccggagccggggccggggtgcacccatccacctcgccgtgctactgcaagatccgcctcaacaagctgccgtaccagaccgccgacgcgccgctgctgctgccgccctcgccggaggcatcggcggcgccggcgccagcgccggcgacgggcgcgctcgccgccgcgttccacctctccaaggccgacctcgaccgcctcaccgcgaagccgtcgctgttcgggtcgcgcacggcgaggctgaagatcgtggtgtacgctggccggaggggcaccacgtgcggcgtcggcggcggctccgggaggctgctcgggaaggtggtcatcccgctcgacctcaagggcgcctcggcgaagccggtggtgtaccacagcagctggatctgcatcgggaagcgcgggcgcaagccctcgtcggtgtcggcggcgaacgcgcagctcaacatcacggtgcgcgccgagcccgacccgaggttcgtgttcgagttcgacggcgagccggagtgcagcccgcaggtgctccaggtgcaggggagcatgaagcagcccatgttcacctgcaagttctcctgccgcagcaacagcgacctccgctcccggtaaaatttcttgccctcatggtgttcgatcaaattcccagtcaaatgtcacatcgttctgacgacaatttcatacgattcaggtcaatgccggccgatatggggagcggcgggcgcaactggctgacggcgttcggctccgacagggagcgggcggggaaggagaggaaggggtggtcggtgacggtgcacgacctgtcaggctccccggtggcgctggcatcaatggtgacgccgttcgtggcgtcgccggggacggacagggtgagcaaatccaacccgggggcgtggctggtgctccgcccgggcgacggcacgtggaagccatggggtcgcctggaatgctggcgcgagcgcggcgcgggcgccgccgccggcgacagcctcgggtaccggttcgagctcgtcctccccgacccaaccggcatgggcgtgggcgtgtccgtggcggagtccaccatcccggcgtcgaagggcggccggttcgcgatcgacctgacggcaacgcaacagttcgggcggagcgggtcgccggcgtgcagcccgtgcgggagcggcgactacgggatgtggccgttcggcagctgccgcgggttcgtgatgtcggcggcggtgcagggggaggggaaatgcagccggccggcggtggaggtgggcgtgcagaacgtcgggtgcgcggaggacgcggcggcgttcgtggcgctcgccgccgccgtcgacctgagcatggacgcgtgccggctcttctcccaccgcctccgccgcgagctctcggcgtcgcgctccgacctgctccggtgaggcacacgaggcggcggtgaatcgatcgatcgatcggaatcgggaacaacattgtacagctagcgctagcgttcgtcgtcgtcgttttctggtctctgtcgtttttgttgggtgatcagattgtgttgtgttttttattttgtttttgaaatcactactcgtgatttttttgtggtttttttgggtggtgaaatggtgatgagggggtttgtaattttggtagacttctaggtgctttttaaagtctagaagcagaggaggaagcagaagaagaagaagagcaagttcgggatcatgatgaatgaatgaacaagttataaaaacttttcgtgtctattatgttttaaatttcaaattcggagtttattttggccaaatcggtcccggcagtcaaaaaggtgtgtgggttgttgttggaacttggaagggaagagagaggaactcgcgctctcaccagctggagtggagtggagtggagtagagtaggaagaagacgaagctgaggagcccgaagtgggccagccgagctggaaaagggtgattgggctgtggggtccacggccacatgggatgtctcgttggttgctttgctttggtcatgctgcacaggccgggcccacccggcgggttgtactcttcctatctgtctgagtatgcggggtgggtcccactggctcgtgggtggggcccagcgggtggcagagagagcggagagtggagtgaagctgtgtgctgctgctgcgaagtgggtggttgggatcggtgccgtcgcgccgcgcgtagctagcgcacgccatgcgcccatgctcatcgcaactttacaagccacaactccagccttcaagatccaagtatgcagggcaagaaaaaaaatacgtcatccatcctaaaatatataagcacttttagcaataaatccaaacaattatggcccattcgaatccactgcaaggagtggatgaaattgtagattaaaatggcacgcttttcaaactgctaaacggtgcgtttcgtgtgaaaactttctatatgaaagttgttctaaaatatcagattaatccatttttcaagtttgtagtaattaaaactcaattaatcacatattattaccacctcgttttacgtgaaacacttaatctttatatttattttcatcttcatgagattcaaacaccactatatatgtgtctaaatttatagctaaaagttattatattttgagacaaaagtagtattaccgtctccgtcccacgtaacctaagatcgaatgccatttaacctataaagacctttatgtatactactatgaaaaggtattaatggtggtggtggctcaccattattatttactttgacaaattgttctactatatattttctgatattacacgataaactaatatttgttttaatcgaatgagtactatgtattcaaataagcaaacaagtaatactagcatattttataaaaacacattattattattattattattattattattattattattattattattattattattattattattattattattattattattattattattattattattattattattattattattattacccatagaaatatgctaaagagctctagtacaatttctttcccacaactgctggtagcagtacatggaccagcagaaaaggaattccggtacaaatgtcttcttgatttaaacgactgacgcctccattttggaaaataaatcgaatgtgattggaattgaattgaagcaaagcaagagggtcaggcccagctgttgttcagcagctttcagccagccagacatgagacaaccctcccaaatccaaccaaacatagcttaattcttcctctacctatctcttgtctcgccttcttctcctaaacaaggatccaaatcatgccagctcaaccctcccttgattcatcaattcccttacctatatagctagctatagccaacactctgtctcgtcatcaaattaattagtacactaatcagctggtagcatgttaattacgtcttgtttagctaatcatgacagcttaattcaacttgttcgccattaatttagtttagtttagtctaatccagtcttgttattaacaaaagctttcgatcgcttgcattggagccatctgaattgtatcatatgttcttgaaaaattatatataaaaaggggattgcagctgctagctagctgttgatgatgcggaccactcctaattatgtgaaaagtgttatatgtacctacctgaaatcttgtagtactcctactacttagctgggattatgatgaatgcctttatggattagtgttcataaagatataagtatatccattagacattgcacaaaataataaaaatatataagtatatctttatgtttgtctaaaggagatcaaaatggattgacctgagaaattaatttttcatataaattagtgagattgcgacgtgcaaggcgatattggcacgtaatatatatatatatatatatatatatatatatatatatatatatatatgtgtgtgtgtgtgtgtgtgtgtgtgtgtgtgtgtgtgtctgtgtgtgtgtgtgtgtgtcgttgggactgtagtacattgaatcttagctgcaaagttttttgaaccaggtcagtactcctatatagcaatattattttcattgtcaaaagcagatagggctgtcattatattgctactttatcatcaatatatttttaattagccaaatccaattatagtgtcttgtaatggcgactagaaacagtggctctatcagatctctgtatatgaaatgaaacgaagaactagtagaagaatatatatggagattagctgtacacatatgcctttggagtcaaatgactgtaaaataattgatgtttatgattaaaaaacatgttggtcctacgacccagtaagatgatccggatcttgtttcttcctcagtgtattgtaaatttgtaatgcccgatgaagaaggatacgatgcgatcgaatagtaagcttcttggcacattgcagactctcacacgtgcagtactcgtcccccacgtgtatagtatcagtctatcagattatcagaaatgattcttctgttcatgcatgcatggatcaaattcccttcacaatgtgcacttatagaaagttagaaaattgatatatagtactacctctatattttaatattttaatgtatgacgccggtgattttttatcaacgtttgaccattcgtcttattcaaaaaaatttatataattatcatttattttattatgacttgatttgtcatcaaatattctttaagcatgacataaatattttcatatttgcacaaaaaatttgaataaaacgaatggttaaacgttggtcgaaaaatcaacggcgtcatacattaaaatacggagggagtagtataaaatagtttaaatgttagcttggagcactgtacatgcatgttctgtagtggtagtttctttgttactcttcttggagcactgtacatgcctgctgatcgtccattttgtttctccaagagagaaacttaagtgcgtatgtcggtgtttgcttcttgcaatggagtctcatgtcttaaaaccttcgagagagagcaacagaaagtatttactacccatatgtttaggataagattcaaaagtttaaaacaataacttctcagatgcttagttttaaaaagacatgcaaatatttgtcttaaaagatatataagatcataacgcactataaaattggattttggcatatgagtcaccttctagcttacatcgtccacctgtgataatatcggtccgagaggacaaaactcgtatgaaaaagaaaaccaatttttataggcgaacttcctaacaggcccgcatgcgaaaataaacttattttcgtaagcggttctgttaagaggcccacctagcaccaggtcagctatcggcccatccccactccccctcttttttctcctctcctatctcttaaaaaaaatctcctcaccgcacactctcctcacccctctcctcccttcttctctcttctcctcaccccctcctccagcgcccccctttctcacccttcctccaccaaatatagtcctcagccatgacaatggtggcgatggtggctagggcaatgacggtgggcggatccggcgccagtggatggggcaatgacgacgatggctccttcgccgctccctctccctctctcttactctcacctccgctgtccatcctctctctctctcaatatgtaggccgacgaaggcgtgcgagaaggttggtggactgcgacgacgacgacggtgggtccagcgacgcgcgagaagaccaacggagcaggtgcgcatcgatgatgatagtggtgtgcttcggcaggggcagcggcatcacctcctcggggcgtcaccactgcggataaggatcatctgcaatcgaaatcacgtgactttgttactgatatgtgggcccatagattagtgacaaatgcaccgtgcatttgactgcaaaggattttaatcctttcgccgtctcgagagcgcgccccccacacccccgcgcgggtggcgaaggtgaataaagagattgttgctgaaaattattattttaaatagtgtacagagcattttctacaggaccacttgacaaagtactccctccatctacttttgatagtcatatttccaaatctgaaaaatctatttttgataggcatatttcaatccaacaacctatcatcttagtgtctttctcgaatttaatgcgtgattctctattcctccacacaagattggctacatgggcatcgagaaatgtaaatattaatgaatcgcttgttcacgaggaatgactagtagcatgtttaaatggatgataagtagaatcacttatcgttagtctgtgtgccaagataaaatatgactatcaaaagtagatggagggagtatattgctagcttgagattaatgagctgatccaaagcaaccagtaacattagtgtggttactacatatacgtacaagctagcaaagggtggttagatggaatgatggatggtagtagtttccaggtccagctgttgctcacaactccttccttccactgatacacacatcagcacacacaacacgtacaaaatcaggagtaactaaaagctattgatacggcagcatcacaagcaagctggagtagtagtagctcgatcaagagcagctaaatccgatatcgtccttaatttggttagttataccaatcgaggtaatcattatgaggatccaattgaagatccacaattaattgctgcaatggagtaattgcagtgtacttgttcaggttaattgagctggtagctagtaatagtagcagtgttctttatttattaattaaggcgagtatatgttgttggtatagtacttccatttactgtactagcaacttaattatcgataaaccttggccttatatatatgtaccttagctcaccgaaccatgcatgtaccagagctgtttcgattaaataatttatgcacctcatgtatgcatgagacaggcagcagtgtatatataccttttttttacataatggataggcagcagtatatgcctgatatatgcattgaacgtacagatcgatcgatgttcatatttagtttgtactactactccagctagtacgtactatatggcggggtttcccaaaccgccggggccggggttaccgcgcctcggcggtaagcacggtaaccgtgaaaaaccgtacgaaaccgtgtaaaatttatcaaaaaatcaaattatttttaaaatttatttaaatttaaggaggttaccgtgatttttctattaccgtaccccgtggtaaccgcgcggttatcgacggtaacatcaaccctgctgtatgctactccagtactgtcccggaaggctcactgacgagtgggccccacgtgcagtgggtgaattagcatcagctggcatgtacttacctgcgtctttctgtacataggctcgcattacttgatttttctcaacacttgtttttatttttcaagctgctgtgttattgattatggagtacaacgtggcgccgccgcgcagactgtgattgatttggtgtggatttggaaagtttaattaggactggatttggtgtatttgggcgatgtttggatcagatttggtgtggatttgggatcgatgtttgggattggattcgaagaagctgtcgtcggctgctgctgcccttggctgcgatttcttttttcggcgaaatttggtttgtgtagacggatggcataatttagccgcatgtgaagattgattactatgaaaataagcactttccacgtcttaattaacacgcagcacatttggccgtctgcagaaaataattttgcagtagtggacatgctaccgtgtacataacatacatgtattcagtagtacctgatcgactgatcaaggcaaggcatgcgttagattgggaggaattgaagcttgcaagcaaacttgtacagctgattccatcagtgagggatactttatttcgttttcttctcgagctagctcgttgatcatatatgcaggcagaggccgctggttttcaggtttggctagctttagagaggagcaagctaaaataagcttatagctatatcagtacgatctttagagtagtgcatgacagaggagaaccaggacgatacagcgagagagagaggaggctagaaaatttttagcctcatctttccgcttatgattgtatgtcaaaatttaaatttgaagtttattttaggattttccattgtggattattttcagcttttgcttttatattactaaaaacacatatataaatattttatttataaattatttttcgtttccatatatatcgtttggcaccgtttgttctatccttgttggtttgcttcaacggcaaatcagtcatggccctgtacgtttgcttcaacagcgaatcagacttgagttcaacgaatcaagtcagaggtaaacagtcacatgactttttgtgtggtgattttttggaacctgatctatacgatgaatcacgaacggacgacaggattaactaactcgctatagtacttagcaaacagtaaatccagagtgtatttgtgtagttgctacagtacccacgatgcacttgtaagctaatgtagctataaagtataaacatgttttttaactaggcgtacgtgtcaccggggttgcacccgccggattctatcggatcgagatgcttgcttttaaagacaccgttttctatcactaacaggtggattcatgattcataaggatcacatatcagtagatgacgtacatgtgaaattatagatcaaactatcaaattggcaaattttagtgttatcatagtatccgctaagttcgtggactggagataagcggactcgaactgctgatatccgccacagggtaaaccactggctctcaggtcttcccaacaggttctaccataaaagccaacactaggtttttgtctttgtagcgaagaaaatcacttgtctctgctttacatccttaattcaactgtgccccgctcaactcgacgggagtgtttccagccgataataatcccatgaggagtgatatggcaccatttacagattccaatagaagtttttctctgttgggtgcactagggtccgttggatgacaatcagatggttctcgatcgtcactgctctaatacgacttaaaacaaaatcccttctttcttacataaaaggacgaacaatggccatgtttagattcaaactttttttcttcaaactttcaacttttccatcacatcaaatatttggacacatgcatggagcactaaatgtgaaaaaaaaaccaattgtacagtttgtatgtaaatcgcgagacgaatcttttgagcctaattacgcaatgatttgacaatacggtgctacagtaaatatttgctaatgatagattaattaggtttaatagattcgtctcgcagtttacaggcggaatctgtaatttgttttgttattagtctacgtttaatacttcaaatgtgtgtccatatactttaaaaaaaatttggcacacgaactaaacacagccaatatagtattatagcctataaaaaactacaaaaaatgttacaattcataaaaaaagaaacaaaattgcatataaaaacattcaaagtaactaaaaccatataacaaacattaaaaagaagtataattgcacattacaaagcactacaattttaattaggcatagaaacatggaattttttatggttgaaaattttcaaatgtttaggcacctgaaatataaccatacctattaatatgtaatttatccgtataattaattagatcatgcatgctcgggtgctctctcaaccttcaatcaattatctaaaattaaaagaacaggtaaattaagctactggtgatcatggttgtggtgtgcttcaccttcaaaccacatcccaatgagaagggctacgccatagagagaagcaacaaccttgagcatcctccaaaacctcttccgacctgcatctcgtctcatcagttcatccacaaaccgatcccgatctgcgcaacgcctacagtaattatcgcctcctcctccataatcacgatcaggcgaactacttgtgcagctcatcgatatattcaccttcttaattaacctacagtttaataacacaagaattggaacacatatagtatcagatatgctggagaaatatggctggggattgattgtgattgaaagaagaggagagattaataagagaaagaatcgagttgattaattaccgattgatccaggaacaagatagatcgatcgatggatggatggatgcaagccgcggtttatgttagcgagaatgcgagataaccacaccgtactgcagatcggttgagaatatcaatgttacatcgagaaactgttttatctctgtaaccgatttataggaacagaatcgaaatagattggtatagatgcggaccggactgtacgacgatctctgcctcaacttgttaggccactttaatctctcagttatgatggccttatgtgtatgggcttctttcttataatgtttgggcttcctctcttgaagcctattaggctgctaaccgtgctctttttacgccgagtttggttcccaactcatctaccacgtttttcacgtgcacacgcttctcaaactattaaacagtgtaattttttactaagaaaacgagatattatacagaagttgctttaaaaaatcatattaattgtttttaaaaaatagctaatacttaattaattatatgctaatgagttgttccgctttacatgcgcgaggaattagttctcaataagtgccgaacacaactttaaaagtttacactaagggtgttttcgagagtagataaaaaagaaaaagtggtaagatacacaaaataaggttagtcattagtgcatcattaattgaatattacttcctccatcttaaaatataataacttttagcatttagattttgtcatataaaaactttaaaaagaaatttcaggtgcatagcgctctaatttcatcgaaaaatccgaagtaacatcgctatagatcaatcatcaatcatcacaaagtgttactttaaagcagatgcatacatcatgccgttgcattgtaaattagtgaaaatcaacacaaattggtaggattagcatgcaatttcttaccatata

SEQ ID NO: 75416 - DNA, 8602 bp, Oryza sativa
ttcttaagttagcaatcctatgcaagtcttcagggagagcccttagttttgggcagccattaagaaacagacgcttaaggcaaggcatcagaacgagctgttcagatctaccacgcaaattccctgtgttaagagaccaactttccaaattgctcatatcaatgatgtgaagcaatttgagctttgggaaaatagttatatgcgtggcactgctgacgccttttcctaggagctctgaaccaatattcactactgcatctgcacatctgatctgaagaattagtagttctggcatctgacctgctggtggaagctcagagcatgaaatgcactcgttgaggtacatatgtcccaaatttggcatcttatactctggttctgagcacaaccaatctgggaaccttacaccaggaaacccctcaaaaaataaataaattaggcttgatgatggacttagcatctcatagacttgttgaattctctcaatctcgttcatctggtagtgggtaatatcatgagtattagctcccattgtgcagcgaaaccacagttctcgaagacgaagactgttcctgagtacaaatgcaccccctggcgttgctttttctagctttacaatccggagacgttggatgttggggagacattgcagttcatctagcctgaatccagatgcactctcgaaaactcctttaaggttgtagagtttctgaaacttcgcgatcccttttggaacatggtcgattccagtttgttctagctcaaggaaacttatgttgacagtctcatcaaactagctggcaggctatccaaatgtctgcaacagtgcaaagaaaggtattcaaggctggtaagatttcctatggattcagggagttttttgatttttgtatagcttagatctagcaacctcagtagcaacaagtttcccaccgactctggtatgacttggatgcttgttccactgagaactaagacacgaatatgcttgagctctctgaaaatgtccttattaattgtcttaaagttcttgttattaaaaattaggaggctcctcaagcacttcagctcttctatagcaggtatttcttttacatcattgttattactaagtgacgtagattcagtaaggttttgctattttccatattcatgaataaggaatgatcctttgtcaaaaattgtccaagtgacctcaaaagatcatgcatcgttgacatccatttgtcaacaaactctggttttggctgcagaagattcattctaattagctcatggtagtattcttctgcggcttcatgtattgagtacccatgcattttcgtcacaaagccttcagcgacccaccagtaagcgacagcatcacgatggatcccaaaatttgatggtaacaaagcacaccagagaaagaattgcttaagttcaggaggtaagttgctgtagcttaagtacagaggacctcctagttctttgggaagtccatgaatagaccatttgctatctcggatgctctcccattctgcctttgttttcttactagataggacacctgcaacaactttgatggcaagaggaaggccatcacactttttgacaatttgatacccaacaccactgaattctcttctttgctcgtatggccctaatgacatcttcatcagcagttctaggccatcgtaatcattcattttgtttaccctgtgggtataagttgcatgcatttcgaccaaaacatccaggtttcttgaggtcacaaggatatgagaattcaaacctctcaagaaaggcaaacgaagaagatcaatccatacatcagatttccaaacatcatccagcacaagaaaaacactcttccctctaatagtgtccactagaagcggtagaagctcagtcttagtctccagctgatcacaaattcctccagccattctgattgcctgttttaacaaactggtctctgtgtaattctgagaaatgcacaaccatatatgaacttggaatttctcccttatcctctgttcattgtatatcttttgagctaatgttgtcttaccgatgcctcccatcccctggatcccaaaaacagttgacctgctttcattgtagttactactaacaatcattttgacgatgtcatcaatagcccttctgatatcttctccaaccacctcaagttcatctacaggagatgtctgacttctgtcaacaattgttatctggatttgttgcccgttggttctctccaagccaaacatctctttgttcattttaatttcttcaaacttttcatttatattatcaattcttttggcaatcatgtgatcaaatgaaaactttgcaaagctagagaacaagggctgattgcaacataccggccttggtggcagcaagagcttctgtgaatgaaccatgaaaagatctacgatgtcatcgacatcaaacataacatttctcatgttcttccaccatgaatctatccctggatcctccatggccagagcctcagcatcctcacgaacagcgttgaagaattccagatttttcttcaggctctcaataccccttttcacacttaatgtcatgataacctcatcctcaataagctgacccagcttttccaagaatttccaagcgagagcatccaaaactgtgcccatagtgctagaaccgggattcccgctggatctctccaatgggagatgcttgaaactgcagatcccagaacagatatctcacagagctgcagatcacttaaatacggaagatggaaagagatattgaagcagtgtggctaaagcctgatgagaacggagagggcaatgcagattgcagaggagagctgttatagattctcctccctttcttgccaccaactgcctttgtcccaacagacattgacattctctattgcaaaacgtctgaaaaacctgaaaaaaaaattaaaatagtatgaaagtactttttgaggcagaatctgcccataaagatttttgtattcaaatctaaatgtttcaacgatgatgcaatgtgaaaaagggcaagtagtgttacaaaattgcaaggcgattcaagttgaaagctcttccaggctgtgtattcttttcctttcatccccttgacaataataatttgattttattgcagcaaaggagccacttggtgctttactttcttttcctgtttaccacctaagaagcctggaagcactggagcagagttctctttttttcaggaatatgcaacaaaaaaaatatatttatattggcattaaggttgggtaaaacaaggttcagagaaaatgatacattagatcaccagagtgcagacagcagaccgaaggaaaaaatagagtcaaacaggtgctggccggtgctgggcatgcaaccgcacgcaggaatctactgggcatttcgtcaaacagctcatctgcgccccaaccatttgttgcaaagtccaagtttcagagcttagagaaaacatcgaaaggaactcatcccattcgcatcagtcgcgttgcacataatcaagtcagaaaagaaaaaaaatatgatggttgattacctacgcaagaaagagagatgcttctcctagcgaaaccaaagacggcgacaacgacccacaagcaaagataagcagggcctaggtcgaactgagcctggatcaggatcacatcgcataactccagtataaacaaagagcaaattctctgattcatctcgcacgtaacgtaacgtaacgaatggggcgctcggggagagcgatgcgcgaatggcgttcgatgaaatgcccctccaagttcaacaggcgcgtccaggccaatcgattttgttttactttctgaattgggccctgtcgcgaagactgcgacctgaattgggccgtaagcccgtaacctaagctctacgccgaaggaaagcccaaactctaaaaactcctccaccaccgcgcggcgggaaacccgctcctccccactccgttcccgcgcacattttttcggcatcccacccgtcgattttttccggcatccaacgtcgtacatccctccacgtcatcgatccgcgccgcgtgccttccaccaatcagggcgcacgtcccctcctctacaaaaccatcttcccccgtctcctttccccacgccgcaatctcgcgaatcccaccgcttccctttcctctcctctcctctccccgggaagaagacagcagcggcatccatggcgcccaaggcagagaagaagccggccgcgaagaagcccgcggaggaggagcccgcggcggagaaggccgagaaggcccccgcggggaagaagcccaaggcggagaagcgtctccccgccggcaaggccgagaagggcagcggcgaggggaggaaggcggggcggaagaaggcgaagaagagcgtcgagacctacaagatctacatcttcaaggtgctcaagcaggtccaccccgatatcggcatctcctccaaggccatgtccatcatgaactccttcatcaacgacatcttcgagaagctcgccggggagtccgccaagctcgcccgctacaacaagaagcccaccatcacctcccgcgagatccagacctccgtccgcctcgtcctccccggcgagctcgccaagcacgccgtctccgagggcaccaaggccgtcaccaaattcacctccgcttaggcttcacccctgcatctatctatgtgttagttttagtgctatcgatgattggaaaatggatgttagatcgttagtttggtagtcagatgtcagtgatctggaacagtagctctgattttaaaccatgtgaatgtgattcctgggtatgtgatgtttgaccgccttgtgtctgctggtcaacgagtgataactagatctaatttttgtggaactatttacatggttgctacttgcattctgttcaactgttgtaaattcctctgtcactcgttggagttttattctctggagcatgtgtggaattgcctgggcatgcttttgggaaactatagtctgtagtcctatgttatgtttggttaattggttgccctgagcttgttggaattaatctatgtataattttgtgcaattacatcctgtgagtatgttgctatttgcattgtcttgcaaactcctttgtatgccacaggaatttaatttctggagcatggatgtttggagtttgatactgttcaagtgcttattggcccatgtagtttataagtacgagtaggtttcatctaaggacactttctaaaagaagagttgtgaattggttagtatatagtatgacaacttggccatcaccgttctattttagctgataactttgacatctgaagtaagttttgctttaccttagtactgtactgtttcaactttcaaagaagtttaattggaaatagtaactgaaacaccggaaccgtaagtattttgcttgctattgcaggatgctgctacactagcctgtttcctcatttatgttccgaaggtctaatgaaggttctctctttgttcttgattagcttgtaagctaactggcaagcatgaggtatgcactaaactgctgcatcttctatcaaagcttgctgttggagttgttgctctgcaggatatgccatgtgtgaagatgatgaccaaactcttgtggactctagaatcttataatgttatcctttggttctttgtccaaactcttgtggactctagaatttttattggtattgtttaattttgcattacagtagtagccagataatatggtgtttcattattaaaatttattaaaggaaacaattttaaccaacttactaaactatcacatgttcaatttgtgagtatctcatgcaaaagtaatttattgacctcacagtgcttacactctaaacaaagttactaaacttttacttttggtaatataagtactattagatttattgttgtaataaaattacttgctcatattgctattgcttaagtgctacttcgcagtttgtataggaaagctaaaaggatagcagaagaacttgagaatgtccattaactacctgaaacacattatctatgttgtatgtgtaaaatatctatatatttataaaaaatcattttaggaacaatttctacaaatatgataatataaaattcaacttatattttaaaaaatatgcattctagattttctctattttaaacttatgcttctttctacaatgcaagtgatctaggaattactactacaacatagtgtatcttctagtttttacaacaatatgttgacacgccaatccactacgccattgttattgaatgagaacttcttatgttgaaagacatgattcactctttgtggaaaagtaaaaaactatgtatcaatattgaaaatttcttgggatcccccagtacatgccccttgggcctatttataggcttagtgcaggctcatgtgccctagggttactaagtacatgggaatttacatgattacccttacaatagggacatttatgaggataattatagacaatttatccttgggcctcttcttgggccgccaagtgggcctccattggttggttggccccctcgggccttgaatccctcggcttgggggcgaaggtcttcggcttcgctcgacgatttgcccagagcctctgtctttgtgacatttggcgttttgctgtcgtgcttcgtcctagcgattgtagacttgtttcggcaggctcggttgaaggccctcgtgacatgcctccaacagccatgctacgcaccatatcaatttttaagtacaggaacaatcattcattcatatgatgcataagaaattaacagttatgtgactttgaagaccatcaagagcttgatcgggatctgagccaataaaagcattgtggacatctaaaagcttgaggcaaaaattttggccaacctaaaagcagttcatatgtttgatcaagtttaggaatgtaccttgagtgctttatgtttagcgatgcattgataaaataataaagatcaggcataggggtgtaagtgggtgttaacgaaaaatccgcgctttgctaatggtgccagaattgtattggcgcgaactaagtcgacgaacataacggccctaggagatctgtttagctctagtgcaggtccaaagcttgtagagatgcgggcatgccagtcagtttgatcctgcaactaactagatatataaatatgttgatcaccaaagagctgatcggctgacgagtcgatcgagcgatactagccgatgccgatagcaaccgatgtcgatagagttttgagcaatcgactatatgtccaatgtagagtctgatacttgagtaaataatgatataaagataattggctgatgataatgtaataaaacaacaatataatccaataaaaaccaatcggctaacaatgatatgatagaataagtgacccgatggttaaagcatacatcggctagtggtatgatgtcattaattaaatccaaatgattagataaacagtgaaatctttgttacaatctgctaaaaacaacttgtatgcaatctttgtaagccgatacaacgtctagataactcattggctgaatcctcgatgaaacccttattataatcaaagacaggttagcgtttaggattctaagcacgactagggatgatgcatcgcaaagtatgcaaagaaacataaagtctaaacaatcaagcctttgactaattttcagggtggtggatatcttagttaatctaatctagcaagatactttagccgataccagtataaaacctaaaacgaatctcagccgatatgatcaaattaagatgctaaattagattaactaagatatatgataaataggtaggcaaacatatcaaccgaaccagagcaatccaagaggtcaaagctatgcagccttgaaccacgccaatgtagccaatacaattgccagagctagcagaacgtagtacttaccccgtcggatgataagtaaaaaccttggtaaagagggtggcgatgcgccgaaagtaattgtattgatcgagagatagtttacaatgtctctgggtgtacatatttatacccatgggtagatactagtccttgttggacaagaaaaaaacattcctaaagataaaaggaaaacataatgtccttatcggacactaaacacatttttctaaagataaaaggaaactaacagactctttctaattaatagataacttgccatgatgcatcatccttaaactcggtcttttctggataagcttaattgaatatattaattttcttaatcgaatatagcaagattccgactattggcgacttgatagtttccatcggccgattataggactctgaaaccgatactgactctaggccgatgatgacttcggggcttgccaaatttcactgtttacagtgggtcaaccgtgaacccacttataggtcaaaataagcaggttcgtggcttattttagcctataagtgggttttgtgggctagccacttacacccctaatcaggcatggacgagaagtttatatctcattaagaaccacattttcactgtcacctgcagggatactattgatctgggtaacaga

SEQ ID NO: 75417 - DNA, 867 bp, Oryza sativa
ccgagctaagatgaattagttatgaatttttaaagattaaatcggattaaaacacttatatggattttaattgaattatgacgcaataatgaattatttttgaaaaggaaaaagggatttattgcgtcagcggctagggttttcggtggaccgggcgcatggcgacggttcacggaaacgaacggctgagatcgatccatccaaaacggacggccgagatcgatcgggtctacagcggctcacggcagacggccccgatgacatcggcgatgacgtcaccaccggcggcggctcgggcggcgcaaactcgccggcgaacaacggcgcttcggcatgaacggaggacaccaggacgtagagggcgacgcggcgaactcaccggtgaccaaaacgtcggcggaagagcaacggacggcgacggcgacgaagaagaagcggcggcgaccttcggcttgacgacggcgacggtgctccggcggtcttcggcagcggcgaaggggcggacgaggacggcgacgacttggcgaccacaatggcgacctccccgagcgacgacgatgaccggaacggcggtggcgcacggctggagcgacggtgacgacggcggctcaaggttgcacggcgttagggcgcttccgacggcgagagacgaaagcaagggtggcggcgggtagaggagacaccgggggtccttttataggggcaagaggcggcggcgagggcccacggcgaccggcgacgagaaggaaagttagggctcggagagagagagaccaatccgaatcgacctcgaatccaacactttccaaacgattttagccggggattccaaaagagaaaaggtagaggagatcccgaagatcattt

SEQ ID NO: 75418 - DNA, 18589 bp, Oryza sativa
tagaatttaatatgttttaatttaattttctcgttttttttctttccgttgcaacgcacatacaattttgctaatttatataacgttacgtgaaaaaaaaaaccgcctggaggcagtatatttgctatgtttgacttctataaaatcctttggtttgacttctataaaatcctttggttcgtccgttccaagaaaagccatacaggaaaataaacagaaactatttgccattactaaacaaggaataattaactatctgtcaatcttacaagtagtgaaaaagaatgtctcatactccatccgttccgcaacaactcaacctaggaagaaagggatttgcccctttaggacagagggagtatggtatagacacatgaagacagaccacaaagcatgcagagacttccaaaacatgaaaaaaacaatagcacggatatttgagcaaacaccaccaatacgtgcacacattttcggtcatactcaactaaacgtgattagcacgaagctgtcacgaactgagataaaccacatattccgaacacatcgagcaaactacacctgtgctgtgcggctgttctgaacacatattgtcaggcaagttcaaccaaaacgtgattccgcacaaagctaccacgagttcaaacaaataaaaacattaacagatgtctgcacagattttcaggcatgctcaacaaaaatgctattcagccaatccaagttgtcatgaatagcagatgtatgagaaaatcaatcggtcctactcccagcggatgtatagccaaccccagtttctccatcaaatcaaccacattgtgttccaatgaaaatccagcccgccctctttgtgtgtgaggtaacatcattttaacttcctgaaccaaacaaggaaaggataattcagagattggcatttgcgggatagaaagcaatagaactgttgatatcatcaaatatttaataccagaaacggaagtgtaaagacaaaacttactttcttgacttcatgtatggttccaaacttttttgaatggcacgcaagtacgttgggtagcgggaagttaaaatataatctgtccatgacaaacgaaagggggtgataccatcctgcagagagtagatataattagaataggaagatattataacacataaaagagtatcaaattctatccttttacctttaatgccttttcaggtatatgaacatcggaattcctcataaaatcaaactgtaagataccatttttagatggttttctcttatccgttccaaccttgttaactttcaaagccactttttttgaatccaaattagcaacgagctttagatactcattgtcttccgttctgttcatccagcagtccaaatacgggatgtgcttaaataaactatcacgatcatcttcgctaatagctggactaatattggttttatattcagtgtgcaaattgaccaataatcctttcttctctttagctgacattaatgagctgctgtctatcactgattcaagtctcttcaaaggattttcctttaaatcatgtagatcaccttgcagatcagccggtatcatttccccaacaaaacaacttttaaccaactcaacaacctgcagcacattatttattgcttcatcctcctcatatgcaatcacttcaagttgaaagaacttgacatcagatccttttaaaagaattttcctccttctcagaaggtctgttcccatcctcaaacatttccccaaagagaacaagttaacaaggtgtgacagcatggaacgaataattgccttagcaatatttcgaacaaaattacattcctcatcattccttgacccaacaatatgctttatcttcagaaaagaattcctctcgagaaattcttccaaagtcaaacagaaaccttcaaaatgtgataaatccaagccattctccaaaaaaaataaatagttctgattattcaaagcaactgagtggagagtgcagcatccaagtttatcatttggcacacagtaatatatatctggggataatttcaactcatttcttgtctgaaaatacaattccatatattgttagtttatattaagaataaaaaataaatgccataaatgcaactaacatcaatgctttaatgccaaaacaaaatataacgataaagaaacaggatatacctattttatgaataaccgtgtttaaatttgtgttcaagacgaaaaaaaaattaaatgtatattataatttgtattgctagtattattcagatatcctacaaaaggacttaaattttctctaaattcagagaatctccatggtgcagatgcatgatagaccacaatttatcgctaaattgtttttatgttaactattgctgtgtcaatgcacttatcgtactgggaaatataaatagaagtgcaactatgcactgccaccaatgatcaggtaaagtattgtgaccataggactaggaattgaaatgtgcaatccaaacaggtgattcagaatactccttaactctctaacaaatgagatagaagccacgattgaacagaaataagatacagtggactggcacatattggttgttactgcattctatatcctatcctaattcctacattcctatacaagtataacctatgtaggaaattatggccataaagcagccttctgatgcagccacatcaaccgttcgataataagttcagcatctgtatacgcacataaattaggcccatatttacggctaggcccagccagcagactccacactctactacccccgtcaactacactcatgtgactcgactcacaaccatttcttttccttcactaagtgcaattgtaaaatagaaactgacaccatccatggttaatcccatttatcctctctgcctctctataagattcttgtaattcctatgctcaattgatcattaatgcgagaagtcatggttgagtaggcaagcagacagtacccattgttattatcctctactactatcatctatccttccctccctcagtcttgagaaattatcaggtaaactcagtcccttactgtctgattttacaacaataaacaatttatagtttttacaacaatatgttgacatgtcaatccactacgccatgctaggtaccatccatttttaagtaccgggacaatcattcatttaatgcataagaaattaacagttacctgactttgaagaccatccagagcttgatcacagtctgagccaacaaaagcaccgtggacatctaaaagcttgaggcaaaaatttagcccaacctaaaagcagttcacatgttctaagtttaggaatggaccacacatgctttatgtttagggatgaatcaataaactaatcaagatcaggaatggacgagaagtttatacctcatcaagaaccagtgaattttcactctcgcctgcagggatactagtgatctgggtaatacaaaaaaaaaatctcaggacaagattatacatgaattatgaaatttattgaaaataaccagcaacttcttaacaaataagttagttgaataccttgaaaatcctgaagtaaacagaatctctactctttgtgaagacatatagatctgaagctgcacgctcatcttcttgaactggagaaaacatctgtttaacaatatcagatatggcatttatatacacgctaaaaactgaaccaaaaaattgaataaaatgagttcttaccatcattagcatctccttcacaagagcccaagtttcatcttcaacaaaattggatgaaaatgaaagtaaaggatttgttactttcacttccatactttcatctaggaatgctgcaagaaattttaattgttatcaatatcatcatgtagaaatcatcatagttatcaatattataattaattactgttgccaatcggattatataagtgtatctgggttttatgcagtggcagatccagaaaattggttttatccaaatctgccctggtttcatgaaacattttgtaacaaaatctaccgttctttgaaacaaattataaaacctaggattttgcgttaagaaaaccccaaaacaagggttttgaaaattttactcttatttaaaattgtaaaaaacattgaaattacctggatttataagaaacgatatgtgaatctctttcaatgtattgaacatatgacaaatcatcatctgatcaccttctgcccactgacataaggaaaaaaaaagattaccttaaatgaatgaaaataatgttatgcgtgtaaaaaaaaagcagattattcattatacctcaaagaagagacaaaagttgcatctgctccatttaagaaacacattgattttgtccgaaggacaagcatatgcctttccttgaccatcataaggaagcagaaatgagatgtttctcaagagagtcccatacctattaacaaatatcattttagatatcaactaaaattgcatttcatacatatatatttgtgtgtatgtgttccgaaagaatttaccgccgaatgaggttaggcgtataagcaataaccacatttgaggcacggggtctattatttgaattcttattttcctgcaatgaagtacagaaaagttcagagaaatgtgccaacaaagtctgcaatgaagtactgcaatgaattcaaatacagaaaagttcgaggtagtagtataatccttgctgctgcagtcaataaagtcttttccttagggaatcagtttccttagggagtcaagtcttagactacaagtcatagggtcaagtcatcccttagccagcaggttgcctcccacaatccttgcgcctgcaggataacacgcatcaccatgtaccactcagtgtagttggtccttgtcaacgtggggtagacgacagaacctgagctccacttgatcaggcgatcgacgatgacctcccttactccggcgcacgtggcaaggtaggggcaagacggagagccaccggttgcataggtcttcagctcttatggggagtgacatcatgccaggggtgtagcctcacccttataccacttgttagctgcaacagaggatgtagcaaacacgtgcgagagagagaagaatcgacaaaacgatgagcacacgtgttttggtgctttcgtataaaacttgcagcgttttctgcattctttccttcttttttttttcctttcttgcaaaacagagaatgtggacgctatgtgtacgatcccgtagcggcgctcccgttcgcgcacgtcgaacccaacggcgcacgaccaattcattcacgcgcccaagtttattcctaacaatagaaccctagatccctaaatttatccatgtccaatctgagttttctgaatattatgtgagaagtctgaatatgtgcatccatttcgagctcgggccgtgacaggaattacctcctcaagcttgcgtctgaaggcacgagctcttctacctcgaccatgtcgcagcctcctgcccccaccgccaccagatctgctgccggagaccgacgagcccatggcgtccttcctcctcctcttggcctcgactcccccacccccggctggcgatggggcccttcgcttgttcgcagcgcgtgtggcatccgccttggcctctccgacccggccgcccggatcgcccccgccgccgccgtccatgtcggcgccccgccccgccgttgttttttttttgtcttgtttaatctgctgagcagagagggcgtggtgacgtggtgtgaagtgtgtgatactacgagaatatccccttcatcctcgtctggatgggccagtatgggccgatgcttcattttctatgggcttgtgacgtccgtctcaaaatatcttggcactgggcttgttttaaaaagagaaataagttcactttttttttgcggggagaaaaataagttcacttaaggtcccttaatttgttgctcagtctgattttcgtcctcagttcataaaaccggatacaacacatccccaacttaccaaaaccgtgcagacgaggtccctcggcagtattgtgcccggttttggatgatgtggcacctacgtggttggtttgactaggttctcgtcccatgtggcattgacgtggcgcttacgtggcaattggatcttaaaaaaataataaaaaactatggaacccacctgtcaattacacacaaaataataaaaagggtggggccatgttgcagaggtcgcctccagcagcgggctggggcgaagcgagttgcggcggtgtgaactcctgctcccaccgcagctccccgacctcccgcggctgctgtggcgtcggcgataacaaggaggaggcaaaccgtcagttagtagcacaccccgagagttcaatctaaggggtcgtggcgcggagaagggcacattgatgcagcacgcattaacttggagaggcggtaggacacgctggaggaggaatcggggccagaggcgaaggaggaggagacgtggagggcgatggcgaccagcgcggcgacggcggtgatggtggtgcccgtcgcggcgagcgagagcagccaccaccgcatcgccgcccgctgcctcgttgcagtggcatcgcatccgccttgtcatggctaccacacgggagggagggagggagatggatccaagcacgaggggtggtcctccgatgaagatgttggcagcgaggatgaacgggaagatgcggtgcatgaaaacccccttcttcgccgacgccgcctctggcggcgacgcggggtcgggcacgacgacgggcatcgcgacgggtgcggatgggtcgcggtcgaaggacggaggcgaggcgactgcttctgtgagcctgaaatccatccaccccccctcccccggtgccaccacgccgccggtctcctccaagaagacgcctgcggctgccgccgcgccgaccatccccaccgcaacgcccaccaccccgccgacgacctcctttccccagtcaaggcttgcctccttgccccatcgctgagtccctcacccccgacgcggcgcacgccaagccgccgccgccggagctcggactgcccgcctcgctcacctgctctgctgcccacccgctctgctgcccacccgctcgtttgctgctcagaaagaagaagaagaagaagaagagagagagagagggaagaaggaagaggagaggattgaggatgaagaagagagagaagggaaaggaaagaaggaagtgaggctgacatgtggggccacgtgggccccaccatttttaaaatactttctgtgagtagctgacatgtggggccatggtttttattatctttctgcaatataattgccacataagtgccacgtcaatgccacgtggaatggagacctagtcaaaccagccatgtaggcgccacgtcagccaaaaccgccttcaaaaccgctgagggacctcatttgcaccggttttaatagttcagggaccggttgtatctggtttttgggttctaggacgaaatcggatttggtgtactcaaatgaacttattcctttaggccccctttgaattggaggaaaaatggaggaaaaacaaaggaattgaaatcctacactattcatgcctttgatttgtaggaatgtgaaaaggtaaaacgtaggaaactttcctattcctacaattctagagtaaaaacataggaaatttaacatctactctgacctattggaaaatttcctttgaggccccctttgattcaaagaaaattcataggaattttagaggattttattcctataggaatttttcctacaaagccctttgaatcaaatgaatgaaccctattgaatcttatgaaattcctatggaatgcctcttcccatacaagttttggaggaattttaacatgaggtagaacctcatggaagaaatcctttgagtctttatctctcctcaaattcctgtgtttttcctatggtccaatcaaacggtcattcctatgtttttcctgtgttttgcaatcctctgttttacacttacattcctgtcataatcatatgtttttcctattcctccgttttttcattcctatgattcaaaggggccctaagtctatctctctcatctgattcctgtgtttttcctgtggtccaattaaacggtcattcctatgtttttcctgtgttttgcaatcctctgttttacacttgcattcctatcagattcctgtgtttttcctattcctccgttttttcaatcctgcgattcaaatgggcccttaaaaggagaacttggcactaaggctaaagttgaaaaaagtacatgcgaccctcgtctttcaccgaattacaaaatcattcctaaaccaaaaaaccaatgtatgacattcctcaacttataatgtggctttgtttttgttttgttcgacgtgggtcaatgtgggacccacgtgggtcccataggcatatgggtctccatcttatttgcgagggccgacgggaaggaaatccggtgcggcggacggacgacgggggaggagcactgccggcgataggcggggagaaccggaggcttcgtgggcaatatcgccttcgacgcctccgatgacgagctctatgatgcctgcgaactcatcggccccgtccattccctctgcctcgccgccgacctagccaccaacaagtgtaggcgacgaagagatggcccgcaatgcctgccgcaacctccacggctacctcctgcgcggcctccttcagccgggccacgagctccgtgttgacctctccgaccgccccagcagcaggcgccgcagccaccgcgagcccgtcagcatggaggacgccgtccacgccgcgtccctcggcatggagtacttttgatatagtaatttgatatagtaattttctttgcattgcactatgcaacaaacatgctcggctcgaagcaaacattttgatatagtaatatgcatgcagtacttcatctccataaagcccctgaaagatcccaccactaacagcatgcatgtcctatatatagatcaggtttgtggcgatgctatccttccacatatatatttttttgaaaacaagggaagcttattatagatttttttacaccaactttattaaaaattaaagacaaggttcaagggaattagatccccggtacatcgctaggagcaaaataacatatagaacaaggccacccctttgacatataagggtaacctgaattacggaaacaactctgcggccgaaacaatacaacagtaaaggatgaaatagacaagggcaacggcgttgtcgcaacgattacattcaaaagcctctactacagtctacagtgacgtgcacaccacttgacaaatcagcatccccttcggctgtcttcatgggaacacatataattcgaggtttttagctgattcgtagattttggataggcttcaccggactccacaaacgattattgtggactccacaaacaatatctgaggagcgctaattgcaaacccaacgacaaatgccacattgacaaactatactcaactcgaacgaataacccgacacacatatatttcccccgaaaaataatgcttacatggagtaatagcaaacatgtgatattttggaggtttataatgtgcgtacacgctcaccaactagaaattgataagcttatactttgcactatatagtataccgctatgtactctctccgtcccataaaaaaccaacctagtactgaatgtgacatattagagattaacttttttttttggacggagggagtatatggagtatatcattagctaattcactagatgatgacatgcgctttgttgcaggatatatgttagatattggataaatgatgaaatgatttggattgaaatattatgaaaatgatttgagaatgatgatttaacatgtctatgtttagttttagaataaaataaattgtagacatgattattatatgcttacatgttaagcttcgtgtgtttaatgggttgatgtggcatgtctgttggtagattttagaagtgataataaatagtatgcttgcatattaatatttaggtgtttaatgggcattagctttatagaaagaagagattagccaggcgtcctgaaattaatgtgagctcacttaataagggaaaaaataaacaattagtgccctcttgcaataaggttgttgtatttgttcctacgagagagagaagatatatattccctccattttaaaatgcataaaatgtttgaccatttgtcttattaaagaatattatataaatatcacttattttattgtgactttgttttgtcatcaaataaaatataatctcaacttacacttttacatatttatattaaatttttgagtaagtcaaatggtcaaacattataaaaaggttaacggcgttatacattttgaaaaaggaggtagtatcatttttcacgcgcaagcttcccaaaccactgagcggtttggttaatttctataagtttcacaggaaattgctttcaaaaaatcatattaatcattttttgagttttaaataattaatacttaattaatcacacactaatagatcatctcgttttacatatatatcttccctatcttcttctttccctccctctcaataatcaataaaaatgtttttatttatttttacgatgattttcgttgtagcttaggagtatatcaaagtcagctagcaaatctagcgcttacccaatctaagaggagctcgtgaaggatgggagagagccaaccgtctcatttcaaagtgcgtgagaaatttagtccaagaggtgtgggagcctgcagttatgtaaaaatactctaaacaaactaaatgtttggtttcacattagtttattaataataaagaaagataatacttttgtttttaactgtcaaggtggttctattttgtttagacttagccacgagagtcggccggtggatgattgattgatcatctttttggtggtgaggatggttttttatttttaagatgaaccgatgactttagattaatgacccaactaaatcgctggcaaccaaacattccaaccaggcggacattcagcagcaaaggcatgagccaccttattacagtcacggggggccatagctaactgaaaaagagtagttcatatgtcacgaacaatccaattcttttggccgaaacagatgttggtaacactgcatcatcgagggtttggccttaacattcactaccagaaaagacgttttcccaggcggtcaaaacacgttttgacagacggacaaaccttctgcctgcatctaaacgatggtaaaaatctcctatttttacaggcggactatgattttcacaggcaacagttgggatcttttcagacgctatagtagccccgcctgcgaaaatactcgcggcaccataaaaaacattcccgtcagccccacccctccctaagtttcaaatcacaaatctcatccaggaaacaaaatccaatcactaacatccatacatcaacacaaaagaattggattcaaatccacagcatcaacttgcaagttaacatcaatcaacatgtaaacttataaaaaaaatcatcttcgccggcgaactcctttgcatgcggtggctgccgccgcccccctctcccgtcaggccagatctgggagggagggaggtgtccaccgccgccaccaccctcccttctcctcgtaggggccagatctgggagagggaggggaggggagccgcatccgcgccaccgccgtcgctccccctccttcggccagatctaggagcgggagggagagagggggagctgccgtcgccccttctgcgccgcggtcacctcgtccgcgccgccaccgtcgctccccatcctccggccagagctaggagcggggggagagagggggagccgccgccgccatcgccccttctgcgccgccgccgttgctccctcttctccagccagatctaggagcggggagagagagagagggggagccgccgccgctaccgtcggcccgtcctcgccacgtcaccgtccgcgcgttcgcgccgctgccgtcgtcgtcgctccccctcctccaacggggagggagagacggggagccaccgccgccgctcggattgggagggagggaggggaggggaggggaggagagtgagccggtggggaggggtggagaggagaagagaagtgttgagggagagatagagagttgagaggaaaatcagtggtggtcggtggggagtggtggtggagaagataaggatgacttaagatttattttaggtaggtatgatttttgcaggcggaccgcataaggttccgcatgcaaaaatcattttttaaggtgattttcgcaggcggacctcttcagtgatccgcctggaaaaattgattttcccaagcggatgacaaaaatccacctcggtttatattttcgtaggccaatatttgactccgagggtcatatccgtctggaaaaataaaaggacaacgtcgctaaaaaaaagttttttagtagagattgccaatcgagatactccctccttcccaaatttatcatcatataatgaaatttaaaatttatcaaattgatcatcatataaccgtatagacacggatttcatcagaatacaattaatacagcatgacagaatgtgtgcatgctaatgtgtaattgttatgatgttttaatcgatgcatgcattgtgggagaatgtgtgtacggtgtcttaattgatgtgattgaaattatccttaatcttggtgtataaacgtatatgatgatcaatttgggaaggagggagtagtgtgttataattttcattatttcttagttacaacaatggatataaaaatgttggttgtaaatttttgtctgctcaattgtaattaatagttattgtcattgatatggttatacagggaatggcatcaaacgcatattaatattcaatatattttattttcatctttgtaatgcatggtattttttaagtaaaaaataaaaatgagaaacttttaattctacgatgattttttttcaaaaaaaaggaaaagaaaaaaagaagactcaaaatgagtcaccgcccaggacctatggaaggcaaatcctaggctagagatcaaaatttgtgcgaaaaaacctctacagcttaattacttttggatatagagacaaattttgaaacatttatctgtcatcattttcattttcacatcaaaaaaaactagacaaagacattggaaaaaaaactatagacaaagaattttattcatatagtttaaccgtcaaaagcaaaatgatggcacttacggtcttgtccgtcaaatcgctgatgattcttaggattcaggtcagtaatttctttattaacgccatatttgaggatatgcaaaagaatgaatactacctccgttccaaaataagtgcagccgtgaatatacgtatccaacgtttgactatccgtcttatttaaaaaatttatgagaaaataaaaaaaagtcacacataaagtattgttcatgttttatcatctaataacaacaaaaatgctaatcattaaaaaaaatcaattaagatgaacggccaaacgttgaatacgaacaatgcagaactgcacttattttgagatggagggagtacgtttctcactctctctatatgtatgtagtactccctccgtttcaggttacaagacgttttgactttagtcaaagtcaaactgttttaagtttgatcaaagtctgtagaaaaaaaatactccatccgttttagattataagatgttttgactttggttaaagtcaaattgttttaagtttgactaagtttatagacaaatacaataatatttataataataaattagtttcatcaaataaattcttgaatatattttcataataaatttgtcatgggttaaaaatgttactactttttctacaaacttcaaacttaaagcaatttttgacttataacctgaaacagagagagtagtaacattttcaaccctatacaaatttattattgccagggttacggataaggtataccctttacccttgggtatatgtcatgcatcgatatggtatatctgcgcgtatatggacgttctctgtacacactaaggaaattcaccacggaatccacatatggaaagattcctactcggatagaaccgggtcgtcattgtatcatgcgggtccgatgtctccgagtcctacttggaggtcagttgacctgcagtataaaaaggatccccgggaagacctaagacatcgaatcttactatcaacacacctaccacagcctacgagtccggagtctacagaagccaagtcgccgggtgatctagtcgaaccaactcgactacggtctcgtcggtatcatcgaattctgttattccctttgtaatatgtggttttcactatataatctcatatcaactgaattggggctattacccatcagggggcctgaaccagtataatctctgttttctgtttcctcgatgtcgtattacgtagatcctcgtaccagcgtactccaataccctctatatccggtctacgggtatcccccgtcgataattatgaaaatatattcaattattgatttgataaaactaatttagtactataaatattactatatttgtttataaacttagccaaacttaaagtagtttgactttaatcaaaatcaaaacgttttgaaacaaagagtacatgtatttagagagatacttatatataaataaatttcttaggaaattagtttatttttatttatttattaactttacaatacctaattaacttcatgtacccttgaataataataaaaaaaatgagccgtaaaaagaaaaggcagtagttggtacctcgtacgttactcgataaggttaaagatgcatcaaaaatggcattggtgtaattatcttctctttacatatactgcatacgtcaagtcagaggaacgtggtggctgacatgtgagccccaccgctcacgggcccacctgtcagtgaccacgtcaggtgcgaggatccgctttcccagtagaggctccagtaggcaggttaggtcaggtcaggtacggacgcatcccctcgattcccctctcccctcactttctctctctctctctctctcgacgcgagcagatcagatgtgccgccgccgccgccgccgggcgagccggctggccgccatggagctgagctgcgacgcgcatctgcgattcgggccgccctcctcttcttcgccgaagtaaataatgcaaagatgagaatatgagtctagctagaggtgaggaactccgaactcccgatcgacctagctacccccctttaatcgatgcagaggcgcgcgctaagctgcaatttgatttcatttatttcatgcagtactagatacatatgtactcctgtatatttgatgaccaaatcaacttcgcatcgaggccgggttgcatacctagctaatatcaccgactagatctctctccttaattagtgctgcacttattatcatatcagattaatgaggggtttggtttgccaattaattaagttgatgaaaagaaatttacttatcgattcttaattcattagcgatgacctcccaattcccattagtatgctcttgagcctcttgactggaatcaagtagcagtacccaagcaactaatgatgaagatcgatctcatgggttagctagaaagaaagctcagaagttccggtatataatatccaacagtactagctcccctgcacccaaaagaagtggttcgtttaagtggtcatttggtcggcaaaagatgctaaccaccttaaccttgtatattggttgtgcgcttcatttggattttgccgttgtaagagtagttttcgtgatataagtgttactggtttggttgtgcgcgtactagttatgcacatacagggaatgttcttagacggttgtatcacctttgtataattggttgagtttaataaaaactttcattatctaaaaatatgtgtcaccgacatctagtacaagcatatcatcgatgttgggttaaccaaactatagcattttatttgtacctaattaggttattaccaattttcttttaaatccatttgtccgggctctatgataagaacacattgcattcaaagcttttctttagaagttcccaataatataatataccatacattattttggtcttcaacttttttccctcatcattacaatacccaagtccaatttggatggcaagggcactttgctttttcccaaaagtatatcatatactatctccatcccatatcatagctatctctgctattcacacatgcattaatcaccatctcaacgaatgtaaatatacgcttgaaaataccatatatcattgtacacatgaggattttgcataaatctagggttgtgaaacagtttaccccaaagagatagtatgttggtttttcttttttttttaaaaaaaaaggatagatcctcttgagccaggtgtacagaactattaagttaaggaaatactagtgcaatttgaaacaaacacttacaattgttattctagttttactaaatgaaacataatttgtgaggatttcttatgtggctccatatgaaccgagcatgatttaatagaggattattaatagtagtttagatcaactaaagttcacatttattattttttaaatatatttgaacaatataaatgaaatataaaacagcaataacctagcgagtttgtttgcggttatgccaagcggggcaatgagaaagtagggtgaatatataatttagggctcctttggattataggattttcataggaacaatgaagaattatactcatgaattttgtttgggacataagattttgagttttcaaattcttacacaattaatttatcgtattcctcaattccataggattataagcataggctcctttggaaatattgtttctttttttaaatactgggctggatttttaggaggggtagtttttacaagtgaggaactacaatggcggggagaaggacgatgacttcacttttcaagtagtacagataaataattatctccattctttctacatgtttgtgcattattacctttttttcatcaaaatcattaaaaaacaactacatgaaagtaattttcataacaaattaccgataccattttcagatattaaatattaacatatttttatattgtttgtgagttcagatttctaggtttgactacactcattataaaaactttatctattttagaactgacctcaaaattcctgttgtatttcatttatgtgggattcaacatattatataatattttagaactgacctcgaacttcatctatatacactgacgtcaaaattcctatttttttctataagctattcgtgtccaaatgaatgaattcaataattcgtgtcgtatttcatttatgtgggattcaacatactatataataattcgtgtgttttattcgaattcccatgttccaaaacacccacaaacaatattgaatttacatattattgcagtggcattgcctagcatgtactacatccgtcccaaaatatagcaacttaggaccggattaaacacatcctactaatacaaatctggattgccagtctaggttcacagttctaggctgctgagttcaaaaggaggggttaggaacccaacccttcaacatgtaaaacgaagcatggattagcgtatgattaattaagtattagcttaaaataacttaaaaattggattaatatgattttttttaaaaaagcaaccttcctatagatctttctttttataaaaaacacaatttaacagttcgagaaacttgcacgtgaaaaaacaagggaatagaagttgggaagatgtagtaaagaacacaccttagtatgcgtctaatcctgtcctgaatacaatattttggaacggagagagtagtaatgatatatcatgctgaagtagttgatgaagctgatggatgatagaagagaagatcttttcaattggcaaagctagtggggtatatatgctggcacactgctaattactacaactaggggtgaaaacagtcatagaaatttccaaccgattgacgctcgttttctactttaactagccaagcaatgtgaaaatggttactgacgaatactaaaacggtaaaaaaaaacgtaaacaattttgctatataccgtccgtttccaaattttgttgtattcttatgcaaattacctcttttatagtatactccctctgtcccataatataagggattttgaatataagggattttgattttttgcttgttttgtttgaccattcatgttattaaaatttttttggaattatcatttattttatttgtgacttacttattatccaaagtactttaagcacaacttttcattttttatatttgcacaaattttctaaataagacgagtggtcgaacccgtacgagcaaaaagtcaaaatcccttatattatgggacatagggagtagtatttaccgggtttctatttgtttcttta

SEQ ID NO: 75419 - DNA, 793 bp, Oryza sativa
ggtggtggagttgcttagagcggacgaaaacactggctaactttgattatggaccaccctatactactgatcagtgtgttacgtgcgcgagggactaaatctgaacgcaaccgatcagaaccagacttcacccgtatctgcggatatcaagctgatgtatatcttgcttgtgaaaccctttaccttctcgagccactccaatccgatctacgctggttattgtatgattgcggtggaaaataatttgttttagatccagtgtactgagcaagcaatgatgatttggctacgtatccattgcgtggccctgttgatgagtggctggatcattatcgcatgagcagatgcgaatgacaaccgattagtcgcgctaaggacgacgaaacgtatcccacgacacacataccttgagcgagtcgatgctctaaagacagccggagacaaagggtctgaagacagaggatcatgatgtccggcgatatctagctgaggtcaatggtgaggaacgatgtggtgccgacgatgttcttactgatcacgacacgtaatggaagttgtggtcaggtgtgagggaatgaactagacagttgcgcggatgtcccatgagattgcctgattatggaggcaatgcttgtacaaaggagtcccacttggatacgaggaacaagcatagtgcgtgagttggggcggacaatgaatgatgaccaggaggctctaggtagtagcttgaagcgacagaacctgcctctccaaatagagaatcttcttgcgattgacaagacagtttcagaag

SEQ ID NO: 75420 - DNA, 690 bp, Oryza sativa
  unsure (1)..(690): unsure at all n locations
caatggtggccacagtggtcactctttaaaatcctagtctttctcaactccctccgtagatgctgcatccgtcagtcggcccctcatcatcgacaggtcgtggcaaccacattcatcttccgctatgtggtccatattcgcaggtgagtatccccctttctccctgttcccgtgtttatagtttgtgccgcctctgtccaggcgatggccgttgcctttggttgacgccgcagtcctgtacgcagtctgccgtcgtttcttgtgccgccgattgccgtcgccggcgaccgtgcgcgtcaccaccggttgccatgaccggtcggccggttttgaatccaagtcgaacagtgcctacccgccgccgtaccgtccgttcggcttcccagccgatccggactgtcggtcctgtggaccggcggtggaccacccgtgtggtcccggtccacggtagaccggccaccttgagccactgccagtgggcccacatgccggcgcccccttcctctccctttgagccggtgacccatgggccccgcctgtcggcgccgcccctccccccttggatgacgtcagccctgggtattattgcgcaataatttattaaggactttttctttattagtaaaaacacagtttatcttataaaattcataagtaattcatccgaggtccgtntaagggctgcaggaa

SEQ ID NO: 75421 - DNA, 1338 bp, Oryza sativa
gggtagggatgaaaaaggagcggatacggacggataatgctcataccatattcgttttcatattttttatcggatacgaaacgaatacggatagctcgaatatggaaacaaatacggattatcttgaatacgaataagaatcgaatatgatcggacacgaatacggaaacaaatttttctcggaacacgaaaaccaactcaacttctaatagaaataaatatcaacatatataattagctcattttatataaaatgaggtataatttataaatattttttaaaatttaaataatattaatagtatggactaatgttaagagataaactactattaaaatctataaaggtatattgaaggttatagagttagaaagaaatggggtatgtctcatgggtcctgcggatatccgaataacactgttcaccggatatccgaattattatccgtatccgacggaaaccctgataccatattcgtattcgtatccgggagaaaatattcgtattcgtatccgtatatgaaatatccgagaattatccgatccgaaaggtatccgtatccgtttttatccggagcggatggaaactatccgctccgttttcatccctaggtgggggtagggtgtgagggggagtgttttagttattactcacaattggattattatgtctatatatatatatatatatatatatatatatatatatatataggaattggattatttgcacccgagtgcacatgcactcgcaatctacaccctcaattcccctgcacgaatcttgggactgatgataataggatgtaccatgcctgctttcctccctttaggcgctgcggaattgctgatggatggtgactttgtaccgtgtctttcccaaaatgcccttcatccactgaccccttcatctccatggggaaattgtggagtgtggacgcccctgttcttcaatcatctctctacccctctccagttctcaaatgcccttctgctcccgatcccccacggtcggacgaacccggtgagaaagtagaaggaaccagccgaggtcaacgtcgacgggagcctcgtcgccggatcaggcagccactttcatggccgctgcaccagttgtcgctctgcaatggcttcatagacatggggctcggctcctaggacctgcgggattggcggctggcgcggttgagctcccaagccagaagggaggaggagcaggctggcgtttttaccatgtagcactggcacggcaagcagcgaggtggctgcgatggtgagggcacgcgtcgaggcggccatgaggtgaggcatgtggtggccgcgttcctactttctgcg

SEQ ID NO: 75422 - DNA, 5702 bp, Oryza sativa
  unsure (1)..(5702): unsure at all n locations
ttacggatgaaaagaaaatccagcgatcagctcacagtattctagtttcttacttcgcatgtttaattaattccctacaagctaggaaagaacttttgcactttacttcacatttcctttatttttctcagcttgactttccattatcaatattgataattgatttcatttcaggtcataataaggaaaatttgtattttagcatgtcacagttcatgaattagataatatgagtgtgtgagaaaagggaagacaatgtgcatattaaatttccttttttttggtgattgtaatatactcatataatcgataatatgagtgatgttgcaatgcacagatggccaattggaaaaactaaaggtttatcattgcaaatcatattgatagaggatatagaaattgagatttttctagcaacacagaaaggaagaaattaaaaatatatatatatagcaaaattaaaactgataccatccgacaacaaggttttgcatcttggtctttacctgaattgacatctatctatctatcttctatctatctatctatctatcttctatctatctatctatcttctattatatactaaaagtccattaaacttcctacaaacgctcctagatcgccatgtggcgttcctataaacgctcctagattgccacgtggcgttttaataaatcctagaaattctaagaaaaaagcaaaacatctggccatcgatttttcatttaatctggtggacccaatattttaaaccattagatctttgttaaaaaaaacccaattcaatctataaaaaaaaattcccacgttacccaacggtgtccccatggacctgtatacgtacgcgtatcccgtgtaagtctttttcttttttcttcttcttatattcttaggttagatgaaaaactaaaaagtccatgttaaattaaagttgtaaaaatatatgctatttcaagttttattctaaatagcgcatctcatcaaaacatccattaaaaatattaataaattaaaattgtagattatattattgtatatctcttaagaacatagttaaattggacttatattttcaaaaaataaaaagaatttaaattatgagcagcgttctaaaaatttactcactccctactgtataatatacccaaatgacattattaaattatcatgaatatattttcatatattatatgttcctttattcatatatttttggaaaattaacgatcatatattttttgacaccatgtggatgtattttttatctcttaggcttcattcggtctacctcattagatgagcttatctaagacatgcgaaaaaaaagaatgtcgtcagcttaagattaattaagtattaaatattacatacttgaatatggatttatttgatctttttaaaaaactttgcatagaaagtatttgaaaacatgcatcgttccaggaaacatctcaccataaagggactagccaatccaataagattttagaactcaaccttaaatttactataaaatatatagtatataatatattttatcaattaggaatagaaccaaatatatcaatcatatatccctactaattcctatgtgtataagtttcatatacaaatcactatccaccaattatcaagtcatattaattacttatgaggcatccgtgcttaatgcacctaataattagatgacatctaatatgcagtgtgttatcaagtactgataatggacaatactaagtgagaaaccatcaacaaatgatatgtaagtattgataccaccaagccacaacaaataatagttgactacaaatatattggtattgggtaatagtgttcccacacacctacatacattcctaggatgccacgtgacgctctaataaattagggtaaatctaacaaaagttataagaaaaagtaaaacatctagccattgatttacacttaaactggtggataaattatttttaaccattagattagatatgttcaagtaatccattacgactatgactaaaagcattcctgcacttccaagatgccgcatgacgctctaataaattagtgatcatataagaaaaaatatattaagaaaagcaaaatataactgtttatttacacataaaccagtggatatattattttcaatcattatattatatctattcaagtaatccctcactatgtacgtacacaacagatgttataaaggaaaaaaagaaagtgtgtatacgatcagccccatcaagtagttttctctttctttctttgcagctctgagattttccacaaattgtgtatatgagtagcgaccactcctggcaaggctgttgaagaagccacgctgcacagcaccgctacacgccatctcgccaattttcttgaaagcattttttttactattaatgttaaaggcaatctcgagcgcatatataaacatgcggacacccatcataaaaataggcatacgcacacctacactgagagaaaaaatatttgtcaaaaaaagaggaaaaaaatatgtacttaatatttgccaggaaaaacatagatatatagcatcgaaaatgtcgcatgtaaccacattatatctttttaattatatcattcccatctatataatgatatgctaattattaacattatagattattccatcgtatattacccatgaacatgcataggtgaaaaaacaaaacaaaaaatatattaactcatatgttagcgaatgatggtgatagacgagtttagatataaccggaacaattcgcatccgcactttcattatagtttaagggtgtaattcagactattaccttttaaaatagtcacttccacataataaggattcataatacaaatttaaccaatactaatttagtaaagtgcccgcgcatgtgcgcgggccaccttcctagtttatgaattaaataaacataaaaaaattctaattataaatttaaggtcctgaagatttgcatgctctgaaaccttttcaaattataccatcatataattttgaggaacttttaagccatgcacctaaatatctcttttgtagatcaggcttacaatgaatcctaatccttcgtattagtacatatatttacattgtttctcatccagatgcatacttcttaatagtaaagtttgcgttagtaaatttgatgggaataatcaacaaatccagaaatttatagctggtgagtaagtcattgaatcaagtccttttttttttttggtttactgattgaaggctagcataactgaaacgcacacaaaacatcgatgtttgacggaaatatcaatctttgtggaactccgcttcagaagaattgatcaggcaataaaaacaatattgagcatacagtgaacagagaattggaaactattcatagacttaattatcctctacttcggacttttgtaagagtttgtggttggcctctgagtggtgtcctgcactctgccgttaaatcaaaagaatcctagagagtttttgtagtgtttattgttcatacctagggcaggttagctaatgggtaacttccatttggttctgcaaaccaactaatgccgttgctgcagccaaaatacaactgtctgttacataatgacagcaaagaagtaacgttgtatatatatacagtagtttatttttcatattccagtttagcatctttttcttgacaaccgaaactttattatattgccattggcagggaatgagcaatacagtttgactcggtacagtctagcccagtagacacattgctacacaagagagacagaaggagtatgttgtcaatatagtaaactggaggtgcagtagaaaaaaaacatatgaaatgagaagctccaatgtgttcttaatttttgtaggtnttcaattcgttaagntntnntggttnttaggtttcccccggttatcccggggggaaaaaaggggccccttaaattnttgaaaanantattnttcttaaaaatgggggggtttttttccccccccctttaggccaagagcttatcaaatggatctatcgacgtttgatgtcgcgattccggtatttgcatggtatggggatcgttggtactagggtatacgcgagactgaggtaaaagagacagagacaaggatttttatacaggttcgggcccctgaattgtcagataataaccctacatcctattggccgaagccggtattgctcttattcaccataatcacaccagtataatacttggggtagcctatctaactgttgtcgtcatggcggtctgaaggtctgactcgtagtcgacgacagggtagtcttcctccttgaatccatgcccggcgagatcagagataacgctttcgtctctcctgacagtatccggagacaccgtaggggactagccgtgcttatccctgaagtcgatatccggcgtcttgtcttggcgtatgttggcttgtattggctttgtggcgtctatgttgattgtggtgggtgtcgattgtccgtatcccctctcctcctagggggccttgtatttatacccataggtgtccccttgtccaagtagaactagggaaaccaatatggatacaatccgagtagtccttgtcgtttccatgtagaactctggttatccttccttatgcggaacttctcctatatccgtaggttgtttccgtataggacatggtatgtggtgggtcctgccgagatttaatcaactactattaggtatgtggtatccataaccctgacaggatccttgagctagctacaggcattgtcaattgagaaattgttacaaacaagagaagattgtctgttagtagtcccatcatgtttatactcataacagattgttttagccttccaaccagttttgcatatatcatattgttaaagtagatttaaagtttattactatttttttataatcctccaaactttgcaaattgaaacaatttatatcacgagaaaaaaaatatcagtcatacaagagcctcagtagcacctgaggtcctaggttcgactccccatgggagcgaattttccaggatttttcggcgttgtgctttcagtggtaggcgacgtatccgtcgacagcgaggcgcctatggtgacttcgtcaatctctccaggatttgctggctcagtcttcgaagatgtttataggggtagggtttgcgtgcgtgtgttcataggggtgagtgcgcgtgcgttctgagtgtatgtgttgtacagtgtaatttaaaaaagaaaaaagtgtcagtcatacggatagctactggtcgcgcgaatgcggaattttttttatttttaattttttttattaaaagttttacaaaagtaatttttcattttaaattgacagaagtggtcgcctaccgccctctgggagggctatttttaaaaatcgccatcccagagggcggcgaaagtcacgtggcagaggcccgttcgctctcgggcgacgcccgtcaacgaaatttgcaggcggcccccttgccgccttccgctagggcgattttgtagtgtgggggggccgcctgcaaatgggcggcggggggcctggaattttgcaggcggcccccttgccgccctgggggagggcgatttttgcctcccccctataaagcccagccctctctctctgaaatttcattatattcagtaaaaatccaaaaaaaacgaaagagagag

SEQ ID NO: 75423 - DNA, 21556 bp, Oryza sativa
tgttttcatcaggcacaatgtcaaataaggtcacattttagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgcgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcgataatgaggaagcggacgacgacgcatcatccgatgaggaaggtgatgtaatggccactgattgggcaaatgaggacttctctggacttgttatattagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagagcaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattacagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgataccgatggatctcggtatggcataatgacaaccaatttggcagaggtgtacaactgggtaatgcgaggagttcgggtacttccattggttgctattgttgaattcatcattcacggcacgcaagcctactttagggatcgatacaagaaaattggtccgtccatggccgataacaacatagtgtttggcaacgtagtgacaaagtacatgaagataaaatcaaaaaggcacggagacatagagttgttgctcaaggcacacaagtgcatcggtatgaaataatgtgtgttgataggagcaggcgtggtatctatcacaagcaagtcgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtggtctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgttgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgtatcgtgatgagtgttcggactaagtactcatatcgtgtaactgcagttattgttgtaatcagaaatattccgtatggtgacacttttgtttgtttgtactcttgtttaatatgtgttaataattcgcttatgaacatttattacttatgttgaactaattatttatatgtttctgatcaatctatttgatgcaggtatggcgtacgacacaccggcgctgttcaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttacgtgcggcaggccttctaccactttgtaggcttgttgaggcggcggcggacgaccgtgacccagcgaagtggtggaatgcagaccggtcactccttgccgctctggtagaccgctggagacctgagacgcacacgttccaccttccctgtggggagatggctccgacactacaggacgtgtcgtacctgctcgggctaccgctggcgggagcaccagttggtcccgtggacggtgtttttgggtggaaggtggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttcgggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttacaagtttatcagtcgtcttctttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtatagttcttacaattatttcatttatcttgcataatataggacaattactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcatgcggtcatgcgcgtcttctcctgtcacagcgccgtggacgtcgtacctccagctggtccggtacaaccacggcctcgcgcgcctaccgtcggagcaggacctcgacctacggcacctgttttgcacggtactgctcagcccaaaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcagtggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctctcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggaaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacacgtgcttacccacgtagtgaaacaagatcggactaactaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactccttagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaacttaataacattactatttttacagggcaatccaaggatgtgtggatttactcgatggatcgacaatgtcactccatcatatcatggacagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaaatttgtacggtaacattccaaataggccctaaaaaataataaaattatattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggtcgcctgcaaatttcgttgacggccgtcgcctgagagcgaacggccatctgccacgtcactttcgccgccctctgggatggcgatttttaaaaatcaccctcccagagggcggtaggcgaccacttctgtcaattttcaaaaatgaaaaattatttttgtaaaacttttaataaaaaaaattaaaaataaaaaaaattccgcgaatgcgcgacttccgtggctggttctaattggtggagatccagattctggtaggccatactaatgggccgcacgatccaggcagtgacgttctgccctcactacaatgggccaacggaagctgtccctgtacggcccgtcgctactgttgtttgcagcgtatacatggccacgcccacgcgcgtcccggcggccacggcacggcacggcacacacgcacccgtcgactacagtaaaaacaacaacgatacgtatacgatacactcgcacactcagatacagacccccccggttcttactagtccaccaatccaccatgcgtcccactaccaccgccgctctcctgatcctcagcgtcctcgccgtcgccgccttggccacgaccaaccatgaagtggaggcggcggtggccgcgctgccacgcggcgccacacgccgtccggcgcccgcccacggcaacgtggcgacggcggccggctgctcgccgcgggagcgggacgcgctgctgacgttcaaggcaggcatcaccgaagatataatgggtctcctcgactcatggaagtacgacggcgctgggcctgggcaggcggaggaggaggccgattgctgccggtggcgaggcgtccggtgcggcgccggcggccatgtcgtcgggcttcacctccgcaacgtgtatgccgaccagagcaacgactacgacttcatcacctccgggtacgacctggccggcgagataagtccctctctgctcaacttgacgtatctggagcacatcgatctcagcaagaaccagctccagggacagaccggccgtgttccggagttcttgggctctctgcaaaacttgagatatcttaacctctccggcataccattttccggtgaggtgcctccccagctgggtaacctcacaaatctacactatcttggcctgtcagatacaggcatcaacttcacggatatccaatggttagcgcgcctgcattctctaacgcacctcgacatgagccatacgagcctcagcatggtacatgattgggccgatgtgatgaacaacattccttctctcaaggtccttcatcttgcttactgcaaccttgtttatgcggatcaatctttttcacactttaacctgaccaatcttgaggagcttgatctctctgtcaactatttcaaccatccaattgcatcctgttggttctggaatgcacaaggactcaagtaccttaaccttgggtcgaccaaactctatggccagtttccaaacgttccaggacaatttggatccctacgatttcttgacttgtcatccacatgtaacatagacatcgtgacaacaaacctaacaaatctatgcaacttgagaatcatacatctcgaacggagtcaaattcatggggacattgcaaagttgctacagagattaccgcggtgctcgtacaacagattgaatgaactatatttgtcagacaataatatatcaggaattctaccaaatcgtctggatcacttaactagcttggtcattcttgacatctctcataacaaactctctggacccttgcctcctcagataggcatgttcagtaatttaacttacttggaccttagcagtaacaacctcaacggagtgatcatagatgaacactttactagtatgagaagtttgaagacattggacttatccggtaattccttgaagattttggtggattcagaatggttacctctatttagtcttgaggttgcattgttttcaccttgccatatgggccctcgctttcccggttggctgaaacaacaggttaatattacttatcttaatatgtcatttgcgggtattactgataggcttccaaactggttttctacaacatttttgaatgctcaacttttagatgtttccaacaacgaaatcaatggtagcttgccagcgaacatggaggttatgactacattatctagactatatatgggatcaaacaagcttaccggtcaaatacctttgttgccaaaagcacttgaaataatggacatctcaaggaactctttatcaggacctctgccatcgaactttggagatgaccttgtcttatcttatctgcatctcttctccaatcgtatcactggccatattccaaactctatgtgtgatttgcatcaccttgtttacttagatttagcggacaatcttttggagggggaatttcctcgatgtttccagccagtgtttttgagtaagctatttgtcagcaacaatattttgtccggaaagttcccgccatttttgcgtagtagacataatctagagatgctggatttggcatcaaatgacttctatggaggattgcccatctggattggagagctgtcgaatctagcaatagtacgactaagcaataacaatttctctggaaatattccaacaagcattaccaaccttacaaggcttgttcaactagatctatcaaataattctatttcgggtgttttacctttgcatttgtccaatttaatatgtatgaagaaaagtggtcattgtgatatcgtaatggtcttcgatcgttactcaatttctggtcgttatggtcgcaatgttggcattgcaaatatgtctgtggacaccaagggccaaaaactttactacaaactacccatagtattagatatcgtgaccattgatttgtctttgaactacttaactggtgaaattccggaggagctaactcttctcgatggcattaaaaatttgaatttatcatggaatcagcttagtggaagaattccaggcaacattagtgtcatgcaatcattggaatcactagatctctcaaaaaacaatctttctggagaaatcccatcaaacctatcaaacataacatctctaagcaggctagacttgtcatacaaccatctcacaggaagaataccatcagggggtcaactcgacaccctctatgcggaaaacccgtctatgtacaatggaaacactggtctttgtgggtatcctcttcggagaaattgctcagacaacagcagtgcatcaaagcatggtgttgaacagagaagggaaagagattctgagccaatgttcttgtactctggacttggttcaggatttgtggctggtctttgggtggttttctgtaccatcttgttcaagaaaacatggaggattgcttacttccgcctcttcgacaaggtgtatgacaaagtgtatgtgtttgttgttgttacatgggcaaccttgtctcagaagtcaggcacacgttaggctattgcgtagtagcagcgttcttttggtggaatatattgtaccacgtcgctgctgctactactactagtactactgtcgctttgaataaatcgatacagcttagttcttgataaagatgagcatgcttaatgtatgaaaaaaaaagagagaagttaatgttgttctatttatgtgaaataaattaaagatggctgtttctcaatgttgtgcagagattaatgttgcttaatttatgtaaaacagagatatgtctgacgaatgttattgatcagtttgtagcactgccgcactggtgaatccagagtttttttttttaatgactcgcaccagacagtgcgaagtttttttgattgagcaggaaaaaaaatccaagattataaccctgggaagtcgtaaccaggaaaaaaaatgaaaaataacccccacccacgcaccgatagctccaactcaacatacctaggagaaagctagcaccgaaccgaccgccgctatgcgtgaccggtcaccgctaagccaacaaagaaactacatccgagaacgttcaaaacttaaccctaataaccgacaccaggccccactctagccacctctttgggattatgagagagaaggatggaaccgttctcccccctaggccctccgacgtggctaccttgcataagctagagcgccgacgaaggggacatgcatctagagcaagcttgcaccagttgtctggaaggattcggcaaggggctacctagacggtgtctccaaggagaggagcgacggatacacagccaccgtcgtccgtcaaggtctcaaataaagtcgaggctgagttttcacccggcagccccactggaggtgaaggggtggcacgacattgccctcaagaggggtagagacattcgaaaacaccgtcgttgccggcacggccaaggccgggctaggttttcgcccgctgcctacgagtctatagatgacaccccgatgctccaccaccatcaagcctccgccgacgcatgggcactgctgcatcagcgccccctgttggtcagcctccgcatgccacactagcctccgccgccctccgaccgcgcctcatcgcgccgcgccggcctccgttcctattggtcgtgcctcaacgagctgtgccggcctctgaccacgctccgtcgccgccacccacacctcataccgaccggctagccacgtctccaaccgcagtccaacaacgactgctcacgccgtcgttgttgcccacaacccaccaccaccgatgccacgcccgcacgcggccgccgctatcctccttccccgttgccagtctcgttccccgcctcctctctagttgtcaccatcgtcgacgcgccggtccaccgcgtcccatctcctcccgtgcaccggccacatcccatctcctcccgtacgtcggtgcagctccagccgacctcgctcccaccgctgccagcagccgctgtcgccatcaccacccactcaaaccccatcgccatcgccagccgccaaccccgctagatccagccaaagcggcagcccgatctgggtgtgtgctccgccgccaccaacgggcgccgtcgccaccgcaaccgaccgccagttgccacctccatcactcagccccgccgccagccgccaccccgtcagatccggccggaacgacgcagatctagatggttgccaccgccgctgcccaggcagctcccccggccgtccgggtgcatgctgggcaaagccccgccaccgccgtccttgcggccgcgcggctttgccggcgcctgctcaggcggcggcgagccagggaaaggagggggaggagggagtcggcagcggtgttgcctctcgtgttcgtgttgtgaatccagaatattgaatgcttctccaaacatgcatgtttgcgcttgaaatataatgtaaagtgacatagtataagatatgaacaggaccaatccatgacagtttgaatcgaagaaacgtgcagacttttaattttgtccaataacagggcaggctctcgaaaagcttgtaaattctgatattgttgatcaagataattttgttttcgaagaaccttcgcaaaggacatggagttcatgccaatttataagataaacaataataagatgtagtgttaaagtcatattttacaagttactagaaaaaatgccctatgctattttaattttatttatactgtttagctagaaaaaaaatgtttgcgtgttgcaacatgtaaatattttaattttattattgttatacggtttagctaaggtaaaagttactgtgggaattcgcttggatatttttttttagtaaatcatgagcttttcatctcatgttaacatgcgaatttttttcttcaaaagatttcttatacagctccttttatacttttaaaaggaaagaagcttaaaatccaactcaaacacggagctgtatttgcaaaagcgaacgaacttaaaaaccgactcaaatacggatgacgtaccaaaatatcggcaaaaacatctttaatttttataacagtagagataagttgttatacttaggataaaatttaaattttagaagtggaacagaggggtagctccgaattttttttatctgaacacatgcaaaccactaattacaaatctgagcacgcaaaagttagaattctacttctaatcaacctgcccatgtcaccaccgtaaatccggttggcccggtagtctattacacctccctcatttcttattcggttagctttggctcagtgccatgacggtagccttaacacgatgatggtgtgcgtatatataaaccatctaggataacctttggcaataacagtgttagcgtggatatagtgtaactaaaattcatcaattctgagcacatgggattgagcaaactagcatgcagcaaacaattgatcgactaatatgaatcgctagtattgagaatttagtagtacaataccgcattgtttgtattttctttgtgatttgaacaatgaataaaactcgccgtatgcaaccctaaaccctatgattttgatatactaccggatgaatgatttgaacaatggagaaaactccccataatgatgcaactaaccaattttagaggtgggttgttgggctaacgtgatcaattcagcagcccaatacggcccaatagtttgttgggctactcgttcgatggaaacatatcgctgcatatgagcatcttgtctaaataattaaatgtgattattgcgtgctcacatttgtaattggtggtttgcatgtgtttagataaaaaaaattcggggagtagctagtaagtgaaaaactcctaagagggcaccttcagtaaagggcattgctggattcaacacgaagctagtactagcgctgacgatcagtacaactgataaagaggttctaatttccaaactgataaagaggtttcaatttccaaaggtttcactctcagtgtcaccgcaacgcgtggaaatatttgcaagcctgaacgcactgaagataagaataactaatgtgaggttccaatttacaaaggattcactctcagtgtcactgccacctccaatacaaggaaatgatgatctctctcccaagtctcgagagtcttgaagtagatctgaacgcggagctagaggaaagcaggcgtgcataatagagaaaccaactgaagcagctactagtggccatcggtgatcaaccagtagctagcaggagttgccggcgacgtgccgctcggtgcaagtcttcggcatcacattcggcacaactgcccaagagctcgacgttggcaatatcagttcttttctggcagtcgcagcccaccacgaaagtcagcccggtcgtgtacgtactatccgcaatcaaaatcagtatcggcccaaatctacatgggcctcacgtgctcggctatcctgatccggctgaattaaaccgaggagattgttttgtaggaaaaagtatactttgactaactcatgtgattctgttgatgcgaaaaacacgaggcctgggagatctgcttaactttagtgaaggtccaaaaatcttgtctttgaggtttgtgagcgtgccggttgatttgatcctgcaatcaacaagaaacaaatacaggaaaatatcacttaaatccataaacgatagccgatcggtcagtcgccaatgacatatcatttatccttgagccgatgtcatctttgcatcgatcggcagtcatgaataaataagaaagaactaaatctattcaatcggctgtagatattaatggtacataatccctatgttgatatatatttaagtcaagtgattgggatagatcgatcgttatgccgagacagtataaatcacttagatcgaaatatatattaacaatgagattataagcgctcatagcatagccgattagatagatctagcatgtatcggctaatactccgataccactctatgttaagatattaaagcaagcaaaatatatcaaacgagaagcttaatatacctgaaagcaagaagatctcaatataaagggcggatctagcatatcaattaagcacataaaatataaggctaaatcaggtaagatcggttgaaaccccgatactaccctaatcggcaaccaaagacaggctagagattgatattctaatcacgacttatagggtcaaactcaactgatgcagctataagtatgaaaagaaagacaatatttagacaatcaagtcgttggatgtttcatagggtggtggataccctatataatctaagtcaacgttggtatttaacctgatcggctgccttctagtgatagatgttagccaactgaaggttaaataacaatattgtcagagattatataggatatatgataactcgacaacttacatacacaaggttagagtgtcataaagatggaagcactaatcccgagaacgcaagccaccataacaagttttacctctagttgaagatcgaaaccgatgcagctcaaactgaaagcaagaacccgtcgaaataaaacgaaagcaaaaagggtggcgatgtgtcgagattgtattgaacgtgtgttaatttgattacatagggctcggggtctatttatacccgagaattacacaacatgtccatgtcggacacgactcttatctctaacaaactctaagataccataagtctttgcggcagacttttgcccaagcttatctctaaggaaattacatcaaatatcctaattaatagatacaattgtcttctcagaactcaatccgtgcatggcaatccatatgaagtacttcaacccaaccctgatgacgtataccaagtcgtattgtcgaaatcggctcaatcggctaaccttgtccgactcgaactctgtcgattctggtcgcagccgattcgaacttctgccgattcttgctctgtttccggaacgatctatctcttggattctgcttcagttttatcttcatctccgataccgaaattaccaaatttggtcgttaacacatgccccccaagtctggaatatttggtaatgtttcggatttgccatattttcatctccaagaatatcgctcattgctgtttttccgaccgttaccgcagcgctttaaatactaaccgtcacccccgagaaatttcacaccgttacttccgttctcaccgcttaaacaaactccgtcttctctttctccggcgatctccttggcgcaaaaaggcgacctcaaggcgatcccaactccggccaagcttccgcctgcagcaatgtcgacttccgccagcccatccgccgcgccatcggcaaagtatgcagaggtgagcacccatcggctagatctctattttgtgcagtagatcggttttcctctatctcatcttattttcttcttctttattctcttttgcatctgtagcatctctctaatctgattgcaattcccagtttgtctcacgagcatcagtactttcttggcccaatcggcaattctaaccccactgagttcattagcgccgaaactaataggataccctttagattggccagcccaaatctaggtcattggaagaatactttcaagtcttggccttcccttgagaaaagttctcctgagagaagttggctcgtatggtgcaagcgtgtatcggctagcaagcaggttcactgggatgaactaggaatcggccaagcccttgctcttactttagcaaattcggctaaggacgaacccctaatggcttctgcaacgtatttctggtccaacaccctcaatgccttcctgttcaatcaagggccgatgactcctaccctgctagacatcaccatgatcactggcctagatatcaccgcatcggccaaccccatgaatttgaattccaagaaccagtttgagttcaaaactaaaaccataggtggctggtctggctacattgctgcatatatgggcaaaggatctgtcacccctcgagaacatactgcctttctgctcatgtggcttgagaaattcctcttctgcggatcaagttgtggccctactatcaattggcagttcctagccgaagcccttgaaaccaaaaagcaaatcgctttgggcaaaatccttctcgactacctatatcagacgttgatcaatgcatcggccaggatagccacaggctcaacagtagctgcaggtggaccctggtggttcctacaaacatggctcaacttagtcgccatgaaagctgtgaatcggccggctctatcagaatctcagtttccaagactagagccgattacagatgaagatggggaagaaaagacccatcggagatgcatgtcgtatggagaagctgcttcaacaccagccgattctggagctaagttataggctgagctactgaaggactggttcttcagtttttatgatggcttccggaaagatgctcgagtctggtttgtatacggagattcaatggactttgagctaccatcggactttagatttgaagagatcaactctgaaaaatatgacaagtctagagaggtcttctcggctgctatcagtccatgcattcttcctgttggcatccatcaaggaagaaacatacaagtgtcttacgagttctatcacccaatgagctcggccaggcaatttgggatgggacagctgccaatcggcttgtattttgccgataaaattcagtgtagaggagagatctcatcgaccttgatgatggatcggctgctcaacatcccaagacctcccttgggcagtattgagaacatagagctggcaaggttcaggagcagggcctttgataggtggtggggtgaatggaagctacacttgttccatcgatcggcttccatgtatatgacagatctattcctggatgtcatccctcaggtaaattttactttgtcaattctgctaaaacaactgttagctgacttgtatcttgactaatctcttcttctattttgcagacaacagaatcctctcctcctcgcaaagacataaaatatgctccaggccttttaccaaacggaggtggtctagctcccccagtcatcggctatcatgcccccaggacctcaagtctgctccaagggcaaataggagaactagccgatgctggcaggaagaggaagactaaggcatcggctgttgatccatcggttctggctctgaagaagaaggccgaaaagaagaaatccaagccaaccgacgacttgcctgccttagatccatccatcgaacaagccttcgatgaagaggaaattgaggaagatgacgaccaagcggcagccgaacttagtgacttaggagaaaaaacaccatcggcttcgcccaaacagactcctccaactcctgctgccccagctcatttttcaagggtaaacaactcatcttgatcatttctcgaaacaacttgcatagccgattacttattagccttgtatttgcagaaaaagaaaactatcgtgaagaagaaatcggcaccgacaccatctaagccagctccaccggtaaagttccctctgcaaaatcctttaaatctgatcgtaaccggtgttaattaacacttatcttttttagcctcctcctcatccttcacctcctgtgcagccgacaccaagtgattgtactccatcggccgcaggcagccataacatcgaagaagaagaacaaccagcagctcctgtcattccagtaagcatttcattgtcataaatcttagattggctatataatttgtttcgatatttaactgtcttcaattttctctcttgcaagtcttagccgatctgttctctttcgatataaaggattactttgacgaagaggcagaagaagaaacaaccaataaagctttagcccctctgaccgatgatgtgaaaagaactcttgaagacatttctcatcggctagagacatcattagacaacttggtggttgactgcggttcaatccggacaagatttgcagagattcaagccctaatcccggatgatctagcgaaaaccatttctccagctgtataccttgagcaacatcaattcaagctggaaaaggccaagcaaaggatagccgatcggcgagagcgaagagatattgaagccactattaaaaccaaccggcaaaccgttcatgaagagaaggctaagttagatcaactctcgattgggccgattcagtccaacatagatcggcttgaagctcggaagattgatctcatagctcaattggaggaatgcaacgccgaattggctcttgagcagaaaaagttagccgatctcccaaaggctgtcgaagaacagaagtccagactgagatcggccatcaggaatgtggctgatatgaccaagtctctcaaggtcatctctggaatcgacgcccaagatatccaagctatcgaagaagtagaccaaatcagacaatgggctgtatcggctatccagcgttacttgtctggatgattatctttgtaataggacttagaaaaaaaacatttttttgtaatcggctaagaaacctttgtacttcttctgattggctaatccttcgtgccgattaatataacatctcaatttgcttgaaacttctcaattttcgtatatatgtatgtgcctccctaattttacaacgatgaaggcattgataaaattataatttggactaacggcgatatattaaatatcggccatcatacatcggcagaacaaaaccgattatgagaaaacaacaaaaaccactaagggcaatataaccatatcggccgtcatacatcggcaaaacacaaccgattatgataataaaactgctaagggcgatataactatatcggccatctaaaggcgatgtaaatacatcggcttaacatgtatcggcaaactcagctgatcatgaattgacccaaacacttggataatatttcttcaagtattttccattaagtgctcgtctataaacttctccatcaagtccttgcaacatataagctcctttggacacaaccttatagatttgaaacggtccttcccaattcggctaccacttgccgaatttgttatctcgagttcctatcggcaagattaacttccaaacaagctctccctcagaaaaagacatagacaccaccttcttgttataatgccatgcaaccctttccttatctttgaaaactttagcaagagctcgcaatcttgattgaaccaaatcttccttttcgtcggccatgagattataatattcatcggctgtcaattcattatgtaaatttgtcctcctggagccgattctaacttcccatggtaaaactacttcctgcccataaacaagcttataaggaggaacttgaatcgatccatgacaagccatccgataagaccacaatg

SEQ ID NO: 75424 - DNA, 3199 bp, Oryza sativa
atattgatacacatcatacctccaatcatcggctgatattgtagcaacttctatcttgatatctctcatcatcggcttgtaccctgatgccccctgagccaaatcattagcttcgacattttgctcccgagatacatgcttcaaagttaccagccaaaatccatccatcaactctctgcacttctcattgtaaaccatcaatgtatcattcttacattcatattctcttgccaattgactgatcaccaacaaggagtcacccataatttcaatagcatcggcttcaacttccttaagcaattgcaatcccttgagaaccgcttgatattcagcctgattgttagttgcatagggcttaatagtataggcaaactcgaaacttgccccccgaggagaaattataaccaagccgatactacaaccatgagtgcacattgatccatcaaaaaataaagtccaaggcacaatgtcaactgagccgattgaatcatcacgatgatccacaataaaatcggctatagcttaccccttaattgccttcggtgactcataccgaagatcaaactccgttaaagcaaatatccacttcctgactcttcctttcaaaattggagccgacagcatgtacttaaccacatcggctttacatatcacagtgcattcattggacaatagataatgccttaacttcgtgcaagagaaatataaacacaaacacaacttctccacaggagaataccttgtttctgcatccaagagcctgcgacttaaatagaatacagccctctctttcccttcaagctcctgaatcaaaaccgagccgattgacttctcaccagccgatagatataatctgaacggtatccccttctgtggaggaatcaaaactggtggggaactaagatattctttgatattatccaaagccctctgttgctctgccccccaggtgaattcttgatcggctttcaatctcaacaaaggtgtaaaaggttctaatcttccagataaattagagataaacctcctaacaaaatttatcttgccgatcaactcctcaacttcttcttgtcctctggaggatggatcttcttaattgcattaatactcctttgagtcacctcaatccccctctcatgaacaagaaatcccaaaaactggccaaccgatacgccaaaagcacattttgttgggttcatcttcaaaccatatttcctagttctctcaaaaaccttcctgagatcgactatgtggttttctacttcctttgacttaacaaccacatcatcaatataaacttcaaccaaccagccgatcagatcgtggaatatgtaattcatggccctttgatatgtagctccagtgctcttcaagccgaaagtcatcacaacccattcaaacaaaccgattgcaccaggacatctgaaagctgtcttatgaatatcctcttctgccataaagatttgattgtaacccgcattgccattcataaaacttaatatcttataccctgaagcagcatcaaccaactgatcggccaccggcattgggtactcatccttcggagtagccttgttcagatcttgaaaatcaatgcacaccctgactttgccatttttcttgataactggaactatattagaaacccactcagcatatcggtatggacgaatgaaaccagcatcatataaacatgcaacctcagccttgacaacattaagcatatcggctttacatctccttggtggctgctagtatggcctaacccctagtttaataggaagccgatgttcaacaatcgatcggctgagtcctagcatctcataatactcctaagcaaagcaatctctgtattcttttagaagctctatcaacttggttctgaattctggggataagttcttactgatgaatgttggccttggtctatctcctagacctatgtcaatttcctccaaatcatcagccgacatgaaaccctttccttgcttgtcatcgagatcatctactgtatccttggtgtagacgtttgaaccctccacgacgccctcaaaataataatttggactctccatcttcaattggctgtatatcacaattggacacttttagaaaatctccatcccaaacttttccaataggcaatcaataccatccatctcccaaagagctaaatcggcactagcaacattaactgacctatcggctagcacaatctcaatcttgtcaccttgccatttaatcaagcattgatgcatggttgaaggaatacaacaattggcatgaatccaatctcttccgagcacacggtatcgaccctttccatccattaccaaaaatggtgggggcacaatttttttggccaatgtcaaatccacgtgaaaaactcccttaatctcccatgggttggcacccaaatccctgagaaccattttccttttgagcaatcattttcccttctgtccagctttatgaaagtagcgtttgggatgcaattcacagcagctcctccatcaaccatcatcttggacatcggcttcccattaacaaatctattgatatacaacggcttgagatgccgattttttgtcccctctggcttctcaaaaatcgctgctccggtgacaaaaccaatcaagcagaggcttcatcaacatcatcaacatcggctagcctagcttcaaactctgctgctagcataaaaaccatattcaccgatgcagacgcagtagccttgcccttgagcaacccttttggctttatcagcttcaacttcatcggctgttgtgaccgagctcttaacacgccacacctgcttggtctttgttttcctcagccgatgattgatttcttgttctacttcttgaaagcgctccatgttccttattctttgaaccattctcttttgattcttggtgaaaatgcctgtaggacaccattgtgttttcctatcttcatcttcatcatggtgataatcttgatttacatgtcccaatctctgatgaacaggtatcctcttttgaatcagccgattacctctattacaggatcggcttgaactccctgcagtgtcactgcatccaggacaattctcgatcgatggcagcctcataccttcattccagcagaatctgaaaaactcacagtcccaatgaggatcaaaaccaccatcatcttcttcataatacctttcctgcta

SEQ ID NO: 75425 - DNA, 20892 bp, Oryza sativa
ctccctgaacctctgaatgtaatgctgcacagactcatcatgcctttgcctaattgccgtcaagtccgatagcttcatttcatgaatttcactgtaaaaatagctgtgaaactgtttctccaaatcggcccaactattgacagagttatatggtagagaagaaaaccatgtaaacgccgatccggacaaagataaaggaaacaacctaactctcaaggcgtcaatagccgatgcctcgccacattgaaccaagaatcggctgacatgttcataagttgaaacattgttttgccctgaaaattttgagaagtctggtaccttgtatcagccaggcaatggaaccctttcaaaccactcagggtatggatgctgatacaggtttccatagtcctttggcttgagcccaaactgcttcctcatcacatctgcaatcatgtcggcccaaggtctctgctggggtactccttgcatctgctgtggaatcggctcgaactgattaaattgaggagcaaattggggctgaggtgatcctctttgctgatactgaacatgaggcaatggaggctggtactgatagctcaaattacctccataataattctggaaattcggctgaatattatgcactaaatgctcaggaataacttggggcaacaccgattgatcctgttgaacattatggaccaagtgttcagggataacttgattcacaacatgttgcctctaccgattgtcaggtgttcctagcccagccgatgtatgctgcaaattctgctgttgaatcggcagaaccgtctgctgtcttggtggtgtttgctgaatcggcattgactgtgctgggttggccaccagtgggtttggtagaaacatcgcagcaacctgctcctgggtcaaccgattgatattttgtccaacatgctgtggctgttctctggtcaacaatcgaggattggttgtttgccttggtgctgacgacggtgcggctggtgcaggagccgaaactggtgccgtcggttgaactggtgttatgttggtagcaggctgttggttaccagttatcaaatatctgtaatttgggaagacacctcctggaagataaactggtcctgtagcttgatgcttagctattgttccatcgaccaaaaacttcaccatgtttgttaaggtattaaccagcactcccgattggttgatcaaagcatgttgcacggtgtagtctatccaatcttggaagttgttgaactgcaattgttctctgttgctatcttcaccaagatcctcaaccaagccatcctggagcccatcacctttgtcgcccaatccatctgtagtacctttgctgcctgaatcatctgtgctgacttgagttttttgcacctcaccatctttagaaggacctgttccagggacatcagcaactagcttcaacttgtatttttgaacaactctcccttgccgagtctctgtgaatgaattcatgaattgttgttgtgcgttctgcatcattagttcaaattccttttttgctctggtgatagcttgccaacagtgactggaataatattcccagtattaacctcagcctcattggttcccgtaggctttggaatcttggtctgaggagggaccacagtctttgttgctgatgatggtgactgtggtggtttttcagccatgagagaaaattgtcgtaacttggtcccactgggcttgccaaaagcgtgttgatgcgaaaaacatgaggcctgggagatctgcttaactccagtgcaggtccaaaaatcttgcctttgaggttcatgagcgtgccaattgatttgatcctgcaatcaacaataaacaaagacaggaaaatagcagttaaattcataaacgatagccgatcggccagtcgccgatgacatatcatttatccttgagccgatgtcatctttgcatcgattggcagtcatgaataaacaagaaagaactaaatctattcaatcggctgtagatattaacggtacataatccctaagtcgatatatatttaagtcaagtgattgggatagattgatcgccatgtcgagacagtataaatcacttagatcgaaatatatattaacaatgaaattataagcgctcatagcatagccgattagatagatttagcatgtatcggctaatactccgataccactctatgtaaagatattaaagcaagtaatatatatcaaacgagaagcttaatatacctgaaagcaagaagatctcaatataaaaggcggatctagcatatcaattaagcacataaaatataaggctaaatcaggtaagatcggctgaaatcttgatactaccctatgaaaaatacacgttcgttgtaatgggtgaatattattttattattattattattattattattattattattattattattattattaattatacaatttagctaaagtgaaaatcattgtgagaatttgtttggatactatttttagaaaatcatgagttgtaattaggagtccgactcttatctcatattagcatgcgagttttttaaaatgatttcttatacgataactgttgtgtttctaaaagcgccccaagttagaatgtgagttcctttaaaataatttcttatacgactccttttatattttaaagagcgaacgagcttaaaaacggactcaaacacatatatgtattttgataagcaaaacgaaattttttagcgtgtcacgttagatatacggacacacgagtattaaacatagactaataataaaacaaattacagattcagcttggaaactgcgagacgaatttattaagcctaattaattcgtcattggtaaatgtttactgtaacaccacattatcaaatcatggagcaatcagatttaaaagattcatatcgtaatttacaagtaattagtttttttctatatttaatactgtatatatctgtctaaatattcgataagactgggtggaaattttttgtttgggaactaatccgggcctgacgcaatgctggtgctcgcagaagagctcggtgcgacgtggcaacgattaggtggagacccgaccagagcgcatgcattgagtagaggaacagatgtggatgtgtgtgttcttgctataaggtagtaaaagtaaatatgtatttaattattagggatgttatcatagaaaaatatggttaaatatatatattttggagatcacgtcgttatcttaaatgttaaggattatataaccagagggagtgtggttgtgtgttgaaactcataaagataaaaataaaattgacgcacataaaaaaatcattagtatatgattaattaaattttaattattataaacttcataaatagatatattttatattttaaaacaatttttttagaaaaaaattttatacaaaatgcaccgtttagtagtttgaaaagtgtgctaacaaaaacaattataaaatcttaatcttaaccttagtcttcctgagccagtactgtacatggttggtactgttcatcgggttactgtgctcgcgcatggaggtctggaacgcagatctggacagtggtttggtggctgtgtttgttaggctgactcaaggtggcatttgcatgtggaaattgagtgggctgcatggaacttgatcaattgggccatgctacatgtcgaaggccaatgcaagtagcaaggcagcagttgtgtatcaatattactttctccgtttcacaacgtaagacgttctagcattgtccatattcatatagatgttaatgaatccaggtatatatatatgtatctagattcattaacttctaaatgaatatgagcaatgttagaaagtcttacaatctaaaacggagggagtactatattaggactcgacggaggcagtgcgcgggttgagaaaaaaatgttatagtggtaaattttttggtttattcaaggtgataataaaattctcaaagtattaaggattcagtctagatacagacagcgtggatgatggattcattagctcgatccataagaaaccaagcaagaaaggattctcttcatgtttgttgagtttgatttgtctatttgatgatgatattagttatctagctatgaattagattaagtcaaatttaaaacgggagatagatgcaaacatggtctttagggagtttgggatataccaactataggaggaatccaattttgcttggcaacacgactgtgacgagagaaaaaaaggtggagcactgttgtaggtggagttcgaaggaagacattacaagatagcggagtctcttgattacggtgagcgtagtgcaggcttgttgggactgctcagcgtgagtagtgaaaggatcaactcaagtccagctacacgaaaatttgtgcaagggacaaattcagattgacgaggcattttcgtcaaagttgagttatgatatgctgtaattatgctggatcagggaagagtgttcgtaatcaatgctctaggaaagtaggcttcggttaaaccttattaataaatatggtgtcttggtgtcattatcgtgtttgtatcttctatagtgtttcttatgtgctcggttaccaatgatgattttggaccggttttataagaaggaaccgcatgagcacgaagctgtgtgacaaaaagcgatggacctggccgtacctcatccatagtatatattttttagtttaccttttcctccctcggtcaaataattatggccaacacgggctctcaaggaagcaatatgtagtacatacttatgatttctgtaaattaattttagatttcacttaatttacttcctaaagaaaagtagtacttttagtactgactcaaaagttacttctattgccctgtacgtttcaaattacttcgtcaggctttgcacattatactttttaaaatcctattagagagctttgtgttttaactccataccataaagctacttcttctaatactagaacaaagagttacttttgttatcgtatttagttacttctacaatttatttgaattacttttagatttcacgctgaacttacttcatgtagcttcatgttttacctctgcactatgtagctaaccacctgtattgtttacataaaaacattataatattatgactcactctaaacatctaaatatgatccgtatatatgaaacataattattttcttcgggtattgatatagggtgcatgcatgtgtaatcacgaacttcaagaaaatgtttatgtaactatcccatctaatctacttttaatccgctagattgttacatttacgttttgaagaactacaatcaaatgaagttgaaaaaaagtactatgaaaaagacaacaattacagaattactactcaaatggaattgacaaaaaaaagggtgatcacagtgtacatgcgacacgcaaggagcggaacaagaggccaattaatggtggaaaatggaaatggcatctactaatctcatggtttttggtgtgatcttcaagctagtgcacactcttctcatatggcaccgatgattggattagctagatgcaattgacaagcatatagactttcgttcaataaaggccatcaacaaacccaacttctaagaaatataatcgtataaactattttatcttggaaatgtctttgccatcacttttattctgttagacgtcgttaattttgtcaaaatgaccaaattaccctcctgaagacctcccatgacaaattctcttcccttccaccgccagccattcctcttcaatttctcccctccacttgaactgccggccactccctcttccacctcttctcgattaatgctaacatctagttgtaacaaaaaaaaaaagtagcccggccgtcatcatcgacaatgcctatatatatcaggccgagctttggtagctgcagagatctcaaagctatagcggctatttcatttcctcttagagtatagttgccgtccatactccaaatacgtactgcctgatgggatcgtcaggggcaccagagttgacacatgaaatgagcagcaatccttgtgccggcgggagagcaacaatcctgggaatcggcacggccgtgccggttcatgtttatgagcagaagtcattccctgattattactttgagattaccgatagcaatcacttggtcgacctaaaagccaagtttgcaaacatctgtaagtgcatgcgaaattactaccattttgtatcttttcccgatcgatgaacttaattaacaaccataaatatataggtagaagctagcagcctcatcttttggcttatacttattcttataagccaaaatttgaatttccaatcttatatttggagttaattttgagatttttcatcataatttattcttcagcctttgccgttagatcgctaagaacatgcatataaaagttttatttacaaattattttccgtttacaaatataccgtttcgcttattccatcaataaacgaaacgatggagacgattttcatggtgcccaagcaattatatagcaatggttattgcattattgcaaatctaggcgagaagacatcgacggagaagcggcacatgtacatctctgatgagtggctgagggccaacccgtcggtgacggcgtacatgtccacctcgctcaacgtacggcagcaggtcgccgaggagggcatccctcggctcggtgcggaggcggcgcgcaaggccattgacgactgggggaagccggcgtcgagcatcacccacatcgtcttcgccaccaccagcaccggctgcctgcccagcgccgacgtcgtgctcatcaagctcctcggcctcccgctgtcgaccaagcgtgtcatgctctaccaggctggctgcttcggaggcaccacggcgctgcgtgtggccaaggacatcgccgagagcaaccacggtgccagggtgctcgtggtgacatccgaggtgatgtcgctggtcatccgtggcccctccgaatcccacatcggcaacctcgtcggccaagccgtgttcggcgacgccgcgggcgccgtcgtggtggggtgctgccccaccgccgacgagcgtcgtcccgtgttcgagttggtccgggcatcgcaggacgtgataccggggacggacgacgccgtggtggtgaaggtgcggcaggaaggggtggtgatcaccatgcaccgcgacgtgccgctccacgtatccaacgccatcggcggcgtggtcaagagcacgttccacgagatagacatgaagatcaccagctacaacgaggcattctggctgctgcacgccggtgggagggggatcgtggatggcgtggaggagaggctgggcctcggcggggagaagctggctgcgacgagggaggtgatgaggcagtatggcaacacgcgtagctccaccatcttcttggcgatggaggagatgaagaggaggtcggaggagcgagggatggcgacggcgggggaaggcctcgagtgggggatgctcatcgcctttggccccggactcaccttggagaccatgctgctccgtgcagtgccacgtaacagctagctatacatacgccaacatgtgatatcgatcgaccggtaacacgaataaattaagcagggcaatctacaagttatattttccagtgcgtacatgttatattttccagtgtgtgacaccagtaaaaataagtctacatgttatatttttccagtataagtgcgaatattatgttaattgcttcttgattgttactccacggttaatttagttggtttcggaaccagctgagtatggaataatgttatacgtgatcaattataagctcttactcgatcatctggtcggacgacaaacatttctagcatgatccatattatgattggttcgtccctagttggaaaatgtggttctgttaataatgttctgaagctttgttttttattatccatattcggtacatcactagaaaaagaataataactgaaaatgaagtaagattactccactggtggagaaaccatctttcgtcggtcggccgatttccacaatagtcccggatgcaataaaaaccggggctaaaaatgatctttagtcccggttcaaaagggtagcgggcatatttgatctttagtcccggtttgtgttaccaaccgggactaaagatcatctttagtcccggttcgaatgctgtcagggcctgtcaggcccccccgggatctttagtcccggtttgtaacaccaaccgggactaaagatcgtaactttagtcccggttggtattaggactaaagatcccggtgatctttagccccggttggtgctaccaactgggactaaagtcccacccctatatatgtgtcttcttcctcctccagctgcccgagcaagcttcaaaatttctttaaaaaagaggggaggtcatgccaaaatttctattgaatttattttggtgattacatacaaatcggaggtgcttaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaagacacattaaaattagtttaaaactttacaaatagtttttaagaattatttggtgtaatattttatgatttttgtatgaataaagatatcttataattattatatgactgtcattattgtaagaataattatttgtgtacggttttttttactcatgtagatggatcagcaatggatgtacgctgaccggcggtccaaagagtttattgacggcgtgcactattttttgagagtggccgaagctaacaggcaaaggggttttatttgttgtccatgcaataagtgtaagaatcagaaggagtattctgtatccaggactattcatttccacttgtttaagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgtcagggaggactgcgaaagtaaaaaggaggcccataaattggacaagatgttggaggaccacagaacttcgttgtacccaggttgcgagcaggggcacaaaaagttggataccactctggagttgttgcaatagaaggcaaaaaaatggggttagtgacaaggcatttggcgatttattgaaactcgtcaagaacattcttctggggggaaacaaattgcccgagacaacgtacgaggctaagaagatagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctatgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatctttactcccggttgttctcaacaaccgggagtaaagatccgggcgtatatatattcccggtgcgccctcgtcttcttcaccaacacttagacgttttcggccgatcgatctctctcggcctctctccttcgccacgccgccgctgctttcgccgccgcgcgcgcaatgccgccgccgccacgccacgccgccgccgccgtcgccacgccgccgccgccaccgccgccgcgccaaccgccgccccgatgccgccacaccgccgttaacgaacgagaacaagaacgatcgaacgaacgagagtgagaacgaacatgtcaacgtacgttgccgcgagaacgtgaactagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgtgaatgagaacgagcgaacgaacgaggacgaacgttaacgtgaaatgcaatatatatatatatatatatatatatatatatatatatatatatatacatatatatatatatttgttacttcgcatttatccaaatacatctttttgtatcttgcaaaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctatcaattgactattgtagtcttaattagacttagcatatacgcacgaaacacttagcatacatgactattttagtcttaacatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgcatgtaatattatttgagttttaatataagattattttatttgtaattagacttagtatataattatttactagctagggttgtataatatacgtcacctagacttagcttatatcatgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaacagggcacgcgggcaacgaggtgcagcgaagaagcttgagggtcagcacatcataacggaagtggaagaagatggacgtcctagtgccccggccgaagccgccaagaactatgtacgtcacagcggttgggttgtgcgggataacgtgcctgtcagtacggtgtactggtgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaaggagatctgtaccggaagtatatactgaaggggcagacaccgaacttcgacacattcccaaagctaagggatcactgggacgagttcgttgcatataagacaggtgaacaagggcaggcgatgatggaaagaaacaaagaaaatgccgccagaagaagtaccatcaccacttggggtcaggaggctatagcgtcgcgatgcagcccgtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgccccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccctgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtctagaaaagaagattcctatagaccccagtgtcaggaacttcttcaggggtatgtttgcatctgtcaaggaggccatcaagctatcggactatgagcgaacgctgaagaaagcatcttctggaaagtccaaaccagtccctcagcttggagagcaaccaaaccaggagatcgagccgttggtgaccggtgaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcaccaccagtagagagatgatcggagcgaggatcagggacacggacttcttgcaaggagatgacattctctggatcaatttcaggggaatctacgaactataccagctggacgccctcgacgtctctagtatgagttgctggattttgtaagtatatcgttcagttagatttcttactatacgtctcctttaattaattaggtccttgtatataagtagactatagaaaataatatactcccttttatcgttgtagaatggagattcaaagggcccgatggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccttggacattgcagattccactgggtgcttttactcttcgacctggatgcctgcaccgtcaacgtatatgactcaatggataaaaaagagtctacgtttgacaaggttttcgaacttatagataggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccgcaagtgagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgcgtacacattttctataatgtaaatatattttggtcatatatatatctatatacatatgcatttgcataacatatatatgtataaatacatatatattatgcatgtatatacatataatataatataatatatatatatatacatatatatatgtatgcatatatatgtattgaaacatatatatgcatggtttatatatatatatatatatatatatataaaccatgcagcaacagggccatgcaaaaaaaaaaaaggactaaagatcgatctttagtcccggttatttcacccgggactaaagatagcgatctttagtcccggattggtactcccggtttggaaaccgggactaaaggggggttacgaaccgggactacaaagggtttctccaccagtgctcttacatatcactttttgtgatctttgatgtacaactttaatcactattatatattaaaacagagttagagtatttacggctaatttttttccagtagtagatgatgtacccatcgatagtgaggtgttcatggtaacttaatcaatctcaagatatgtcgggcccagtttttcggaggtgctcataaggatagaatgtgcgtatgtattcatatagttgagtgcacacgcattgggggcacctgtgtttgtaatgtgtttattttaaaaaaaaagagtacctagtaaaaatttgtattgttatagtgtccttttctaaactaatctacacatatgaaagtgtagtagatatggaacaccccacttatgtgtatatagtcagcaggaataccacataaattgtagcagtgcaagctacgcatcgcgtgcctttagccaatcggttcaatgaaataaaaaaaaatcatttgtaggtcttacaacagagaatatgttggatatttcaagaggaacaatacgatccagttgattaaagaacgtaattaggagtaggtacatacgaccttctcatccactttaggatagttgtctatttaaaattaatgatctttagaaatcataactaataaatcacatattcaatttcaaagtcgtttcaacagctgtattcatggtaattaaatggacaattcaacaactacactccctccgtctcattttaagcgcaaacatgaattttcgtgtccaattttgatcgttcgttttatttgatatttttttataattagtatttttgttgttattagatgataaaacatgaatagtactttatgcatgacttttttttaattgttcttctaaaaaatcaaataagatggacgattaaagttgaacagaagagtcatggttgcgcttaaaatttgcgcttaaacgctgttaggtgtggttggtacaactaaaagagatggatacccgcgagcggcggcgacacaagtgtagttgagtagtagtttaattctctaaaccagatgtggcaacggatagaaatcattcggcgatgacacaagtgtagttgagtagtagtttaattctctaaactagatgtggcaacggatagaaatcattcgagcatgcgggtatccatctcttttagttgcacaataaccagatgtggcaatggatagaaatcattcggcgatgacacaagtgtagtaaaccagatgtggcaatggatagaaatcattcggcgatggcatatgctcgcgggtatccatttcttttagttgaaccaaccacacaccacatctggtttggcgatgacacaagtgtagtaaaccagatgtgacaatggatagaaatcattcggcgatgacacaagtgtagtaaaccagatgtgacaatggatagaaatcattcggcgatgacacaagtgtagtaaaccagatgtggcaatggatagaaatcattcggcgatggcatatgctcgcgggtatccatttcttttagttgaaccaaccacacaccacatctggtttggcgatgacacaagtgtagtaaaccagatgtggcaaggcatatgctgcaacggatagaaatcattggcatatgctcgcgggtatccacatctcttttagttgaaccaaccacccacatctggtttagagaattaaactactactcaactacacttatgtcgccgccgctcgcgggtatccatctcttctcttttagttgaaccaaccacatctaacagcgtttttcgtcctcgctttcacgcaaaagattcgaatccggtgtgttacagtgaccgggcaaatttcctatttaagctgctgctgctcaagttaggaaagcgaggtggtactaatctagctacagtgccgcgccttgctacagtagcgcgagctactgttgggctgcatgcatgcgtgggccaaggcccatggcctgctgctagcttttttttcttttagggtgttacacggatccggcggcggcggccacgggcgatagcggtggcggcgcgtgccccctcccctccctccccatgcagatccggcggagggagggcttgggggcagcagatccggcggccgccgccctctcccctccttccccttgcagatccgggggagggggtggctgatccggcggcgcgcggcgggaggagagcacggggcggcggcggcggccgcgggcgacagcggcggcggcgcgtgccccctcccctccctccccgtgcagatccggcggaggggaggcttggaggcttgaggagatggtgaccggcggagcggcggcatgcgtcggcgaccagatctatctctccccctcctctttttttcacttgtgttttttgtgtgtgatttgatcatgtgagatgttcatgtgatgtgttcttgtgatgtgagatgtgtgttcttgtgatgcttcttgtgatgttcatgagatgttcatgtgatgtgttcttgtgatgttcatgtgatgcttcttgtgatgcgtgttcttgtgatgtgagattcggcggtgggcgacggcgacggcgacggcggcgggcctcggccaggcggcggcggattaggttagggttagggtttcttttttctttttttttgtttctttttttttctccgcgcaggcggcttaagcgcccgcacgcgaaaattggttttcgcgtgcaggcgcgccacccgcatgcgaaaatcacgattttcccagacgactgggtgcatgcgggccgcccacccgcacgcagaaattggctatcccgcatggaaaaattggcgctgtagtagtgcttgatgcgtgaacctagccgtacatgatcaataaatcagtaagattttaaattttgatttatagcataatttgtcactcctctctatttatagctccctcttccaccttctatgtttagtgatggacacaattagtgaatagccaggccgggcttacgtaggccagcggtttccaaacactcccccttgggctctgactgtataatttggagaaaagaaaaacccagtggaaaaaatttggagaaagagtacatagcatatgcttgcaatgtcgcatgaattgcctcattaaaaatcttataataaactactgggaaaacttatctaacggaaaaaagagtataatgcactcaattcttcgttcaatttttctagatggaattttgggtattttattttctatatcaaaattctggaatgagtcagcgaaattctccccctgaattttgcatctctctaaatctcattattccaattcctcagacacacttattcaagagaagatgttaataatgggttagtggacaaatctgtaagacttccatatagcttagttcgttgcttctattcaattcatgtacatagaagagcttggggttcatgtgcttagtgagtttgcttctcatgtaatccatttgcatatgtgcgacatatgctggggttgtgttaacagtgaaatttggtaagcccagagtagtcatcggcttagagtcagcattggcttcgaagtcttgagattagccgatgagagttgtcaagtcgtcagttgtcggattcttgctatattcggttaaggaaattgatctactaaaggaagcttatccagaagagaccgagtttaaagagaatgcggcatggcaagttatctattaattaggaatagtttattagtttccttttatgtttaggaaagtgtgtttagtgtcctataaggactttatcttttccttttatctttaggaaagtttctttcttgtccggcaagaacttgtatcaacccatgggtataaatatgtacacccagggtattaatacaattcggcgcatcgccaccttttaccttttctactttattttatcgtccgacgggacttggcacctgacgtggggctatgtttgatctccggctaaggggtaagtccaatgttccgtcggcctaggcaatagtatcgtttacgtcggcgtcgttcaagtctgcatcagtacattcgatctcttggattgctctggtttggatgatatatttgcctacctatttatcatatgtctctgttaatatcgtcttagcatatcaatttagctctatcggctgcttctcgttttagggattctgccagtatcggctaaatcgcgttgctagattagatttgcttagacatctaccaccctaaaaactcagtcaacggcttgattgtctagatattatatttcttttcatacttagtgctgcatccattgagtttgatctactaagtcgtgcttagaaccataatctctagcctgcttcttgattgccaataagggtttcatcggggtttcaaccggtgagttatctggacgttgcatcggctcataaggattgcatatacatataagttggatttagccgatggcaacaaaggtttcactatttaatttaatcttgtggatttcatgatatcggacctccagccaatgtgtgctttaaccttcggattaatgcttgtttatcatatcattatttgctgattggtttatactggattatattgttatgtcgttacatcatcttcagccgattgcctttatatcattatttacattggacatatagccgatagctctaaaccctatcgctatcggctggcatcggctattggctggtatcagcatcggctggaatctctacattggattatgagccgatcggctattttatctcctatttacataacttgtcagttgcaggatcaaacttactggcacgcctgcatctcatcaagatttggacctgcacaggagctaagcagatctcccacgccggtgtgttcgattttttcgtcaacacaaattggcacgcccggtgggaccatgaattttatatccacatgtctgaagaagaagccaatgccaagatcatggtcacggtggagaatttaatggaggaacaacaatattggctcggggggcaagcgtatcagtttcagcatggtggagtacatcagtatcggcttgtcggtgacatggggccgcgggtatcatgactagaggcttgggtagccgcgatcacccacgtggcctgaccccctcgggggggtcgggcccgaggatgatgtagccacccctccctctatctccccgaggggtcg

SEQ ID NO: 75426 - DNA, 2620 bp, Oryza sativa
gagttctacagtgaagctgttggtgtggaggattaggtgtaaccctggtcaagctgcctgtagagtggagtcgtctgcgccgtttatcttatttttccgctgcatagatctttattgattgagaggaactatctacctctgtaatgacattttattcgcttattatttagagtaataattgaactctattatcaatttgttattgtgtgcctcggctgattcctggacgagggttcacacagatgtaagcgtttggaattttggatagaaattccgggcgtgacaagttggtatcagagccaggttgaccctaggttatgccaaatggttacccatagaagccctctaaaaatattggaaaagtagaactgttctcctccccttctcttttaattaaaccaaactaatagcacatgcacttcataatctcttttagtggttttcattcgaaagttattccagtgttattagtactgtacatctattactgtactaatgactcatttaccagcaaaagttttacaatattattttatttaaccttgctgcaatgaaataaatttagcatgttgattttataactttcttttatttcttttgaaacttgttgttcaaaagtacaaaatttgtgaccttgtttccaactgtttcaacttatcttgcaagtttggtttactttatttacttaccttttactttgattttctaactttattcaaattaatccaaaaacttgtgctattaatttgataaatgtcttaactccctcctttcacttgtctttagatgccgcgctacaagcctgagtacctctttggtgttgagggatttgtccaggagttgcgtacgatgtcctttgccataggatttgggacagcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgctataggagaactccgcgatcgctattgtgatcagttggccgacactgagtatcgctaccatcctcgccaaccacagggaagtgatcgtggcagctaccttgagattgaaggaattgagaatgatgctaccacaaggcatttggttgagatgctgtgggctatggatgaaacccgtgcggagactgtgttagcggctcaagatcgtgaagaccggaatcgtggtaagatttgcaaactagaagacaaggtggatcgtttggagaaggaactagccgcgttgaagggagaagcaccaccgcagaaggccagggttcgtcttaccgcaagaaagagagctctatttgtccctcgttaccaattggcgccaaaggtccgtgtggtggagaaagaagttaccccagccctagcagatcctccggtcgtcattataagtgatgatgaagaagaagaatccaagcacgcccattccaagatcgagtggggagccactcaagatgatgaagacgagccgaacgagccttcaatcaactccgatgctcggaagaactagaatgccatgtcaagtcgttgtcttagatcgttgtgttagtttgcttgttttaagtttggttgtgtgtgtctcgcatgtgatttacatcagtggtgggatgtaagtgcatgcgtttgtttgctttcgagtgttaggtagttggtgagtttggtggtgtgagagtcttcagtttgtaataatgaaacccacttaagatcaataaaagttaaattaattctctgtcctaagtagttttccccggtttctcttcttgtggtcctgtccatgccagatggtgctcactcgcagcaacgggaatggccctaacaacaataacaataacaacaacaatggagagaatcccacacttgcccaagtcttggctcaacaggcacagcttatgaacatgatgatgcagcaactccagaaccagcagaaccagggaaataaccatgcacctccccagaacaagttagcaaaattttttcgtgtgaggccgcctattttctctagcaccattaatcctgttgaagctggtgattggctgcatgccatagagaagaagttggatttacttcaatgcaccgatcaggagaaggtctcatttgcatcacatcaactgcatggccctgcctctgaatggtgggatcacttccgccttaacaggactactgctgaacctatcacttggcttgaattcaccgctgctttccggaagacgcatataccatcgggagtggtgtctctcaaaaagagggaattcaggtcgctcactcaggggtctcgctctgttacggagtatctgcacgagtttaatcgtcttgctcgttatgctccggaagatgtgcgcactgatgaagagcgccaggagaagttcttggaaggacttaatgatgagctttcttattcactcatgattggggattaacctggatttcataagttagtggataaggctattcgtcaggaggacaagtacaatcgcatggagcagaagaaacgccggattgctcaattcaagacacaacaggggaataatcagaagccgcgtcttacttta

SEQ ID NO: 75427 - DNA, 24894 bp, Oryza sativa
tggatatcggccaacctgtagcgcgacataagtcaaaattattatataactcaacaagtattcacattaatttcaaatagaatagtcatggcaaccctctgtgaaaatggatcaagatggttcatgagatatccatgtcttgctgcttattgatgaaaagggaagagaagaagagaaaacaacatatgatcctcaaagagaattgcatattcactaaatatatgcatgggattccatcagcaggaaatcatcggtgaccataaccgcagggcatcaacacagtaagtccagtataacagcatcacagtgatcatcagcacacatgcttgaaataaatcgattgtgatggtacatcgcggaggtaatatttgagaatttcaaactaaccatcgaagcgagtgttcaaataagttaaggtaagaaaatggtactcacaggaaaaagcagatccagtgtattccaggctgcatgccttactgctcgtgtagggtaggtaggacctccaggagaagtgaagctgtaaaggcaagccttcagtctagtgcttgtactcatcctcaattccaatcctggatgattttttttttcagaatgaagaatttacatttcagtggagaaacagatgcaaaaagtcttggattacttttggaatgtgtctgaaatctgaataactataccttgaaggatggtcaagccgggagaggtaatgcagaagcacaggttcaacttttagtttctggagctgaaaaacaaagaacacacgatttagtttgaggtgaagttttagcatgtcatgagaacaccgaagatacttcacttagagaacaacctgatcagtgagttcaattacatagtaatctgcagggccaccaaccaagaaagaatttggaaaagtaggaaaatgctcaaggaaacttgcaagcaagtgatctgcacatgcaaacttggatcacttcaatagcaaacaattgggaccaagaacgtggagaaaaataacataccttgatcatagaacagcataaatctcgagaggaggaggaaaagacctctaccagcctgttcaaaacatcaaattaatgacaacaaatactatcgtacatgcttattaggaaaactcatagcagagttcaatgtcaatagggagtgacctgtactgatatcttactcagttgatctgggactaaagcaacctcttcaaggagatactgtttaataaagcaagcatgttttgattttactaaaacacatacatcacagtttcaacgaaatttgagcaactgaaaccaaatatatccttacattatataatgagagaaagtgtcttgtattggtttggatgtcaatcctgtcaaaaagtaattccatcagatctatggaagtttcaggcaagaaaaaaaggaacatcagtgcaataatccctctgttagcagaaatattttgcagtaataactttctcagtcaacagatcaaatttatgggtgccatcataccaaaaaacattagtagctccttggacaagagcagagctgtatctcagtgatacttccttcccatcaagagggacttcgaataactgcaaatgatgaactagtaattcaccaaactgaaatagagatgaaggctaatacaatccggagcattcttgtatgcaagatcgaataagcgaattacagctagcatttacagaattctgtacttagcttgtttaactagctatttgcagtaaatggtggccagaacaatgggcagtataagcttgatgctgggatacaaattccccagtaagattatctttccttttgagatcatatatacattactcaaaagtgaaaacttaaaaccaccaagacattagctcattcagaggaacatatagcaaggagtaaaaggtaaaaggcacattcactgaggtactggttaaacaaattccttaaacgttactggaaatggaaaacatgacttcttgtgaacatgattgagtttgtacttatattggttatgaaaatcaacctattgcatgttctaaacatataaggttgtaagaattaatatatacccatctgtggaaaagaagtgcaaatatgttcgctgcaaaagactggctccagagttgcactatcaagtcaagtatacgcctcccactttcaggtactttaacaaaatggttagcaagaatctcatagaagcacaaccgggtatcttctcgctcatctactggagcaataccatcatcgttcgtgcttaaaatcacatctgttaaaaagaaataagtatgtaacatagcaaaaacacttgtaacaagattgagtagtattatgacccaaacattgatcataaaaggaagtaaggacagagcatgtgcagaaaataagtgatatactaatgtaacaacaaagttcttactgtcagaagaatccaagcaaccaaaactcaatactctgaatctaaaagaaaaaatggattgaatttctattaaagtatagccttattgttatgcacaattaagtcaaatatcatgttttcctgtgatgcaggtgtgcacagtaacgatggtgtatgcagtacttccctagttagcaagtgcatgccaaaacagccaacttttttagacacttcaatctacagatgcatataaaataaacaattaagatggattcctagaataaaaatgaagtaatgccaatcttggtaaacgatttttgaaaagcaaaatatagtgaaagtgacaagggaaagaactagtttttaactcttggctgacatcaatgaattgttagttctccgccaaaaacgttaaacaagggaatggatataaaccatagtacaaaggaaggcaatgcttttgccttccttcaaaaaaaaaaaaatagtacaaaggttcaaactctaggtaaaactaccacaaacttggtgccaatctcatgattactgtccacaaatacacacatgacgaaaaagcattagtttgattaacatctgaagctatgaaagaaatggcacctcgagcgcggtcatccaccttcaatgcgatgtcagcaaacaactgctgcagcagctgaagacgttgcgaattggagttgagagcctacacgcaagcaacaaccagtgaaacagtgccacctgccctatccaaaccactcaaattatcagtatcgtttcgagatcatataaagtaatctttaattcggtagagaatttgagaaaagaaaacgggagaaccaatttcgattctgtaactgcggtaattgccatcgacttagcgccattcgaaaaggggaaattctgggattacgaaacaggcccaaatttctctaactgatacgtggaaaacaaatcaaaatcgtatattcttcaacactgaaaactcccaacagaacaacagtctcgaaaaaaaccattgattcagaaaaaacaaatccaaacaaaaaaaaacaccttcctcactccaaaccgaaattaatcgcaaagaacccaaaaaggtggccaagaaatgctcaataatcaacagaaacaggccaggacaccaccagcacgaatcaacccaaccctcccggaaatcaatgaaagaacgagacgatgaggggggggggggggggggggcaggaaccggaatgcggagaggaaggggcaggatataaccttctgcagcttgcgctcgatctccagggagagcgcctcgaggtggtcggcggctcgggcccgcatctttcgccgtcgccgtcgccggcggggggcgctcgccgtggacgctgggtcgagtagcgtcgcttcgcttctccaacgattcgtctcgtcgttgttctctttgctcctctcccctcttctgactcgtggtagggcggtccaatcagagccgtacacgtggcgggccggcgacgctggcgagtaaccgcgagttcagcggtggtggcaggataggcatcaccgtgattttgatattgcaaatggatgagaagagatgattctgattctggtcgcatttgatcggcttttccaacgaaataattttgccaaatatttttttttggactgttttgtgtaggccgtgtttagtttctctttattcccaactttttatcatatcatatcacattaaaaatttacatatacttgtaaatttttaactttttttccaaactctcaactttctttaaactttcaactttttttagaaactaaacaaacctgtaaagtttgtcaaatttttgtgttccaaacatgtgtctgattatcaggttgtactccacaatagtctgtctgtctgcgtgtttcagacatgcactgtaagcattttttttcttaatattaacagtgaattgattgtgtgattctttgctttcaatagaagcagggctgcaaagccttttctctaaaaaaaaatttgattgtgtgaaatgattgccgatttcttcttatcccacgctattgcgtgccgtctgctgtgctccaccattttcgccgcgtagctgacgtgtaccaacctttatcttggctcgaggacagcacgacagctgcatgcagcgacacgtggaaaaagcctactccacgggatcttctgcaccagctcggatcggtcactcttcactcaattcaaatcatacaatttttttgcagaatttttcatataaacatgttcactttttcacatgaatcttgtgagaattttcggtggtttaaaaggaggcctaataggcgccgtgacacgtcatgcatgcgtcatcacatcccggcaggtctcccgtctttcctcgggtcgctgacggcggtgagcatcccgtggaagacattctcgtcgccggcggcggcgaccggcgtcagcaagtcctgcacgatgaactggcagacggcgccggagtccgtgctcgtcagccggtggcccctccgccgcaggaactccctcgcctcgccgctgagctcgaacacctcgccgtcgaccaccgtcacgttctcgtacaccacctcatttggcaccagctacatatacataccaccatagtgtaattaattaattgctccttccgtttttatcatattataagttatttttattttttttaattatattattttgaagtttaacaaaatttatataaaaaatagcagtacttttaattaaaaaaatatattactccatccgtttcagattataaaacttttttactttgatcaaaattaaattattttaaggttgactaagtttatagacaaataaagtaatatttataatatcaaattagtttcattaaattaataattaaatatattttcataataaatttgtcttgagttgaaaatgttattattttttctataacttagttaaatttgatacaatttgactttaagtagagttaaaatatcttgtaacctgaaacggagggagtattaaaatatatttaatgaacctaatttgatattgtagatgcattaaatttttttgtaaaattggttaaacctaaataaatttaattaaaaaatctaagcagcttatactctgtttagggagtactggttaatcaaagagattaggtctaatcgattaactgatgcttgccttgtggtagaccctgggattcaggacggcggcgagcgggtgcatgccgacgatgaagtggttcacgaacacctggaccaccgtcgctatgatgaacggcccgccgctgccgccgacgacgccggcgagctgtccgtcctgcacaaagccacaaacagtaatggtggtcgtcagcaccggcgacggtgagctcgatcagcgtgacagcgtcgtcagccaaattgttagtaactacatgccttgagaatgatcgtcggcgtcatggaggagagcggccgtttgcccggagcgatgaagttcgccggcgccggcgggaggttgtccggcggcggcgtcccctccgccggcacggagaagtcgtccatctggttgttcaccacgatgcccgtcgacggcgacagcaggtgcgccccgaagaggtggttctccgtggtcgtcatcgccaccgcgttccggtcgccgtcgacgacgcacaggtggctcgtcccgtggtcatccagctggctccatctgatgatcaagatgtaatatcatcaatccaaatgtttcctggtatgatctctgcaagaacaagaacgtgtacattttctgagatcagttgtactttgggaagtagtagctgggagggaacgtggtgttgtcgacgatcctctgccggagtttgtcggcgaacgccggcgagagcatctccgagacgttgccggtgatgttgacgtagtcagggtcgccgagatccatccggatggccagcatgtgcttgaacgcctcgatgaaccggtgcaagccaagaaatcctttcaagaactcgagtgatttgtatccgctcaagatgttcaaaatctggaattaatcatattcaagtttggtttggatggatcgaggaatgaacagatgatcagaatttaactgggacgaatttggatactgaccagagccaccccgacgccgccgctggacggcggcggcatgccgaggaaggtgtagcccatggcgtcggagcgcatggcgtcgctcacctcgaccttgtacgccctcaggtcgtccaccttcgcgatgccgccggcgcgccgcacgtcggcgacgaacctctcgccgacggcgccgccgtagaacgcctcgacgccgccgctggcgatggcctcgagcgtgtcggcgagcgccgggttgcggcacacctcgccggcggcgaggatcctcccctccggcgccagcacggcgcggaggcccgggtccgcgagcacgtcgcgctccgtcttcttgagcgcgatctcgaggtacggcaccaccgtgaagccgtcgcgcgccagcttgatcgccggcgcgaagaggtccttccacggcagcctgccgtagcgggaccacgcggcgtggaggccggcgagctcgccggggatgcccatggcgagcgcgcccttgtacttggaggtcgggttgcccgcgtacatgtcctgtcagacacaaaaaccaccatttcagcttgtcatgtttgggaattcaaatgtaacaaattcatatatattttgaattttgattcgagcatcctttttcggatgcctctcacttcgatcgaattaagaacataatctacctttatttggaccagcaaactcagctagcagcaagtttacacaattgagaaacgtccagaggttttccggctagctctacaaggtggtaggctaaataacctagattcgaagcctcaccccttttaattatttgatattagatcattccctaatattcgcgtcttttttcttagcaagtttacacaagcaaattcagtgtaaccataagaactgcccaaataatggcaaattcagatgctctcagattttgcttcataatgctatcgatagaattagcacttgcaacgcgcgcatggtgcattatcaaaaaatgttttgcttcataaacacttgcaaatgtgctatcgacaaaatgcgttgttattgtggaactgatctgttcagttcttttaatgcaaattctcacttgaaagaaatttcctaatggacaatttcagctctggttcacacaaatcccccaaggtgttgctatctctgtttcaaattactgttccaggtttgttctaagttaaacatgtttatccttaaccattaatttttaagaatccgtgaaagttaacaaataacaatatatgaattctatattataaaaatattcttatggtgaatccaaaaatataaatttttgatgtttagctacacaactttatataaatttatagtcaatgattaaagtgtttaacttagaacaaatttaaaatgacaaataatttgaaacgggaagagtatatagttaatgttatgcaagttgttgtaccgaattacaccaattttacaagatcatacatcatgagcacaactattttctttaagtaatttcagatattttttcccaaatctattggtttcctatccttttagctatggttttcaaaagaagaaaaaacatcatacatggtttcctcgtaaaactacagctttgtattagtaacatgatcattgctatatatcaaaggtgctatgtccctccaaggctccaaaagtccaaataatgacagggaccatagaaagtactaaacaatggagttgatgaaccatattataacaaactatacacaaatggcgaccttatactgttatatataccgaaaacatttcccggagatatgctagttctaatgggcgatcgatcaccctacctacctagtagcgatcaggtagccccctccacctggtttccttttttggcaccgcattattttcctattttaataaatttatgcatctaaagtttatacatctcaagtttacacatctaaagtttagagaccaaaagtttataagtcaaaagtttatatatccgattcaaatttgaatttgaattcaaatattttttatatatatagtatttctatacatataaagtttatatacctaaagtttatagaactaaagtttataagtcaaaaatttatatatctgattcaaatttgaatttaaattcaaatatttttcatatatagtatttctatacatttaaagtttatacacctaaagtttatagacctaaagtttatatacccgattcaaatttgaatttgaattcaaatattttctatatatatagtatttatatacatataaagtttatacacctaaagtttatagatccaaagtttataagtcaaaagtttacatgcccaattcaaatttgaatttaaattcaatttatatatatatatatatatatatatatatatatatatatatatatagagagagagagagagagagtatttctatacataaattgttctaacttttgttttttaaaaaaaattgtgtggtgtactttggtagaaagagaagaaagggaggaggaagggggggagaggagggaggagtacatagtataggagagaggcaggggggtgatcgctgggcggatggaggagcgatcacccgcctaataggaattaccaacgcgtgaaacatgtgagaagaagaaaattataaatctagatcgaatctggacaaatttcatcttttttattcagtgtgaacaactgaacccatattttattatcttaaagaaactgaactcattttcccaaactggcaactgcagtatggtaatcgcgaagtgcagaaaaactataaagaccaccttgaagcaaccaatgaattagcccatgctgattgcacgtgtgaaatagagagtcttacagaaatggacattttctgaagcgatctacaattatttcaataatataatcaatgtccatttctgaatagttctgaagactgaagcagagttgtagcttgaataattctgaattacaaaatcacagcttgattaaaaaaagagtaaagtgtattagcgattcttaaacttgtagggttgtgttatataggttcctaaactctcaaaatgcatattcaggtcctagaatttatcaaagtgtatcatataggtcccaaatcggcacatcccctctaagatcctacgtgatgctgatgtggcatgccacatggacgtgacgtgtcattttcattttcttttcttcttttctttttctttttctttttcttcgttttcttctcattcttctttttttcctttcttctgctcgggtcacagagaaaggagaagaaagggaaaaaaagagaagaaaaaaaagaaaagttttaaatgtgacccatttgtcagtcaaaatgatgtcacgtcattccgtgtgacatatcacgtcaacgccatgtaagatcctgaaggggttgtggcgatttgaggcctaaatgacaccctgtaataagttctgtaatttggatatgcattttaagagtttagggacttagatgacacacaactacaaatttaacatacactttactctaaaaaaaaaaaggactacctactaagcgacctacaatgtgttgtttttgtttaatgtggttttaggatcatggaccacggggtagtcgacaatgcacatcgcacgcttgtacagtggcatgcctctccatgaatggaatggaatttgcaatgagccaaaaaaaaaaatcaaagtcaaatgccaatcatgtttctagatatggtgacttacatgctgttgctaaactaaatgaagcggggttcaatttaggttgtgttattttgtgcaagtcaccaacttcttatttatcgtttttaaaaaaatatataaaaaaattgctttacaaaatcatactaatcatttttaagctctttatagctaatacataataaattataggctaaaatgtttcatcgttttgcgtgtcatacctccaaacacagccttaatagctgtcaaatgccatcacaaaataaacaagttacggagacaacctttctaaatgaaaaaaacaatagctctattcagaaaaagaaataatgcagtggctactgaggcgaagaagaaagaaaagaaggaagaagatgaaaacatgagagaacgattctaactttgtaaaattttagtgatattcagctgatattatgaatagtaatattttttaaaaaaaattggtaaacttgtaataacatgatccaattaacccctttttgaaagttgcaatgtagacatttcgaattcttttttcaaaatttactgatagggatacttcgaattgctgatgtgaaatttttcttgctgttcttttacagccccgtcttttcacttatgcttatcaaccaaaatttaaaatttcaaccttaaatttagagttgattttggagttttctcatcaaagtttattttacagcatttgcttttagatcactaagaacacgtatataaaagttttattcataaattatttttcgtttgtaaatataccgtttcacttattccggatggggccgttagttggtgagcagaatcacgtgcctatcatttgcgtaggcaggtgtggcccaccagacagtgacatgcgccagaccaccgaatcgctttaaatccctaatattataagagcaggtatagatatattttaattttaatgaaataaaaggtgaaaaaaaagagcagcgggttatagatctgtagccagctgcagtacagactccaagagatagtgggtgtatgataggtgagaccgtatattaatagtatataaagaaactattgtataaattggctattagactataatataatatatacatatacatatatatatatatatacatacatacatatatatatatatatatatatatatatatatatatatatatatattggagctagtagtgagctgtactattcaacttgctctaacggaggtctcgttgccggccacgtggcgcgtggccacacacgtcatccgctcaaaatttccgggaaaaagttttttttttttgtttttactgcgtgctctagttggtgacgagtagtaacgggtaacgcactcaccggcgtggccgcggccggcgcggtctcgcgggcgtcgaaggcgacggcgtcgccggaggcggcgtccctggcgacgatgaacgcgccgccgccgacgccgctcgacatcgggtgcaccacgccgaggcagagcgtcgccgccacggccgcgtccaccgcgtgcccgccggcgcgcagcgccgcggcgcccacctccgagcaccgcccgtcgtccgtcgccaccgcgcccaccccggcctccacctcgtgcgggctcagtctcacacccccgccgccgccggacaccaccctgctccgatcatcgccgcccgagctcaggtgcagcacgacgcacgccgccagggcgagcagcgccgcggcggcgatggcgagcgcggtgcacggacggcggcgccgactgtccggagaagaaaccgcgccgccgccgaggagagggttctctaggccgcctcgcgcggccatggccgccggatcgccggagattgtagtggcgatcggcaggtaggtcgtcaggaaggggagggattcttggatggcgagagcttgtcacactgtgcgtttgttggcttgtcaatgagacgcttgatttttataatgatcgtgtgtctaactgggcaatgattctacagatcctattgtacttgatattttcactattttcttaattatactcccttcgtacaaaaagaaaatatataacagttatagagcgggacacatcggtagggctgtcaaaaaagctcgagactcgcgagctgctcgagctcggcttgtcctaggctcgattcgagctcagctcgagctcctgacgagccgagccctagcctctctataagctcgcgagctttgtcgagccgagcttgagcttccaacgagcttagtaatatatgatttttgttattatttaataaattaggagatcaaatatgttatttgtatggcttatattgacatcatatatttattttattcttttttcctcttatattaatatgatgaactaaaaattaattatatttttaaagattatctttcaaatatatgttgttttacttaaaaatcaagctcggcagtcgagctcgagccgagcctatcagaaagcttgaacattttataggctcggctcgagcttgtatcgagctcgagcctaggcagacaagctcgctcgagctcggctcgttgacaaccctacacatcggtattaaaaaagtgagtggatattgaggaaaagttatgattcgtgaggagaaaaaaatataggtagagataaaatggagaatactccattttgggacaagttgagaagtgatagaaatagctttagagctaatcaaatgacttgtgacttgtgatttggttaagatgggagaataggtggaaaatagttttattttaggataagtttaagtgatagaaatagttttattttagaacagagagatctaatcaaatgaaaattcagaatttgaatgtttgacgcaattgtactgattcaatggcgtgattctaactcatcaaaagcaataacccatcagatttttttttaaaataatatttcgatttagtgctacttgttgttgggatatcactttccaaattaagccgcaggaattacctttttcttgtaagtaaagaagaaacagagtacacagcagattgacaggtctacagatgtgtatactattgtcagatttatgagatcacaaaatttaaattctgacagttgatcttcttaagagtgacaaaatatcagataattttttttgcaagaaagaaatagagaaaataatctgcacctgcaaagaatattatggtgtggacagtgtggcaagcagtggactgcgtagccgcagcggcagcttgatcacagaatcagctgggaaaacaaccattggcagaatcaggagctctgatctttcagagttgtgacaaactgattttttttaaaaaaaaattgatcacgtcattataaattttgcaattttacaatttggcattactatttgcctatatacatgttgaaattgaaaaatatgacactaacattgaaaactgaaatatcccttggctgtatttttcaatttttgggaccaaaatacccaatcttctccgttcatcctctcatgtacctccagtcatcttctccaccaaaccacccatggctgccccgtgctcgagcgccacagccggccgttccactgctgtacaaattttgaagaatttccatataaacttgttcagctttcacatgaatcgtgtaagaatttcggctgtctaaacgggggcctaatcgatgccgtggcgcgccatgcatgcgccatcacattccggcaggtctgccgcctttcctcgggtcgctgacggcggtgagcatcccgtggaagacgttcccgccgccgtgctgccgacggtcggcggccgagccgaccggcgccagcaagtcctgcacgatgaactggcagacggcgccggagcccgtgctcctcagccggtggcccctccgccgcaggaactccctcgcctcgccgctgagctcgatcacctcgccgccgaccaccgtctcgttctcgtacaccaccacgttcggcaccagctgcattatatataccaccgaccagacagtaattatgagattgatttttgtgcatgtccgttcgaaaagttataaaaaaatttaaaagaatttgtcaagatagatcaatatacaatatatcttttcacaaatatgtgaattaaaattcgacatatacaattcgaaaaaaataaaaataattaccataatgtgttctatttatagtcaaatttgttatttttttttaattgtataagttaaatttgaatttgtattatttgtgaggtgacatattatataacgatctatttctactaatttttttaaatttttttgataactttttaaagcgacatgtaaaagtgagagatatcctaattgagtttcccagtaattaattaattgctgtttattaatcgacgagattaaggtaattaattgatgcatgcgtgcttgccttgtggtagactctgggatgctggacggcggcgagcgggtgcatgccgacgatgaaatggttcacgaacacctgggccgccgtcgcgatgatgttcgtcccgccactgccgccgactactccggcgagctgtccgttctgcacagatagcactgcagtggtcagcatcggcgagctcgtcagcgtcagcgaaatggttagtagttactactatatgcttgcctttagtatgatcgtcggcgtcatggaggagagaggccgttttcccggagcgatgaagttcgccggcgccggcgggaggtggtccggcgtccgctccgccggcacggagaagtcgtccatctcgttgttcagcacgatgcccgtcgacggcgacagcacgtgcgccccgaagtaagagttcaccgtcgtcgtcatcgccaccgcgttccggtcgccgtcgacgacgcagaggtggctcgtcccgtggtcattcagctggctccatctgatcacacaaaaaccaaaatctcatcactaaaactgctctagctaacttctgaaagaaacgttcatttctgagatgagaattactttgggaagtagtaactgggagggaacgtagtgttgtcgacgatccgctgccggattttgtcggcgaacgccggcgagagcatctgggagacgttgccggcgacgttgacgtagtcagggtcgccgagagccatcctgatggccagcatgtgcttcagcgcctcgatgaaccggtgcacgccaagaaaccctttcaagaactcgagcgatttgtatccatccaagatgttcaaaacctgcgattaatcatgtcaagtttgatatggatcgatcgagggatgaacaaataatcgaaattgactgggaatttgatactgaccagagccattccgactgtgccgctggaaggcggcggcatgccgaggaaagtgtatcccatggcgtcggcgcgcatggcgtcgctcacctcgaccttgtacgccctcaggtcgtccaccgtcgcgatgcccccggcgcgccgcacgtcggcgacgaacctctcgccgatggcgccgccgtagaacgcctcgacgccgccgctggcgacggcctcaagcgtgtccgcgagcgccgggttgcggcacacctcgccggcggcgaggatcctcccctgcggcgcgaacacggcgcggaggcccgggtcggcgagcacgtcccgctccgcctccttgagcgcgccggcgacgggcggcaccaccgtgaagccgtcccgcgctagcttgatcgccggcgcgaagaggtccttccacggcagcctgccgtagcgggaccacgcggcgtggaggccggcgagctcgccggggacgcccatggcgagcgcgcccttgtacttggaggtcgggttgcccgcgtacatgtcctgtcagacacaaaaaccaccatttcagcatgtcattttgggaaatcaaatgtaacaatttcctatttttgaattttggctcgaacatcctttttgagtgcctctcagtttgatcgaattaagaacataatttatcttaaattttgagttttaatgctgaaatttggagtccatggtcatgcgaattttcaccaacttcagatggagatttacaaatagaattgaataaaatgtatttctccttttactactatattggagtgttagacttttgtctaatcatagttagcttctatgagctcaatgttgagtgaacaatatttgtaataattggttgtagcatcttttgaagtaacgaccagatgttattttcattatctaaaaaaatatgtatgagcataattaaaatttaattttccactttttaattatgctcttcacaaaaaacatcatacttgaaaatagaaaggtctaaggttgcatttgtatgtgtaacttgcttgagcttttcacctgtacgtaaaactgagaagaggaattagagtataattaattaagtattaattattaaaaaaagtagagagttgattttttttattttttaagaaactttgatgtataaagttttcaaaaaacacattgtttagcctgtttagcagttcaggaaatgcaccaacgaaaaataagaaagttgttgtatagagttgctcaaaagaacgcaacataaataatgaagatgaaccataccatactaaactatttgtatgaaattgtggcgatggaatctacactgttacaccataaacatttccctacatgccaaccaactcgtgaagcatgtgaggagatgaaaatgacaaatctagatcgagtctgaacaaattctgtcttttttattcaacccgaacaactgaacctgtattttattattatctaaaaaatctgaacctttcttcccaactggcaaccgcaatggggtaactggtaggagtatcgcaaagtgcagaaaaaaaaaagaccaatgttgaagcaaccaaatcaattagaccatgctgattgcccatgtgaaacacagtgtcttacagaaaatgaccatttttttgggatcagatcacggatcatgctgtagttgataatgcaatgcacattgcacacttgcacagaggcatgcctctcagtgaaatgaatttgcaatgagctaaaaaaaactcaaagtcaaatgctgattatgtcttctagctatggtgacgttttacacgagacatgccgttcgctaaacaaaatgaaacaatgtggtgtaatacggaaatattagggagggtcagcttagataccgagtgaaccatagttaatcaggagtaaaaaagataagtacagtggtttttgtgcaaactgcaatataaagccattcggaaaagaacaggattgctgattggacttggagaggaacgtcaggtgcctatcatttgcgtaagcaagcgtggcccaccagacagtgacctgtacccaaccagcgcatcgcactaggccgtgggccccacatgtcatgcactcaggattgcagtaaaaaaagttttgctttttctttttttttttaatttttactgcggcgctctagttggtgacgaggagtaacgtactcaccggcgtggccgcggccggcgcggtctcgcgggcgtcgaaggcgacggcgtcgccggaggcggcgtccctggtgacgatgaacgcgccgccgccgacgccgctcgacatcgggtgcaccacgccgaggcagagcgccgccgccacggccgcgtccgccgcgtgcccgccggcgcgcagcgccgcggcgcccacctccgagcacctcccgtcgtccgccgccaccgcgcccaccccggcctccacctcgtgcgggctcagccccacgcccccgccgccgccgccggacaccaccctgctccgatcaccgccttgctccgctccccccgagctcaggagcagcagcacgacgcacgccacggcgagcagcgccacggcgatggcgagcgcggtccacgggcggcggcgccgactgccctgagaagaaaccgggccgccgccgaggagggggttctccaggccgccgcgcgcggccatggctgggtagctgccgccggatagccggagatcctggtggggattccaaggtaggacagagaggggagggatttcttggatagcgacttggcgagagcttgtcgcactgtggtgttgggtggcttgtgtgcttgagacacttggatatttatatttagtgactgtctgtccagctggccaatgattctatagagcttgttctaacttggattgtttctagtactatatttttaacgactcaaagctggagtagtaattacttatcagatggaaattcagaagttgaatgcttgacgcaactgtactgattggatggcaagagtaattctaacacattagagtgaatctggacataccttacgttcagattggtttattttagaacggagggactatggataaaaaaaaatttgaactctgaccattaatctgcttgagtgtcaaaacatcaagttctcaaatgtgtactactagtattatttttgttgcaaggaagaaacagagaaaagaatatgcagatgcaaagaatattgtggcgtggtgtgtgtgagatggtgcagcaaccattggcagaatcaggaaaacagattctttcagagttgtgacggactgatatttattacgtttatttatgcttagaaaacccagcatctgaatatctgataagcaccttggatctccgtctggctatcactattttagcctttaatttcatttccctattttttaataaatgaaacttttattgatctcaaacagttctccgcaaaaaaatattaaaggctaaaatatactacccattacaaaatatagcaacttttagctataaatatacctcatcccacaatataataatttttagctacgaattagacatgccatttgagcggagcgaccaaccaacttggcgaggcgagtgagacgaccagagtcggtgtaatcgcgtctcagcaatttgtcgctgtcaagtgtcaactactccggtccaggggcatgacttgttggtaatccatgcgtctcagcttctctttgctgcaccttctgtcattttctaattaaacggttgatatgtgttattccttaatttatgggttagttattactaacatagtacggagtactccgtaagtagtactagtatttatggtttttgcgaattgcaagcagatttctggatttttcacattttggtccttttaaaaaacttatttcgcaaatagacccctaaaaaaacttattctaaaaatggtcctttttaggcgccagaatagctggctcccccccccccggccgaaattttttatttttgttttatttgtttgatatttttttcacgcttagggacacacaaaaaccaaccatagaaaaattgaactcaaatggacgtaatatgtgacctgtagaatttttccactcctctcctctctctccaaaccagtgcaaaggagagatgtgcaacttttttatttttatttttattttttgatatttttttcacacttaggaactcacaggaatcaaccatgtaaaaaataaactcaaacggacgaaatatgtggcatgtggaattttccaaagttctaccgaaaaacttctcctcgaaaacacaatcttacaagcggaatttggaggttttaatatcgccgaacccggcaaagcggggagaatcggatgtaatattttctgtagatgtccgtgcatatattatttgcctgattccgagttcgtatgagaaagttacgcctattttaatagatgacatattttgtccgtttcgatagagttttggaaaattctacaagtcacatattttgtccgtttgagtttattttttatacggttggttcctatgttctcctaagtgtgaaaaaaatatcaaaaaaatgaaataaaaataaaaaaaattgcatctttatgtactgtttaacttatatatgtcatttcatgtggttatattttgaattagattaagtaatttcatatagtggtagagtgtattatgtttaacatgctgatcaaagggttttactaaaggaattatggtctaattttagtgaaggtgcaaagtagactaagtggtatgctagctattttcagacttagttaagtggtagttcgagtttaaattttttttgtggttggttgtatcgtgatcctaagtgtgaaaaaacatccgaaaaaataaaataaaaatgacaccgttgcaactccatacagagaaacaggaatggaggcggcggcgccagcatggctggcgccctcctcctgccacgtcggttcgcgtgcaccacggtggcaggaggacggcgccagcctctctggcgccgtcccgttggatgacggcgccagccactctggcgcccaaaaaaggaccatttctgggataagttttttcaggggtctatttgcgaaataagttttttaaaaggaccaaaatgtgaaaaatccagagcagatttccagtgaacgacaccatggtttttgtaacttttttttccttctgcatatatacgtaggttacacgaaggatttgcgacacagaactcaaattctgcgtgaaaattgcgtgccaaacttctagtttttgtttgttcctttctgtatcagactatgttcgttttgggcttgttaccaagctgggtaatgattaatgaaagttgcctgttgtcaaaattaaaaaaaatgcgtgccaaagcaacggtgtggaattgatcaatcgtgcacacaaagtttgcctcaaatgtgaaaagtgcaaacaaagtatggcacagacatctcaggcacaataattgtagccagcagattcgacaagctgcagttgagctaatgatatattgtctccaaccaaaccaaacacctcttcatcgaattattaggatttggccttattagtataattgctcagaatcacagaaattggctcaaagatttaaagtagacgtaagttcagcaatgtatttttttttcctcaccttttctaggcgactggattgttctaacttctgcaatatactccgcaaagaatgttattaggttacaagagggaaataaatgcatgtagagcatgaattatgcaattcctgcgtgagtttggtacccacattgcagagtagcacaagaataatttgtgtactactcttatgttgtagcacatactcaagccatgcctatcctctcaaacctattgtagtgtactgaactattttcatcttgctgtgtgccagcaaaacacctgtaccactggaatgtttcgtgtctgtcctgcacctgaagattagccttcccaactgatcatcaaaattgtgtccgagatcaactacacaaccgtactggccaactgaattaacctgtatttgtaaatgtacatgacattaacaccaattgatcaaggacatatgataagatagagtataaacctttcttttttgccacttaaaaaacatgaactccagaattcaaataagctagtgagcttctttataaaaaggtgtttgtgtgttcatagtacttaccagtaatgacaaaaatgaaatccaatcaggttctgtcacacctactgaaccatgcgcttcctctttgatcttttgcccttctttccggagtaatttggaagtttcttgttgctactggaattgtatctttcctcaggtcctccctgctgtccgttttacatcagtaattgaaatttgttatgattcacacggactattttaaggggaatagtgattttctaagatgactagcttgaactgtctactacacagtgctccagcaggacaaatgaatggtaaaaaaagattgagtacctcttcagtagtctcatcatccgactcttcatcctctgatgttgaggctgaaagatctgaatctcctgcagcaagcgctttgttgccttttctcttgctctcctcttctttcagctgtttaaatctattcaagatatttttgtaaaaatcaaaaccagaatataatagggttaaaagccatgtgaggttcaaaagcacctttcaccaggttgggctggttgagcactcgtacgttttgctcgtcctgcagtaattatcccactacccccctgattgacaacaggctttgctcctcccagtttccgtaaccaaacttgctgggctgtgctgaggatattatttgtgaacctgatagcaaacatggagtcaatacacatattggatttgatcaattgcaagaagttaatgagcagtggaggagtcccacaatctctatgaggcatagcactatagcatggaacatgactgaaacactcatacaactaatagcaaatgcacataccaataaatggacaaccctgacggcactgacaaagagaaccaccctatcataaatggaagaaatttcaaaacaagcagtgtgttcttctgcgatggatcatcagtctgcagaaaaaaaggatcaaattgccagccactcatagcttgtatagtggcaatatgacagatgatatagtaatttagagcaccgctcgtctgctcacctggggtggcttcatgatttccatagagacaaactgagaagcaacaagtagcacaggcaacacaagataacatatcgtgtcatgccagcctaatggaggatggccatcctgcacaattcatttaagttgtaagtatgatttaccatctcaatattatgcaagtacatgagtaatatgctgttttactatcatgtctctacaggactataaattggtatgccacgccatttatttcaaccagagttctaaataataggcaacaaaatgcgaggtgcaaatagctaagcttcttgttgcttgattgcttaaatgactatgggcagaaacgtgacactaatctaacttgacgggtatgtcaaagtcaaataaggggggaaaatgaggttaaattcgctcaagtgcactataaacctgattttcctagatcagcaatgaaattgttgatatatgttaacgtgtgatcaattttattaccacaaaaggcaagagccaagaaatgccagcaccactttgccgagcagcaattgttgtagggcctcccaaagatggaatccagaaaaatccttctgtcagtaatcccttcagagaaatataagccacttagaacaaaatcctcttaatgaagcaaatattaggaagcaggatttgagttttacctcgtttgctacatttgaaagggcttggtagaggccaatccagacaggtattgttgccaaagttggaaaacatcctggaagagaaaccataatatcaaaacactatatcacaaaagcaatctcacttaaaactttaaaaagccaacaattggttttgcaagcacatgatggcaatagatgcattatgtcgagaaatagaaaatatgatcaactaataaataacaaactcatacaaaaaagatgcaatggaacaattcaactatcaaagttaataggctaaagaatggagaagtaagcgacctgccagagggttgactccagcttgcttgtataaccgagcagtctcaagctgtatcctttcctaataagagttatgtaggagtgatagatcagaaatgcccaaagatatgtgcttgaaaatataaaacacaacagtgaaataagaacattttttgggaagatagttctaccttctatcgttaaaatatgcaaaacatatatccagaaacaaacctcagtgttcctactttaatatccatggcgtgcgtaaaagataaacaaaacaaacctgatttcctgcatatctctgttgaattgctttgatctgtggctgtaaattctgcatagccagagttgattcgacctaaaaaaagagaggaaaaacagcacaactctcaacccaccatatccatgttactcattaattaaaaaatagaccagattttatcatttacctgttgtttcgttaaaggtaatgttgcagccttcacaataacagtgagaagaatgatggcgaatccataagagtacggcacatgaacagctgacaggccatccttcagcacctgtatggtgatactcacatagtatcagcattccggagccgatgaatgctatgcaataaaatcctaacagttcttgaattgtaacatttcatatcaaaacctgtggataggaaaatgctaaacaatgcacgcctggtcataactagatataagttacttaaaaataaccatgccgggttgccgtctgctcaatgtttagtaagtttcagagcatggaggcgtcataattaagtgcatgcacatctactcctgcactctccacgaacttacatgactccaaatctccaattccccaaccaattcaccagaccaacttttgcaactcagggatatatccattaaccaatcttagcaatcctgaacctgaactcctaaagtgacttggattcctataggtttgggagaagacggcggcgcttaccttaagcacgacctccaaggcctcggagatgaacccgaaccaccccccgttcttctgcgccaccgacgccgccgcttcaccgccaccaccaccgccaccccctcctcctcccgccgccgcgtccgccgcgacgacagcggcgtcggcgagcgtgtagagcgccgcctcggcgcgctccagcgcggcgtggaggtcgagccccgcgatcgagtcgagcccgtggaggctcgccctcaccctgcacgccgacgcgcggcggcccccgtgcctccgcagcgaaggcagcgtcagcataggcagcctcgcggcggcggcgcggggctgcagcgaggggagcagcgacgaggagaggagcgccttggccatcgcggggggtgcgggaggg

SEQ ID NO: 75428 - DNA, 47383 bp, Oryza sativa
  unsure (1)..(47383): unsure at all n locations
atatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaaattttgaaaaatttgagtgattttgtgcattagataccatggtgtccgggcaccatggtgccccatatgagtgtactatatatatatatatatatatatatatgtcattccataggaacttcaaaggaaaggaaatgattcaacccttataaaggatttcataggaatttttcatataagattgaaatcctccaaatttactatgtttttttttttacaagtcaaaggggtctagtagttagaataccttatagctagaaaaaaacagaagaggatattaagttacatgcaccagatagttcacatgaaagtttaaactgaagcataagctgaggagaaaagatagacaatttacttgtatttcaatagaggacgatacattgagatggatagcttaacatattacatatctgacaataaaaaatggccttccagaactgttgttgatacaaaccagaagataacaaatcaaatttcaaatactgagatggctgaatatggcggcccttgttctacaagttgggtcatctcagatgttgaggtaaaagatatcagtgattccattagacaaaatggggtattgcatcagcttcacagagcaaactacaagcctatacatctgctaaaaaaatatggttacatcattttgttttggcgtcacaggattgtgtacatactatcttctaccaccatctttcttcgaaaatatgcgcaagtttgcagtctgccggcgccattcatttatagggacctaaattcagtgggcacagcaaacatttgtgagtgaaggaaaaagttaaacatgtaatgtcatagctataaaatgaaaggcttactgctggaaaccgccatagtcaccgggtttctgaatatcctttgtcaccgaactatttgctgcaagccgaacctgtaaatggattgaggaaaaaaaaattgaatggttaaagggcctttagagttggtcaaggcttaaaagaatagattgagcaatgtagttaaatttgtaatacagataaacacaaaactgaatagagactgaagtagtattaaatcatgttagcaggaagctatgaaaaaagaacagagatgggaaaacagcacctttgaagcaatggagacgtgatcccgaattgccaccctaccacccaaggttacatagtcccccaatctgttgatacatgccaatgacacaagttactaaatctcaaaaagcaggcaaaataaacatttagtcaatgagatgaaggaatgcatacgttgcagaaccagcaattcctgcttgtccacaaatcatgcaacactttccaattactacattgtgaccaatctgcaagaggaactgtcaatttggacaacaagggcggcggaagtccaatcacattaagcagaatatccaatacctgaacaagattgtcaattttggtttcatctccaattactgtatctctccaactgcacttagtaaataatgatgaaaatttccgctcgcgggttaggttcaaccaaacatatattcacaaagaaagagctgatattacaaaatgtttggtatatttaaatcaaccatggagtggccaaaggaacatttgccatttcaaggctgacaaattacctccctctgtcaatacatgtattgcacctatctccacatgatttccaatttttacatgcaacatctggagaagcataaagcttttcaacatatagccatatgatgtttcaattgaatccaaaacaaaacatctaaatacagtctatgagagtgatagtcatcaaacatttgtatcagaagtacttctcccatgtcactggcattttctcagtttcttttttctgtatctctgataccaggtaagcacattgggtgaacgtgacaaatgaaggactgagcatttccttatccttttaatacaaaatgaaccctctttgcgatcctagaatatttcagctaaccatttcactgcccttccatttggaaactactaactcatcatcttcacagaacgtttactaagaaaagggttgttagagagtactagcctgcagtttcttcttaacctgtccatcatcccccacaaagaaaccaaaacctgaaacagatgcatcaaactaaatagcatcaggatgcaagttttaatgcttgatcggagtacataaatcaatatctactggagcatcaaacaagaatagcataaaaacaaaggaaacccaaaaggttgacatttaaatagatggactggacttcaatccacaacaataaatgtaattgggcaaaagtagtgaaattctgaagacagttcacaagttgagaattttttttcctagtttgacatgtgtgcaggtagcagaaagaatccaagattgcagcaatcttgctagttactagtaccctcactggcagaaagagtccaagattgcaacagtcttacttatccctcactgcatcgttgatatcatgtaatcgtttgagaactgaatacatagatgtatgctcaccatcttgaccaatgcaggcgccattgtggagagtgcagaactcgcccaccgaacaattgctcaaaacaacattgtacctgcacacacatcaacatcaagcacactcagctcactaccagcaaaatcaaatcaccaaatcaaacagaattcccccctttgtattcagatcgaatcgtagattagaaacaccattaccagatcctggttgactgaccgatggacacggagggcccgaccacggctcccgagccgacgacgacatccttgccaagaacggcgccggagtgcacgacggcgccggcctccaccaccgcggtggggtcaacggacgcggccctgtgcaagacgcccccgccgttgtgccacgggacgaactcccccgaagcaaccgccgcatctggaaacatccaagaagaagctaagctaagctaactcaagatcaagacgggaagcatatataggagaatataagttgattgctaccggaggaagcagcggaggcgccgccgaggaaccgcgcgaggcgagcggcgtggcgcggtggtgcggagagccggaacaccgccgccgccgccatgggagccgcggttctgcgcagagcggccgccatgtctaacaacggcggcgattcaaggtttgagcgcggcgttcgccggcggcgcgggtaggtgggtctggggactcggctttcaggcccatgggtgggcaaggagatgggccagcgtgctgggctaagaggagagaaaattgggctggccttcagcctgtagaataaagaagacaaaattggttatatagcatcaatgttcacgtttttttattttatagtatcgaaagataccggttcactttaatagcatctaaagtccacattgttttccgtccgtcttgattgctattgactcagccacgcacacggtatgatgtctctacccctcattgccatgtattctactcgggtactattaaagtgaaccggtatctttcggtgctataaaaccaaaaacgtgaactttagatgctactatataaccaattttcccaatatagaaatgaaggaatgccataagcctataataacttattgagtggaggaattaaaaaaaaagaaaaaaggggaggatgaaaaaggaaagggggagaaaaaactattccctttcttaaaatgtgccttcttcgtgtttgaaatttggtatgaaattattgacgaagaatttgatctaaaatataaaaacttctagtgtgctacttctcataaatcacttgtttatttttacctaatgttatccgcaatgcacccttccaggcttccactccccatcccctcatttagtgacattatatcacttttcttttaaccttaattcctccgaaaagaccccaaaagtctttttatggagtatattggaaggagtgagtaataattatttcgtttattattatgattattagttaaatttgaattatagaacttatttttgaatttgaatttttggttctttcatcgtagtgtattttatagcatttattttttagtcgctaaggacacatatgtataagttttactcataaataattttttatttaataataagctatttggataagcatatgaataagcgaaacaatgtggctggaggagtggaaagagtttagataaatttctaaaattcctttattttcaaatatagaaactgttagaaattgaaactaaaaccgaaagaaaagaaactagaagtgtgacaaacacacaaaaaaaaaccagtgacgaggcccacagattcatgaaaatggagaaagcagcatgaaactttagtccgcactcgccccaccgagcgaaaagttattcaagcccacagattcacaggtctttcatgtggttgaaggaatctcacggaaattaaacttagggcttgcttagttggcaaaacatttacccatacatgttacatcggatatacggatacacatttgaattattacacgtagtctaataacaaaataaattacagatttcgccaggaaactgtgaaacaaatttattaagcctaattaatccatcattagtaaatatttacttagcaccacattgttaaatcatgacgcaattaggcttaaataatttatctcgcaatttctcggcgaactgtgtaattggtttttttctacttttaatacttcatgtatgtgttaaatattcgatgtgacagtatgaaaaattttgtttgggaagtaaacatgcccttaagaaaatctgtagtacgatccaaatgagcccatccacaaaggaatactttaggagttaggacggctgacaaaagtgatcaggcatagaaaaatggacgaatcaactaaaatataaataaccctttgcatttatattattagtgatttaaaaactagtgatgtaaaatagactaaagaaaattccaaaattaattttaaaattacatttcggttggctacggctgataagccaatataacaaaatacagacattaacgttgatactccctcaatcttaaaatagagtaacatagtactagcatacgcacactttaggacaaaatataggaattcatggcaatagtaggttataggctgtatatgttactatattttactcttcccgttgtaaaacatagggattatgatgtgtcttcgttaattttggttaataacttaatatattttaggatggaggggtagaagttgtagaacggtgaaagtggttaagggtaagtactatgagcatccaagcacaatcttttagatgtcacataagctaaaatagtgaggtggaggagagaagagatgagagagataagcagccacctctcatgcaagaggcaaccactgtataaaattcaagacaaaaggagagaggggaagagtagactggacaaacaaacattggggctaatgtattaaaattagtatagatgtgatatattgtacatgttacctctacatttattagttgatgatgtggtcaagattagatacaacatccacctcttttataaaacttgccctaagattgatattttattttgaaggagggagtacacagtgggtctgttctgttattatttttcacggctgcggcacagccgacacgaacagagccgtactcagtgtgcgcagctgcaaccgcagccgcagccatggtagccgacctaccgaacgctcccgttgatggtcttaaggctgtgtttgggaggagccgacacgtaaaacgaagtacgtattattacatgattaactaaatattaattattttttaatttaaaaggattaatatgattttttaaaacaactttcgtgtagaaattttttataaaaacacacagtttagcagtttgaaaaatatgtgtgtgaaaaatgagggaggtgagttagaaaatctgggggaagaacacggcctaggcggtcagcagcgaattttggtgagcagtgttggtcggcagcgtgctctggattatggatgaaactggttcggatagtttccgtctgtccggaccatttttcggattcggatagtttcggtcggaattatccggaaattatcggattcggaaacgaattcggatatttttttctcggaaacgaaaacgaatacaataagggtactatccgtcggaatcagaaaacggtcggaaactatccagaatttttttcggatatccacaaacattgaacaaattttagaaaaaacacgtatatatacataactttttcatacgaaatcggatgaagataaactttatatcaatattgtagagctcgatgagatctacaactttattattgactattttattatttgaggtcatttaagggtctaaatattcattataatataccatattaattttacaaaatcttagatctacaattcaaacgacatctgatggagatgtgttccatatcaaaattgtagagcttaatgggatctaccactttgtagtttataacatttgtatttgaaggcatttaaagtataatacaaacattacaagttttgaagatgtgaagtaaaataaataacatctctaatttatacaatggtaagtaagttatatatctagtaaaaggtcttgggaatagaaaataataatcatatttgcatatggtcttagaggaaatcgattatcacatacggttgtgggaccgtctacaaaattgacgatataaatgttggagatgttgaactaaaataataagtgatatctcttccttgatcaagaaactcaatttgaggggttttttatataccggtaaatattcgctaccgtattcgttccgtctcgtattcgctccgtatctgtattcgataatattcgatttcatttctaattaaaaaaaataataaaactagttttcgtccgttttcgatccgttttcatccctctgatgccgccggcacgagcggaaaggtccctgcacagcacagcactacacctccgctggtagggtagccacacgtccgtcttgccatcttggtgtgccttggtgcttctgacacgtaggccaccgagtgagcattttatattttctacttacctttcggcaacgatttctttttagtttatttattattatcactcctcacatgcacatgtcactcctgttgtttatgttactcctatataacatcatccattgtacagtactagtaccatgtggatttttttatttttttagacttttttattttaaattttattaatagacgtttctaaaaagtatttccaaatcagaatcccgtggccaaataactttgtcaagacagtgttgttagctagcgtgacattcaattttcagaaatactttttaaaaagatctattaataaaattaaaaaaataaaaaaattataccacatgtcaatgtgtgttcttccgataatgcttgctagtacagcaagcagcaaccttagcacggaagaaatgatgaattccacaggatggattatggtttcttcggtactagtagtaattcctgtttgaggatttttcacaaaattatgagtttctccggctctaatttaaagagcagaaaagttcaacaaaagcatatgatataccaacttgactacgcaatcagcaggcagcatctattccttgcaacaaaagaatgtaccagtactgttccatccagatccgggcatctcacattgtcattgtcagctcctccacaattaagcaacctagccttaatcatctgcgcttcccaacgcccaatttgttcggtagtgataaaaataaaaatacaggaaactattaaaacactactaattgagttttaatttttttttaaaaaataaatttatctaaatattttaaaataatttctatatataaagtttttgtacaaaatatatcagctgtttaagaaacatgttaagagacacccaaataaaataaatctgacgtgtgtctctctttcttcttgttgcttcttgcaagttaaaccaaaccaacccaaaccaaagcagcagcagccagcaggaacagcaaattaaatttgtccaattaatgccatgtttagtttcaagatttttctttaaactctaacttttccatccaaactttactacgtataaacttttaactttttactacacacaaacttccaatttttctatcacatcgtttcactttcaaccaaactatcaattttgggtgaactaaacacagctttttttttcctggtttctttctgcttctgtgttcttacccacctttttttttcctttccaatttccatttcgtagtttactttacttgtttgttcctcctcttcttccctgacacgacacgaacccgaccacacgagccttctccgctcgcgccgccgccgtccacgcccatcgctcgccgtcgccccccccgcaattctcgtcgccttcgaggcgcgcgctggtccgccgccacgccggctgtgtgggggtctcgcttgcccagatcgcttcggctcgcctcttcttccccgacatcgcgtctccgcctttcctccccgccgccgcccacaggtgagctcctcgtatgaattctgagccacagcaattattttgcaaatgtgccaaggtagaaagcatcctgtagtacagagcaacaagctttttttttttttgcatgtgtgttcttcccccatgaagagacaagtgaacaattgctgccagaacttttgtttttcgtatgtgtgttcctccttcctgaaggaagagataattgaacaattgtaggagtcttggtaccagaactttttttttttatgtgtgttctcttcccctgaagagttaagggaacaattgtaggaagacctagtactagaaccactgcagtaaaataggggctttactatacagctaatgaaataaatataccttgtaggataccatgctaatgtgtttaaattgtgttatcttctgcctgtgggagtagcaaacaatccacgcattttttttaggatccttccttttaagttgaattcagggcaatgcattgaataaattcgtttgatctgttaatttatgagcagcaaggcacattctagtttcgtgtgaaaaaagatggatttttcttgcgtccacttcatgtttctgtttatcttagtatgtttcatttttgtcttatgcctctgaatatcttttagaaatgatttctgatgttgacgtttgagttcactactcgcttgaatgagtttatacatcagcatttttttttatttatgcagctctgaccacaagtctggaacatttctccagtgaccaagtgctcacactttctgcttcggtttcaattatgaattctcagtgactcagggagccatatttctatgggaagagaaaagctgcgcaagcaacgttctggtcgtctgattgaaaccctcaaaatggagagggtcaggactatcctgactcatagatacccatacccacatgagcactcaagacatctcatgattgctgtatttgccatctggcttttcttcgtttcatcggataacttgcaaactcttataatgaagttggacaagaatttcaaatggtggtcgatgtatgcttgtttaattggtttcttctatttcttctcatcaccttttattcgaaagactatcaaaccgagctattcaaattttagtcgttggtaagcaacctcttgagtctgtgagaaggtaaattaagcaaaacatggtgtatttgttctctaaagccgttccctgctgcaggtatattgcttggatattcttggcagcattataccatctccccagttttcagtcaatggggttggatttacggatgaacctttctcttttcctcaccatttatatctcctctctaattttcttgatcgtatttcatgtcatctttcttggcctgtggtatttgggcctcgtttctcgtatggccgagaaaaaaccagagatgcttactataatccaaaattgtgcagtaagtttctttggatacagtaattatagaagtgttttttttattttcacctaatcttgtttagttaccacttatcagctgttccttatctatgtttttgcattttgtgctgtgttgcaggttataagtatagcttgctgcgtactttacagccactgtggtaacaaaactattacgagagataaatccattgaccgtagaactgctagctgggttgcgttctctctgtggaaaaaacatgatgacaattcactgatttcaaagctattgcgcatgcataagtttaaagagcagatttgctcatcctggtttgctccggttggctctgctagcgattaccctctcctatctaaatgggcaatttatgaagaagttagtattgcttcaccttctgtgtttctcttgatttttttttagtttattcttattttttttatgtttgctccagttagcttctaatggatccgggcattccaatgacatttcacctgtctactctttatgggctacattcattggtctttacatagccaattatgtcgtggagcggtcaaccgggtatgtcaactatcttaacgtatccacctgataactcacttgtgtactatggaaatttagaagacaaatatatggattctttcatcttgaaaaagcaacagttgatattggaaagggaactaacttcaccatttgttcatataacagagctgtatataatatgttaatgttcggttttttaactttcagctacatgaatatttagacatgttcacaatttcacatgcttatgaaatctaggagataactaaaaagggaaaaaccatgttcacactgtgtaatggccgtgttttgggttttctaccacaaaccagatcatttgaaatataatgatctgagttctaattcttttttgtataatggccaaataataaagaaactaattgtttccttggttatttagtttttctcaactcactttcttatctttgtttcattcgagttgcttatagatgggctctaactcatcctttgacaatgtcggagtacgaaaaattgaagaaacaactgaaaccagattttgaggacatggttccttggtactctgggtatgctgatgacactctacctcttgctacctcgcttggtgtacacagtgactaaatattcgtcgatttgcttgctctgcaggacatcaactgatttatttaaaaccgtttttgacctcatggtatctgtgactcttttcgttggtcggtttgacatgcggatgatgcaggtatgtgacctgttgaagttgaaacttgttcctcacttcctctttttattttggttgttagttttcagcttttccttatctcgtgaagtcatgatcccctcttcactatttttttcccactatgtttcctgttaaatggatagcactagaatgatatatatatacttccttttacattgtggtttatgttttcacttcctatcgaggtcatttgtcctgttaacttaaccattgatattttctttttaattcttgaccaggctgctatgaacaaaactccagatgaatctaagagtagtgacctgttttatgatcatcttgatggaaaagacgaactctggtttgatttcattgcagatactggtgatggtggcaactcgacttatgctgtagcacggttacttgctcaaccttctttagccataaaatcggatggctctaggcagacatttccccgtggacagctactccttattggtggagacctagcgtatgtttctatctttggtcatacaatttgcgttgtaaaaaattctcgattaatatggcctaagtcaaggcgagcaaaataattcatcgcagaatgtttttgttctgcaagctgaaattttagctatggatgatatcatatattgtttttgtgtcatctcattagtaccctttccattgttattagttaacttatacagttttggagtttccatattgatattagtgtactattccacaaagatgataattttgttccttttcccacagatatccaaatccgtcttcattttcatatgaacggcgttttttctgccctttcgagtatgccctccagcctcctgcttggtataaacctgaacatatagcattggagaaacctgaacttccccttggagtttctgagctcaggaaatatcgtggaccacagtgttttatgattcctggaaaccatggtaactgtcacacatctgtaattttatgcagtagcatcatggtttacaaagttttcttaccatgtattccttgtcattcgctgatgtgttctatttgttatgctaatgatgttttggtatggaatacccaattatatttccatgacgctactgtgggttgatctattgaaaaacaggactgacaaaatccacattgttttgagcagattggtttgatggactgcacacattcatgaggtatatctgtcataaaagttggctgggtgggtggttcctacctcagaagaggagttattttgccttaaagcttcctaatgggtggtgggtttttggccttgaccaagctcttcatggtgacattgatgtctatcagttcaagttttttgcagagctatgtcaacaaaaggtaagtacattgcgtcatctttaggctattagcaaattatttttgtggtgaatgctatggtctacatttgtgaatttgttgtttcggttcttctagtgaaaacacaatttgattgtagtacaccagtgacattattctacaggttagtaatatgtactagacgttgttatcatgaccagaaaattatgcataatttcacgtgaagtttaccgcgtgtgggttttcttattgactaatactacttgtaactatgcaggttggagaaagtgattctgtaattcttataactcatgagccaaattggcttcttgattggtactggggtgataaaactggaacaaacgttgagtatttaatacgtgaatacctcaagggaagatgcaaactgcggatggctggggatctgcaccattatatgcgccattctttcattgaatctaaagaaccagttcatgtgcaacacttacttgtaaatggttgtggtggggcctttctgcatccaacacatgtctttgagaatttcagagaattttatgggaacaaatatgaaacaaagattgcatatccttcttatgacgattctagcaaggtaaggttgattcctgcttgtgtgccttcagcccttcatttggttcattacatagcagagcttgccctttcatgttcatgagccgattctatttattgccaatttgacttctctccattgtttgcccttccagattgcacttggtaatattttgaagttccgaaggaagaattggcagtttgatgtgattggtggttttgtgtactttgttttggttttctcgatgtttccgcaggtgagagactaaattatttatgaattatttaattcatagtaaatcattttgcttatgcactatgtggttaatgtgaatacttatagcctagaaagaccatccaattttcatatgcacgaatgctatattgtaaagtccatgaaggattgttctccaacagcatattatatgcttgtctgattaaagtagtatcgtatatgtttggcacggaaaaataaccttggtggtatgagttcattgatgattatgccctgctacttacaattgatattggacatgacctatactctccagagtattttaggacttaagaataatgcctgatatcctctatatagttttgttttttgttgcgttgaattggatttaggaaaattattagggctttgctcatagaatcatttcaggcctattcccaagggcgcattaacatatctgagacttcatgaacatttctcataggttcatagttgtactttgtaggtttagttgcctgtagtctgctccatgaactctatggaccaacagttggtgataaataatgttcatctagacaattaatgtgcatgcaccatataatagaagctaaagcaacaagaaccacatttcaactttgggcactagagtatcaaatttatattagagcagtgctagaagtttctcaattactgttcttttgtggcctgacataagtatatattattttcagtgtgattcctttcgtatcttacgtgaagactcttgggctgaccgtgtcaatagtttcttcactgcaatgtggaatgttgtttttgagattctggagcattcctatgtatccctggctggtgttgttactctattgatggtatcttttttctttgtacccacaaaactatcgcgtagaagacgtgccttgcttggttttcttcatgctgtggcccatctaacttcagcagtgatactgatgctgcttatggaattggctattgagatatgcatccgcaacaatctattggcaacatcaggtcggtgtgttatctttctttttttttcatgcatcgttgcttgatatatcatgtaatgtttgtgcaagctttaatcctgtgttctctcttggtttaagatggcagcattccatttttaccacggcttaccacagctgtcagaaacttaatgcggttctataatagtctatattatttaatgtcaatttctttggttataactccatttttttttcataagaacttgtgtctaactttattgttacaatatgggtaatggtagtcatcctaaggttatcagaaatgtttggagaagagactaggacagtgtactaacttgcaaccattgtgtattcttgaattggtttcttatacccttttatgagttggcaatgtggcacgtgtttatttgtacctctattttatgtctcaactatttaatgcctgaaatgttcattttctattcctgtccttatccaggctaccataccctctacgagtggtatcgcaaggtcgaaagtgagcattttcctgatcccacaggacttcgcactcgtctggaacaatggactttaggtctttaccctgcatgcattaagtacctgatgtctgcatttgacatccctgaggttattcttcataaatataccagaatcgctatttctgagttcctgtaccattttcaaccctgtaatgtatatttgctatttcaggttatggcagttacgaggagcacaatctgcagaaaaggaatagagtcccttcctcgaggaggagcgatcatctactatgtttgcgtcttcctgtacttttgggtcttgtcaacaccagttgtatcactggtgtttgggagctacttatacatatgcataaactggtttcatattcatttcgatgaggccttctcctcactgcgcatagccaattacaaggcatttacacggttccatatcaagaagaatggagaccttgaagttttcacctttgctgtcgacaaggtaagaagcctgccgatttaatttatgtttgtcagcttagcaatgcatcgatcaaacatgctcgctctcctacatctttcatgtatctggaaccccaagactaagatatttatttaactcctggaaggcatctgtaaaacatccaaaaaagttctcaagaagcaaatagcatttcctattgatttttctccagaactagactagacctaggttatgtagactcggaattatatgtcgcacactgttcccaaggattagcaaaatcgaaatagtgaaattcttgggtcatttcaatgggttaagttatggattttttcagtgagacctacataaatgtttctctttagaaagaaccaaacaagctgttgtgctttgtgaatcaatcaggtgccaaaagactggatgctggatccagactgggacatggagccaaaggagccattccagatgagctacaccaggaagttccccagcaaatggagggccgcctccggctcggacccaaccaatgcggtgcggatcgtcgaccatttcgtcatccctcggacacccccagattccccaacctcaggatctgctagttgatcaattgtagcctagcttaagatcatagtgttgtaatgtacagtgtagtagctatcttgttctatctccctgtataaattgtacagcaacacaagaagccttctgacatactctagcatagaagaaatagggaaagaaaaagaaaatgagaaaagggtaggatggggcactgcttgtaatgctacagatgtttttgttaaacgaaacattattggttcagtaatgatggttcattgttgtatgatcattgtgcaaattgcctctgatgcctgggcaagtgacttgatgggaattttgtgctgtcagtttgtcaactctactgtttatggtcactcctagttttggtgccatacccgtttatgattgagtacttactactactaaatgactgtgtatcaatgcaggtaataacattgtttcgatcagatgtttatcttgacgataacattaacagatgatgttgcctgccaagttttctcgatatctctaattcaacagtaagtaattcgttcctggcaaatattcactcgatatctttgcttgttggcttattagacatagtcaattttaaattttaaatttcatttttagagttgattttatgatttattttatcctttttttctgctcttatctttaaaactactaataatacaaatataaattttaatcatatactacttccttttttaatagatgacgatgttcaccttttgtcacacgtttgaccgtttgcttattaaaaaaatttacgtaattataatttattttttatgagttgtttttatcactcaaaagtattttatgtatgacttatatcttatacatttatataaaatttttaaataaaacgcattgttaaaaaatgtgttcaaaattaacggcttcatcgcttaaaaaaacgagggagtattacttttagtcgcttgatttattcctctacgactcatcggtcgtagctcaaaaacccaagacaaggaaacaatcaaacaatggtttgcgtacagaatacaaacagaagacatgaggaaaaatcaaaaagcaaagagcggccgacatgtgaacagtagaacaagtcggtgggcgagacggagaccggaggtggagaagacggtggagcagcgagacgcaccgacctcgccggcggcgtgcgtggcggcgcatgccggtgagccagtggcggcgccgtacattgctcctccccccgatgggccatggccgacgcaggccgcgccggcgatcccgactgtagccgtccagcccattaaggcccaataagagtctttccaatggtggtgagtggtgactaacgaaatttggacatattgactctttcgaaaaaacttatttcaagaatagaccgtgtcaaaatttgttgtaaaaatgaaataattttctcagcactgccaaacctagatgtctctgagctataacacctgtgccacaagcattgatgctaaggtcctatccaatgtatgtgatgctgagctttgatagcactaagcaaattgttagtttttagtaaatttttggcacaatctacttttaaaataagctttctaaaagggttaatttgtcaaaattttgggactaaccgtgacaaacatgccactgtatgacctcaaccatttgtactgatgaagtgctattaggtgtacataaagctcgcgattgtgtgaatttgtagtatggtcatcgattataaagtgtttgtgtgagtttgtgtgtgctattgccgtaagtataataaagttgtgtgtgctatctttaaaagtggattagataataataaggtgaagaaaagaactgaagagacaagatgcgatgagtcatcccttacttaaaagacaatatctacataacctctaagaaaaaagtaggaagaaagcgatatagtatgattaaaaaaaataaaaaaaggtttgtatataagaggttatgttatacgtatgctaccttttaaccgataagtagacgatataactaaagtttaaaggtagtaatactacaaactacagtaaagatcaaagaaccgattatcacattgatggtttcaaagttgaaaccttttggtgatttgaaagttgcacctctcatgctcctaatggctgaagtactccgagtccatttaatgtaattatagtactaatatattctctaatcccaaggactctgacattgcaacgtcaacttaacaatttgtatgcatacgtgtagcagctaacagccacaacaggggcgtttgcatgcaaccatgtaggagtactctactagtgtacgccattcatcccctctcttattttaaacatttctttattgaaacaacactgtttaaatttaaacaaacctacaaacagtttcaatcgaagtagacaagctacaccggttggttggttgccggcgtgaacgcgtcaaatttggcaaaattcataccaacaaaatttacagctcagtactatactactactcctaccagtaaaagccaactagaaactgtataaaagggcacaaactgcgccgtccccgtccatccaaacgaaacggtaaaacctgtccgccgtcagccacacaccccactgacaaccgggccccactcgcacccccgccggcgccgtcccctccctcccggtcaccgccatgtgggacccaccccaaccctcgccggccacctccccaccagtcagagagacacgggcgcattgaatccgtggcaaaggcagcgcgaagcccgtgggccggcccggctggcacgtgggccccaccaaaccgctttttttttttttttggtgtggtttagtcgctcgcacacatgccggtttcttgtctcgtcttctctcctcgcctcgcctcgtcgccacctccacccccacgcgccgcagtcaactcctccccccaccccacctacgcatttcggcgaacacctcgcctccatggcggcgccgcggtgagtagacgaagcaggcatctcatctcccatcccatggcgctgcgggcgcggttgaggcggttgctggtggtggtgatcctcgtcgtggtggaggtggtggtggcgcagcagcagcagcaggagaggttggcgtcggggtcggatttggcggggctgttcagcctgcgggcgtcgctggggatacgggcgagggagtggccggcgagggtggacccgtcggtggcgggtgggccggggtcacctgccgcggggggcgcgtcgtcggggtcaccgtcgccgggttccgccgcacgcgggtgggcgcacgggcgccgaggttcgccgtcgacggggtgaggaacctcacggcgctggaggtgttcaatgcctccgggttcccgctcccgggggagatgccggcgtggttcgggcgcggcctcccgccgccgctcgccgtgctcgacctccgctccgccgcggtcaatggcacgctcccgcccgatctcggcgtgtcagggaacctcacgagcttgctcctctcgggaaacagcctctccggcgccgtgccggggtcgctgctgtctgtcgccgggcttcggtttcttgacctctccggcaacaatttcaccggcgggctgccgaatgtcacccccgtcgccggtggtggagccgcctcgctgttcaacgtttctgggaattcgctgtatggtgtggtcagcgatgccattggggccctcaaggggaggttccaggtggtggacctgtcaagcaactacttcgatggggtttggaatgtgtctgatggaaatgtagatgttaggatgaattgcttctccggtgcgccaggtcagcgcaaccgtgttgattgtgaagagttctataggagggcaggggtgaggcttggtgatgctctagctcccgcaccttcgccggagacatcaccggggacgacgacgaagaataataacagtaggatatccaagggtgtactgattggagttattgctgccgcggcaacgctgatggttgtgttttttggtgcattggtattctgcttggcaaggcagaaggcgggaagaagaggcgcacgcgggagaggggtggatacaaatgaggaaagcacacgtggcgtgcgcaggagggatagtagtgtaaacccggtgacatcaccaccagtagcagtgtccccaagtgccaattctggacataaggatccggttgttgtttccggtgaatttacctttgagcagttggtccatgccacaggcgggtttggagatgacaacctcctcaagcatgggcactctggggatatttaccatggtgtctttgagagtggatcccaggttgttgtcaagaaggtcaacgcacagagcgtcaacaagcatgcaggtgaattggacttctataaaatgtattcccatgagaggattgttccgttgctcggacatttggcaaaggatgaagaggaatttatggcttacaagtatatgcctaagggggacttgaccaatgcattgcacaagaaacctgtggacacagaagatggcttgccatcattggattggataacaagactgaagattgcaacaggtgtggctgaggccatgtgcttccttcacgatgagtgccgcccgccattagtccacaggtaattccgtattctatatgatccacaggcatctaagaaattcatttgctacaccatgtaatatcctattggttagtgcaccctaatattggccgttctgtcctaatttaatttggttcatagttgagagaattattgatggctcacatgccttattttttattaagttgtagccgtactaatggtgtaagttatgtcaaaggcgggaacgatataagaccagtgaagtagaagaagtgtctaattgaaattgaattgtttgatttgtgatttctgtggctcctcagtgtggttgctgtgcctttcttggacttatttactcagcggtttacttcatatttcattgaggcacttttttactcaagagcgaatcttgcatatgaaaattcttttggtgataaattattcataggcctggacaaaaatatcatgcttggagacttgaatatgatttatctgtgcatgttgtgtcgttgcctagaagcattgacccactgtaattaaaagtatacattttgatatgacttgtcattttcggtaaccttattggtactataaaatgtttgttagtttgtttctctttccacattcgatatatttgtttgtgtctctttcttcattcagttatgcgttctaacgatttgaaaccacatatggtttctttttactagtgatcaactataacaagttcccaagtctctatcaaagctttagatgcgcattcaatattctacttgtatagtgttctgtgtatgtcatcaacaattccaggaaaatttaggtttggtgcttttgacataactggtagtggtcataatttttttcccacttgcctgtcttaatttcttcgtttttgctgtcttatgttacttttttatctaggaaattttttatcagtaggtcagctcaacttttctgattcaataagccttacctccaagttgatacatgttttgcatacctcaatcttctctgacattatgttcacattgttatttattatgttgtgatttcttcaattgtaatcacagagatatccaagcaactagcgttcttcttgatgataaatttgaagtgcgacttgggagtatgagtgatgtatgtgcccagcaaagtgggggaagccagagtgtcttctctcggttgttgagatcatcaaggtatgattatgacctgtcatgggcgggaatgagaaaaactacacttattgatggctgaatgtggtggttttacaattttttgaattctcgtaatcactggtgacagaatttgatggttttgcccctctttttttttctgaatttgtattttaaatttggaaacaacataaacataaaattgaaggtaagagaaacagcaacagtagtattgatagatcatggatgatcctatgtagagaatgcagttccctactttccttactattgcatttttttaaaaaataaaaataaaaagggtaaataacagaagagaccaacctggttcgaaccagtgacctcagtcaaaatactctaccattgagctatggaaatggaactgttgatccttattaacgtaattttccttttgggttcacttgggtttacactagtactgatgtaattgctgtttgttttctcattcctcgctgtttacaactggcaaaaaaattcttccctccggttaaaattttttcaaaaaatcctttggcaaataaggcaaaaaatttacaggggctcaagggagggganaccctccctggcacgcctatctgaaagtttctatcttgttggatggtacaccaagaatatgtgcctgctcaaaaaaaaaaaaagtaataatatgtgcaccaaggggttggtgattatagataacctaaaatgttattttattttctatgctgattgcatgctagttggtatttggtagttcaatgttccgagcacacacacctacttccttctaatcctgttgtcttttagttgagcaaacttccatctttatctgccttaaacgagtcacatctttctgaaaacttttgtttactgctaactaaagctcctaactgacaatgatatttggttctttcttgtggcaggtcgcttgataagaacatatcaggtacataaatcttatacatggctatttattaccactctaattctgtggttcatgtacatgcgcacaaggaagtttcatggttaacattcccttctgcattttttacatgacaggcccaccagcaacttgttcttatgatgtttactgctttggaaaggtgatgcttgaactagtaacaggcaactttggtgtaagtggatcaaacgatgctgcctccgaagagtggatgacaaacacactaaaccgcatcgacatgaacgacaaggagagcatttctaggatcatcgatcctttgcttattgtcgacgaggatcatctcgaagaggtgtgggccatggcaatcgtcgcgaagacatgcctgaattcaaagccatcaaggcggccttctgctcggtacgttctgagagccctggagaacccgctaaagattctgcgaatggcgtcccgctccaattcagcaagactcaggagctcatcatcccggagctcctggcagtctgctttccttcaaggaaaccggtaccagagccttgaaaccgcgtcgtcgtcagggcaaatgcttgacaggaaacattcaactagatcacatggaagcggaggagagacttccttctccttcaagagggcttccagggagattgctccggagccagaagggttcgaggagaatgttgtcgtgtagaactgaaattacaccgattctttcgaagaatttgtgattcattcatacctgtgtataatctgatcttctgatgagcatgattcggggtctcgaagtgagaattgtgcatatagagaagttttcggggtttttatttctcttttttttttccttcatatgttggagaattgttttggtttactgaacgcatggtacttgatgttctcattgtgcacataacatttacccttttttttcccttatcatatcaagcagcaagctcttttaccgtagatgttgctactttttctataaacttagttaaattttaagacatttcacttagagcaattccaaaatgtctcataatatgaagtggaggaagtagtaactacgatttgtcgcaatcttagtagaacaaaatcaatacgaaaaaatctggcatatattatgccaagtgcagtaatccgcatttttcttctggtttgtgtgatgtgatgcagggactattttgaaacactcctacaagaaacggggaccaagttgtaaattgtaggatgtaaatagttggacctctaccaacgaagcgatacaaaatactaaaatagggacttaaatgcaaaacatcctaatcctctacgggtgtacaagcagccgtcagatccacaatcaacggcccagattgatccccttaactaccgaaatgccagagtgcgacatttctaaaagagtccctcgaaaaatatattttacgatccaatcccctctactcgaagcaatcaagcaaggagaggatagaggagagctcaagctccacctcccgctccaatggcggcagccactctcccaccctcccaccaccgcctccacctccacctccacctccacacccccaaaccctccccacctcgccgcctccgcctcgccgccgccgccgccgcgtcgcgcctccagaacccgacaaccacccactacccgaacctcccgccgcccgcgccgccgccctccacctccctcgtcgccgccgaggaggcctccctcgcgccgcgccgcacctaccgcttccccggctccgtcccctcctcccccacgctcccggacactgcggacggcggtctcgccgcggcggccgcggtggcggacgacgccgtcctgcggcgcgcgctcgaggtgcggcgcgcggtggccggggaggtgcttgtggcggcgctccgaggcgggaaggtgggcgggctgacctacatcaggaacctcacctcccggatggcgccgttcgtggaccgcgtcgtcgtcgaggccgccgccatgcggcgcgaccgccccgagctcgcgcaccagtcgttcaacgcgcgggcgcgcgtgtacatcgaggagtccggcctcgtcgccctagtcaagtgaggatgcagctttgatgtttttcgtttatatactttgtaatatatcgcctcagttcatttctgtttcggaatgcacaaagaaatttgaattcgaagtaacaccaactatcagaaattcagaagaattgcggatcatacaaatgcaattttggtatattgtgtatgggaaaggaaagaattagagggaagtgatgattccgtgttcgaagtaggcataagcatgacgtagcgtaattcattagagcttaggagttaggagtagtttagtttgttactatgcacataatactgattgatcatggcacccaccatcttggctatgaattgtgagctccctcatgcctcatttcaagtcttcaaagctcatctttatgtctaattagcaacctgggctacaaatacttaatttggaggcatgatcgtggttggtgttgaaaatggccaggctagaactgtaccgaaacaatctgagttgaaccttggcttggcttgaatttatttgatttcttgtcagaactgtatttatttatgcactgtaaaattattagtacctgtttaaaaatatgatttgaactggtatgatttatgactctgttaattcccaaataggctcacatccctggcatcttgtcaaactcctaagcaattgcacaaattcgtaatatattacataatgtttatagtgttttataaatacaatttaaatcctgatcctcaggtggttcaagcacaactccatgacttatccccaaatcgccaaagtagtttgctcatcctctggcaatctggagaaagtgagaaggatgataaagtggttaaggtccattcatgtgaaaggagaatatctaggacgcgtgcttgcaaaaggtgatacttttttgagccgcagttttgaagaactggaagagattatttactacatggaaagctgcggtgttagaaaagattggattggtcatgtggttggtaggtgtccacagttactgaatctgtccatggatgaactggagactcgtgtgagattttatacagatatgggcatgaatgataatgattttggcaccatggtttatgattatccaaaagctcttggatttttcagcctagaagagatgaacagtaaggtgttttatgtgcactaaaacttgttttgtgcttttttggctccttgttcattcagaatttttttagcgattattttagcaatatcatttcattctcttaatatgaacaaagagtgttcattgatatctgtggacaagtaaggatcaaattaatatttcagacagttaaaaatcgatttctgattaaaagtgaactattaaatcggacaaaactgaggtcacgatctggttatttccccttttagatatgaatgaatgtaactgatgatgagctggttaaagttacttttcttgtaattctgaaagatgtttagataaagttaccgagtattctcaacgttctctttctgctatgagcttcattttctagttgtagtcaaatagcatttgtttatgtattctctctttgtcagatagaaacttcattgaagataatggcattatggatcacaggtacaatatctgaaagaatttggactgagcactgatgaacttggaaagttgatggctttcaagccacagctcatggcctgcagcattgaagaaaggtggaagcctcttgtgaagtacctgtatcatctaaacatttcacgggatggcatgaagcgtatgttggtggttcagcctacgatcttctgtcttgatttggaaacagtaattgcaccaaaggtactcttttgattgctttgcatgcattgtatttccaaattttcacaacaattggatacattttatttattacttcacagcaacatattaggaacttgttagtgtgttcactaaatatagtcttgatcgttaaagagtaacagcatattgttttaagcaaatgcacaaagtggatttatagctcttaatatgctgagatctgaacaatgtgattcttcttacctctatcctatcatttgttttaggtacaatttctacaggatattggtgtgaggagtgatgccgttggaggtgtgctggtgaagtttccgcctgtactaacttatagcctatacaagaaaatacgcccagtggtacaagctctcaattttccaattcttaattagtattgacctgccttgttgattcttttgtttttaaggtcagtaggatcagtttggagcagctaagcatggcatagaaggcagtttgtcaaatctcatgaaaccaccatctgaaatgctaaaacttgctttaaacctaagttgccacagtaactgaacatggacagaaatttcaattgttttcaatattggtttggtttgccatgatgaatgaacacaccggcaactgttgaataaccagttaaagcataaaggcgagcgcggcattgcgtaatgcaccttgcagcaaatatgtgtaaggccaggagtgatgaagttgaaaaatgttaaatggccagttgctctatttgtatgaccagcagtggtgatgttgatgagaacacccaaaatagtaaaagcagttcatccacatatagtgcttctatgtttttcttcttccttttttaatacataattgcataccttgatgatctactccatttggcttatgctgattccacatgtaggtaatattcctgatgacgaaagccgcagtaaaacaggaggacatcggcaaggtcattgccctggatccacagctcctgggctgtagcattgtgcgcaagctggaagtcagcgtcaagtacttgagatcgctgggcatctaccacttcgtgcttggtcagatggtcaccgatttcccaacgcttctcaggtacaacgtggatgttctaaggccaaaataccagtacctgcggcgcgtcatggtgcgaccgctgattgatctcgtcgagttcccccggtgagtctgtctagggttcatgttttgattgcacatcgaaagatgagatcattgtgaaacaactgcgaaatgcttatcaactctacactgcatttttgtcaggtttttcagctactctttggaggacaggatagtgccaaggcaccaaacattggtggagaacaggatcaacatgaagctgagatacatgctaactggatctgacgaagatttttcacaaagggtacgagaagctgttgagaggagagccagatttgaagctggaaatgttgaggcatcagattcgcaggcgactaccgacggagcagaagccacagcaccagcatctcaagacggctgggaggcagatacatagatagagcaggcagggcaaaattgtaatctcacattgtgatgtaaagaaaaatagaaagaaaaaacgctttgcttccatgccattgataagcacagcacaggggaccgtgagtccatgaccacattgtacttgcatgaggcgaagatcattggcaagcagtacaaaatttcatttatacaagttgcccagaagggaccagttaggcactagcattagcatgagtttgtcctttatttttctagcaaattacacaaaataccgagggaaaaaggaggatggaattcaggtcgcactttcagctaggaatgcccagcccctgaattattaacaccacacagaattacggcgctgcgtgaatcccgaactaataaacacgcgccttgggtgggaacgactcaacttcactgtccaatgtgttcatgtggactggcctgtatgccaagcgaaccttctcattctcccagtacctgtataacaagaaacatcgagaattcaggatcaaattacatataaaaaaattataccatcagagagaaaacatgttgatttcacattctacagtgttttaacacctaatgtgcatgcatgtcatgttacagccaatgataagtaaggttgacattcttttaagtgctacaataatttgtctcaatatttaacttaggtgtcgtggtgacaacgtctaaagctgcaacccacatcaaaactactatactgcttgatgaacagagtatgcttaccccagcgagtgcttcatccattgctcatcatctcttttctgtaagcagtaaggaagaatcaattgtcactacaacatagaagcatgtgggtgcgaggcaccaaaaagaagggaaacaagagaagtacaaaccgtgaaatcttcacgagcatgagctcctctgctttccttccgagcctctgctgagtgcatggttatgcatgcatttatcaagagattttccaactcaatggtctctatcaaatctgaattcctgtgaaacaaatagtgaattatagatagccagtgtaagatagtaacaagcaagcaaaataagtcggtgcaatccttgcaagaaatggcataccatatgagactccggtcactgatcttcacatcatgataactttcccatgccttggtaatcaatttgcaacctaataaagcaaggtcgaggtcagtgggaaatatttatgaatcatgtctcttgttatcttaactatttatgccatgcttgattactagctaattatgaagcttcaatcactaattcttggtattatggtacctttactatactttgctaatcagctaacaacctaataaaggtctgtgagaacacattgatacaacagtcaagaatcatgactttctactggggtctatctttactgttaaatcctgccttccttgcttcctattgttaatgactaggatgatctatggtgacaacagacatttctatatcaccagcgtcattgccttaagctacaaaggatatgtgcaaaactgcattaccttcctcgagtgtttcttgcgtacggaagacagcagcattattttgcataacacgttgcatgtttagacggatcttggaagttggcaatgatccatttgcatttctcagcttgtctaaccaggctatggtcttttctccagcacttttttgaagaggtttctgcttctcacctataatgttgcatcacagacattaggtgcatcaggatgagcaaatcagccaacaagttatgtagcacaggagggaaacctacctggcttagcggtttcagctaccctgtttgcacaagctctgccaaaaacaactatgtcaagaagtgaatttgcacccagacgatttgcaccatgaacagatgcacatgctgcttctcccgcagccatcaaaccaggaacaacagaatcaggattgtcacccttcatagtcactacctgatatgcagaatagaaaacttctattaaaaatcagcaagaaaaaagtgatctacagtaatgtttattggttactcaacacaaacctctccatggtaatttgttgggatcccacccatattatagtgcacagtaggcaagacaggaatgggctccttggtgacatcaacaccagcaaaaatagcagcagtttcagaaataccaggaagcctctccttaagaacttctggaggcagatggttaagatgcagatagatgtggtccttcaatggccctgaagtaaccagaacaaaagataagtttcatcccaacagccaacacagttctgtacctcaggtgttaaatgaatggacttgggcataccaacaccacggccttctctgatttccattgtcatagatcttgaaacaacatctcgagaagcaagatcttttgcagtaggagcatatcgttccatgaaacgctcgccttcactgttcctaaggataccaccttcaccacgggaacctgatgatcaaatgagaatgaagacacgaagattgtcagtaaaattacatatgtgcaacatcaacagtataaatgtcctgcccataaactaggataaacaagagaagtccttagaagctaagcacatgaagaaaagaggagtatagaaccttcagtgataaggcatccagcaccataaatgcctgtaggatggaactgcacaaactcaaggtcctgcaaacatatatcatgcaaatgtaatcaggatagaagcatggaacagtaactaacaattcagcactaaataattggactaacctgaagtggtaaaccagcacgtgcaaccatagcgttgccatctccagtgcatgtgtgagctgaggttgctgagaagtaggctctgccataaccctgtttccacaagacaacacaaaaatgaatcgccatagtcaagaaagctagcacatttgtcatccaaaattcaaatctgtgagatatcttactcctgtggccagaattgtatttgtagcacggaaacggtgaagagtgccatcctccatgttcaaagcaataaccccctgacaggtgcctgaatattattacaaagtaatcaatagagcttctatggcatggagtaatcgactgcttgaataaaattcacaagtcctaatacaagaagcaggagggtaaatacaaggatatgaatgagatatttgcaactactgaagaggaagctacagtgccaagtgtacttgtgttatgcttgaaatagccacacacacacacacgcacacaaggaacaaaataattagagtaaactgcacttagcaccggataaaacatttgtttcgctttgcaccagatttagcacatactttcctttacactaaggttgtattgaaataagtttcacttagcactaggatacataatcttacctatcaagattgaataagttttataagatatcctcatattttacaatattttgttcaattataagacataaccaagtgcaaagtgaaatcgaattgagataccctggtataaagtgaaagtatgtgttaaacccagtgtaaagtgaaacaagttacgctctacccggtgcaaagtgcaatttactcaaataattatcaaaagaaaccaatttagcaatgatggattacaactaggagtttatgacacagatagtaattagaaaagtcttctatcatacacttgagtcttgcatagactacgtagacacagggttgacggatatgattatctaaaaaactagccgtcttaccttcactgtccatgataaggtctagcgcaaaatattctacaaagaactgagtattatgcttcattgcttgaccatacagagtgtgtaacatagcatgtcctgttctgtcagcagcacatgcacatcgataggcctgcccacctgaagaaagcacacacagttatagggactggaataatatatgtcaagattgtcttttcaaaataaatttagaaagctacgacctttcccaaaatctaagctctggcctccaaaggcccgttggtatatctttccatcttcagttcttgaaaatggcaacccatagttttcaagttctataactgcttttggtgcttctctgcacatatactgaatagaatcctggtcacctggaaatggataagaacaaaatgttagaaagagagtgaaactgtagaacagtagggtagttgatataagatgccattccatgttagtaactctttattataacctctaggtgttttgcagcctaaaagaagtaaaaaagggaaccaggaattaaggcagcttaccaagccaatcactacccttgacagtgtcatacatatgccatctccagtcatcttccgtcatgtttccaagagcagcatttatgccaccctacatacactcttgtaaattagtacgtgaatgaagctcataaacataccagaacaataaaagaagtaagagaaggctctaatgatgaacatcaatggagcaaaatacatcaaccaacaaaattgaaaagtttagatgttaacctaggcatttagacataccaaaaacaactgttgctgaatgactcatatcaacaaaaagtataaaaaataaagaggcacaaaaaagattcaaacatgcaaaacacacaaaataactaggtaggacagtaatataggcattaatcaattaaaaatttatatgtatagcttcgatatcggtaacagtaatatcgcaagtcaaggaatacatcagatctgcataacaatccactgtgaaatgcatatctgacttaaaggccagagaaacagaacaactgctcttcaaaattatcttaaatacatagaaagtttagaacagacaaccaagaatggcaggactaaaagtccaggacactgtatttattcctttaaaatgattgttgattataaaacacaccgtcttagtgacacgtccattcactgagtgctaatatcaagagcagatgcaataaaataactggccttttctgttgacaaagcatttttttctgttgaccattggtgtgcagtgaattccctgatgaaagggagctatgctcaaactggccctagtactttagctactacctaaccatatttatctcatttgtactgatttggttagcgtactgcgcagtacacaaaaagcataccataggacaaatgaacctaaacagatggaaattacttagcacataaatcacaaatggacataaagcatcacatcaaactaattctaaaactaaccatccaacataaatcatcgtaaacacaatgaaagcacatcacaaccagcatctcagttcccacaatacccaaccaatgtttgcatgatgcacaacaaatctattgtcactaaatgcaagcctaagtaaaggtgttgcagcaagtttttcacagtacctgcgccgcgacggtgtgcgaccgcgtggggaagagcttggtgatgcaagccgtgttgaacccgtgctcggagagcccgatcgccgcacggagccccgcgccgccggctcccaccacgaccgcgtcatacgagtgatccaccaccgtgtacgacgactgcacatcaacaaataaaaaaccaataccatcaatcgccgcccatttctcgaaccaaaccctctcatcgcatcacaaatcaaactcccacaccaccaccaccacaagcagccaaaaaaaatataaataaataaataaatcccatcccaaaatagagctcatcgaatcccacccaaaacaatccgaacacacagtcgcgcggatcaactgaggtcgggggatcgaggggactaccgaggcggtggagaagagcctagcggcggcggagacgggggcggaggaggaggagcccttgcccttggagaggctcctgaggccacgcgagacgcagccgcgccacatctcgggtggatctcggtgcaccgcacgccggcgatggagatcggcggcacgagagaaggcggaggcggaggcggtggaggagggagagggcggcgcggaagacgacgaggtgggagggtggtcgaggggaaggtcgtttattctcgagaggggagggttttgatgggacgattatgccctcggtattgacgggttatttacgataatgccattttctccttttctttttcacttttttttcatttaggaattttttaaaatgtcgtgttagtacgtactccatccgtcccaaaatatagcaatttgtgcttggatgagacgtatcctactacgtactctctcttgttcttgttcagattcgtagtcctaagatacgtcccatcccactaaaaattgctatattttgggatgtagggagtattttttttacaaatgatttttttgtttggtatataaagttttctttttaggtaccataaaggaaatggcttctcccaaattatctataaataaaactcagaatttctttggagtggtggtctaggttagaaacgtatggaaagaaattggaaattattttcacacaagttcagtccttttaaatccaacgacgtataaacactttctcttctttcgctacaacacaacattaataattttgggttggatggggttatcttataataagaaaagaaataaagtaatattacgtctcttttgaatcatgggaatttactcctgattaccaagaaaatgaaaaccattccagcgtttcagagagcctttactagtaaaatatacacttaatgaattgagatcaagatatatagctctgcggttttttgcgtggaagtttatgatctaggtgaagcaaaaccaaccaaggagaaacaaaatttgagaaaatttggccataaattaagttcccagctagatcagccaagggtaaaaacgtaatgcaaaaccaaagtaagatgaattgttggattacttgcagaagaagaggagagcactagttgttgagaagttgagatggctccagcttcagtggagggcggcatgtacacgagtgtggctgcgcaaagcgaaacgcggcgcgtccatctcccaaccaaacaaagcacagtgtgactcgcatgactcccatcgccatcgcttgatcggctacttgctagtacttcacccacgtatacgtactcctcgtatgaattgttcttcttcgttatcctttttcactttgggttgcgttaagtgattcgatgttaatgaaaccacaagggtacacgtaacacggctgtataaaaattggtctgaaagatagcacagttgatcaatcgtttcgtcatgagccgatgccaaattttaaattttaaaagttactatcctatatagaagctcttgctaaatacaattttggcaaattttattatggtacactaaacaatgtaaatttggttttatagacaatgcaagaagtcacatttgcctatgtgaattttagtggacaacgcacctattatttatcatttttggctatttcaaggagatttttttgaagcaagtataataatacccctaggactaaacccatcactcaaccaataatttttatgttagaataagttcaatgatattatgatattttttaggccaatatatatgtatacaattttaaaactaagcatagatgattaaaattttataacagaacactaccatgaatttaatgcctaataaattaacagtattaaagatgactcatcagggtgttaattcatcgcgggtaccaatacggcctccaaaaggttagataataaacaactttataactaatgatcgcatcgcttcgcttattcgggaaataagccaaacatcatatttgcaaacaaaaaataatttgtgaatacacttttatattttgtgttcttagcgatctaaaatcaaatgttgcaaaataaactttgatgaaaaaaacccccaaatcaactctatttttaaggttaaaaattcaaattttgtctgataagtataaacttaagcgaaaagacgaggttgtaaggttaacctataaacaacccatatgtttgtacaatagtagtatttcttagttgatgagatatagtgtggtaccatatcattgtgtacgccacccgtagtattacaatagtatcgttcacacaactcctatgtataatattttgaaatagcccaatttaaacatcaaatgatccatcatttgtaactcgtgtaatggtaagcgtgggtaagaaatagatacgctagtatctgtagtatctagaatatacccatattagtgcatttggactaattaagggttcatttggtacaactcttactatgaggacggagctaattaaggagcggttgggttgaaatgccacttcattgctagttcttttttctgaggtgttattggttggcccttatacttataagccaaaatttaaattttagaagttgatttgaatttgattttttttgtcttttcatcactgtttatgtttattttataatatttgtttttgacttgctaagaacaagttttatactcataaatattttttctatttgttactacctccgtcccataaaaattgaatttctagctttaaacctttgtcccataaaaattgtatttctactaatgtgggacccagtaaactgtaatcttctttccttccatctcatctctaacccattgtcgtgacattccttttaatcaagtttatatatggaatgtgtgcatgtactgtgttcattaaatagggttattgtagtcattagtctatcctattaatatgtccttaattctctagaaatttaatttttatgggacggaggcagtaataagtaattcgaataagccaatcaatgtcttccactagcctggagtacgcggcaatgtcttaccgtttcctaatatgaaccctatactttatggtaattaaagtaggtcattcactcacccaataagtagggcccgcatgtcattgggaagagacgtggctagcgctcaactcatggctaccggcgccggtgagcggtgcggcgtcggcgcgtcgctacggcggttgttggctcaacagaaccttggcatgtcatcaaccgaggtcaagagcacttgccccaacttggatgaggcaaagacaactgaggtggcgcggtctcgatccaacgatagttatagtcgctaatgatgtaatatataaacattactgtaacttgattgacactgtgacataatgggcctattctgtagtaggtcaaagtgaagtgtttttggctgtacagcacagccctatatatggccatatggcccgaggctcgatggcccgctcaaggcccgataaatttggcccagggcccgtccaaggcctagtaattttggcccggccaggcccgtgctggcccggcccaacagccgtgacgtgcctgagcttctacctcgacacgctaggctggcactaggggtgaaaaaaagctcgggctcgcctcgagcttggttggctcggctcgtaagccaaacgagccaagcccaagcctccttttcagctcgttgctgaaatgagccgagctggctcgcgagccgtttgttttggctagcaagcctaggccatcatgtgtttatatcgattatttcactttttttggcgttattatttgtcaacttgaaatttatcattaagatttttttttaaaaaatgaatatataaacttatttaaattttacatgttgatgatttgtttttgttttttttaataattataaaatatatatgaagaggattttcaataggaaggcttgcaagccaactcgagctggctcgagccacgaaatgagccgagccgagctcaagttttagcttgttgccttaactgagccgagccaagccaagcctagtttgttgcgatccactgcaagccgagccgagctaggcttcgcttggctcgtttccacccctagctggcctggcccggcccaaagtttagtgatgcgaaacagacttattctcaaccatggccctttttagattccaactttttttttcaaactttcaacttttccgtcacatcgaactttcttacacacacaaacttccaacttttccgtcacattgttccaatttctttaaactttcaattttggtgtgaaactaaacacagcccatatgtaaggcacgtcacaaaaatatagggagacaaatagacttattatatggtacgacccaaagagtagagatgtaaaatagacttattttagctctctctctctctctctatatatatatatatatatatatatatatatatatatatatatatatatatatatatatgccatagcccaaagaggagggggaaaataaacttattttaaaaaaggcatgatgggccgcacgtgccttcgggctggcacggcacggcccgactactggtaggccgtgcctgggcctgaggtgcagtacgtgggccggcacaacacgtcctgaagtgccgatcgtgccgtgccggcttgattgacttgggccgtgcctcgcccgtgcctaggtcgggccgtgccagacaggccttatagccatctatatacacatccctaaccgaacggtaggggcaccgcagcgaatggtcatctaactaataagaatggtaagtggctaacccgtgaagctcacttataagtcggaacaatgtaagaatccactttattttgatctataggtgagctcgcggattaattagccacttacatctctatgggtgtgttcggcaccccttttcccaacccctctctcgttttccgcacgcacgcttttcaaactgttaaatagtgtgttttttttaaaaaaagtttatatacgaaagttgcttaaaaattaaattaatttatttttcttaaaaatagctaatacttaattaatcacacgctaatgaaccgctccgatttccgcgcgtaccggttgggaagctgtactagcgaacataccctatatatgaaatatcgttgtaatcttgtcccgttgtagctgttgtggtagtgacaagtgtagctacattcatgtttcagcagctagttctaccaaacaagtctattgttttttaggctccactccaatagttatgattgatattttccccaacgtttggacggtctacacaatggtcgcggaaatgatttaagcattttgtttggactgttttctttcctgcacgaatcaatgggcttgttcactttgatgtcatttctaaccataccattttttagcaagttactaaaattgtgcatatgtttggtttcttaccaaattttggtaaaaacgccaaaattttggctacattgccaaaatttggcaacaaagtgaacacatccaaaatggctatattgcctaaatttagcaacattgacaaccttacaaaaattttgacaataacaaagtgaacaagctcaatatgatacgtcctgggtcgatttcccgctcgaacgcgtgctatgcgattatatttcttccatccactgatccatacaggcacaatccttaatgtgaatctaatactccattaaggtttgtgcctgtacgtgtatattagaaatccatcggcagttctttgttgtaacatacggttctctacataatactatgcgtgcatatgatgcagtacgtacgtacagtaccaccggccggcaaatatggaatggagtagaaacattcgtggatcagtacacgcgagatatgtttcacgaaaaaaaaagagagggaatgtttcaaaacaaaacatactgtcctatacaaaaccaacccaaattcattatactaagggcctgtatacttcgcgaaaaaaaaaatttggattgcacatcggatgtttgaccggatgtcggaagggtttttccgatatgaatgaaaaaactaatttcatctcgcctggaaaccgcgagacgaattttttgagcataattaattcgtcattagcacatgtgggttattgtagcacttatagctaatcatggactaattagactcaaaagattcgtctcgcgatttcccccataactatgcaattagttttttcatttatctatatttaatgctctatgcatgtgtccaaatattcaatgtgatgtttttagaaaaaaatttgggaactaaacggggcctttaaagctatataaaaaacgtttaatcctgtattagattgaatttttttttaaccgagagtatgttcctggtgtatcaacgaaagcaccgctgtacgttctcaaaaaaagaaaacacgcatcactcctcgctggatcatcaggtcgtttttgttcacatggcatggcgcagcgcgtgactagctgcagcagcagtgcaaaagcagcagcattagccttgggtcgttgcgtaccgtgaagcacagtgatcccgtgcagagacactgcagcacgcatgcactcctactcctatagtataactgacgagctgtcacatgcaatcatggtcaatttcagatttcaactgggatggatgttcaggtctggttacatctcacttcaaaattttttaacatgttaaatagaatatttgagcacctacataaaatattaaatataaaatattaaatatagactaaaaaataactaattgtacagattgcgactaatttacgagacgaaatttttaaatctaattgctccataatttagtaatgtggtgctacagtaaacatttgctaatgacggatttgctatactggaaggggaagcccgtgcaccgccgcctatttcccgtcggtgcatcgttgccgtcggctgcttccccctccgccgtgcgtcgtttgtgttagattaatgagctaggcccaattaaatcataataaattccattgtcccacattaagagctatgggtaataaaccaccttgaaaatctaagtgaagaggtctcaacttaaatacagagctagtggagagtctctgttgaacggttaagatggtgtacgggacaagcaagtgcctctggaactccgtccgcgcttgagaacctgcacgggtaggcgggcgatcaagtttcatatatatatatatatatatatatatatatatatatatatatatatatatatatatactctgtagtaccaaaggaagaacttcccgactcttgcacttgattcatatatatactcaagtttcatatatatactccgcattgcacttgtttcatatatatactcaagtttcatatatatactctgcagtaccaaggaagaacttcccgactcttgcacttcgagttcctcctcctttgttcctagtgtacgggacgagcaagtgcctctggaacctgcacggataaacggacgatcaagtttttgggtagctttttcaagcgcggctgctcctattcttcgacgacaacgttgcatcttcctctgcttctgcttcaccatggcttatactggagagaacggaggagacaacatcaacggaggcaatacaaatgcctcaacatcttctgcatcgttctctgggtataacattctaactttatttgattttcttcttggtatttacacgttcataatgttattcataggattgaaatcctacgtgaatatcaattgatgtttatgcttattttagcttaagcatgctcatgtttatgtttagccttatcactagatcgcttcttattgtgtatgtcatgtttattgtcttaatattttggattaaaatatgccaaaatatgaccaaatttccaatgttttgctgcttcgcctcctcgctctcgcgagatggaggtcgggggagacggcgtgaagtggtacaagagagagggatgggggtagggtggtgccatttgcgggtaatttcatcaaaaatatgtgggtaatcctttaacgcggttggagttggagttgaggagcgataaaaatgccaccgtctgccggtacattttcccggagcgattctatgcgctccgctccagttttgatcaaatctgaaccgtttggttgcactccagctctagataagatgaatctgagagctggagccctgccaaacgagctcttacactaaatcaaccaccctatctaaattctatcacaataccctcgcaaaataatgagattctattataataaatttttggtaatatttgcacatattgcaatgtcaatgtaatcatgcatgtttacacaaatttgtctgaagactgaagtatcattttcaattccaccctagctaaatttaaattgttcgccctactacaagtatggccttgtttaattcccaagatttttttccctaaaaatatcacatcgaatctttcgacatatgcatagagcattaaatataaataaaataaaaaaataattacacagtttgcatggaaatcgcaagacgaatcttttgagcctaattagtttatgattagctataagtgctacagtaacccacatgtgctaatgacggattaattaggcttaataaattcgtctcgcatttcacgtacctattttgtttcattcatgccgtggctggcttaagtaggtgcgtgtaacagaggcccttaatttgttgtttcaacctaaaatttggggtgaaaaagtttcagcaattatttcatcagagtttcttctttcccctacttatttactcaatggcatggctgatgttaagttggtgcaaaagaagcaaactgattttcccttcttttgttgttctaacccaaaatttgcttgaaaatcacctaatcctttcagttctagctgaattattctctgcgtgcatagtattgtctcttagttgtccgcttgtacatactagtagtatggaacaactatctatggctaggcaaatgcaagatgtaacacttgagggtatgtgcaacctgactaaatgagcgactagttatgatattaattgctagcccttcctctgctgtttggtcttacttgaagcaacagctgctttgtggtttgcacttggcaattcctagcaatcaatctgattatgtttcttccttcatgtgcgaaccatagggcacgacatctcccaagactacaactcctactaccaagagctgggaagagaacaaccctgagcttcttgctgaattggttaaacacaagcaaactgcgttcccctggattagttgtttgaacctatttttttttttttttaaaaaaatccatcaacgtctcttctttcacgtacctatctgcttcatgccgtggctgatttagctaggtgtaatggaggcaaactgatttccccccttaattttttgtttgaacctaaaatttgcgtcaaatctttttcatcaaagtttcttcttcctcctaaaatttgcgtcaacagaaacaaactgatttttcccttagtttgttgttttcacctaaatttttcttcgaaattacttatccttctattctaatggattttgtttgaaaccctgcctctctatgcgtagtattgtctctagcttagttgttcgcttgctaagccgtatatactacactagtagcatgtaacaactatctctagttttaagagagagaaggcaaagcgagaggagatgaggagacatacaggtatagaagagaaccagccgtaagtcggcatggggagcgccgccatcgcgctccctccaccttgatgttgtttctcttctcttctattccttccccgtgtcggcttgctcattttcgagatcccggatcataggtttaatccaccgtcctcgcgcaattatgccagctcgctccccgggctcaggatctgtttgttcttgatttcgcgattcaacctgccctccccggaccgtgattagagcccaatttggggggaaaaatttcagtttttcccatcaaagtttcttcttttctgtattcatttgcttcaggcctggctgatgtgcaacacaagaaaactggttttccctgaactgcaagttgtttcaacctaatatttatgcttcgagattacatcttttagttgtaccgtcaccctgcctctgcatgcataatagtattgtctcttaattgttggcttgctaagagtagcagtatctatggctaggaaagtgtaagaggtaacagttcataggatatgtgcaactgactagttatgatattcctccgctgcttggttttacatgaagcgacagctatttagtagtttgcaccttgcaatgcctagtaatctgattatgtttcttccttcatgtggaattgtaggataagctgcgtggcacggcatctcccgggactacagctcctactggcgctacatttgaagagaggaaccctgagctgtatgctgaattggtaaaacgtctttcagatcaaaagagaaattccaggaggatgaggctggctggtgcttctgcctattgtgttgtgttcgtcaccctgttgtaccttggcgatcgtgagaagcgtttgtttgagaagtctttcggtgttggcaaatagctttatcatctatatattattcaccagggttatgtattttctggtgctaagtctaatggtttcttagatcgccgtctttacgttctgagactattgactttgttatctatgactctcctgtagcatgcgtgtgacatgcatttgtgtacgattaattaattatctatgtattactaccttaagtaccttctatatatctgatatgtgcaagtagatgctatggcgatctcctatagcagctttggctttaattgctctatcgaaaatacatatccatccatcttcatccatccgttaaatacctcgaacaaaaccatttttttccgaggtacattgatacactaagacaacgacgttacagtgtataacagctgaacatcgcgtatagacgacagtagttgagtttgtaggaagaaacatgaatttggaaaccgggataatatacttagcgtgcaggcgacgtggctacagttaaaaccgcaccggcaccgcacgtactacgtactatactaggccggagccagtttagctgcggcgcggggcggggctgaagggaaccgttcgattcatccacgtgtcgtccatccggcgcggtgacaaactgacaccagcacttacgcacccactcactccttcttcctcctctctactactctctttccccctctcctctattgaaggtgaaagaaaccaaaaagaagagagagagagagagtgtgtgtgagtttgaaaaacccaacccaaaaccctagccttcgggaaagcctcatcgccggcaaccaatccgatggcgcttcttctgagggtggtgaagaaagggagggggatggccgtcgtcgcccagagcggcggccgcggcctttccatggtggccacgagcgccggagccgcgggaggaggagaccttgtcccgaagctgctccgcctcggatgcccacagcatgtgttgagattataggcatataatgatttaatttattccataaataaatcatggcattgcagatgtatactagcattaacgcatcattagatctacacatgtaaactaagcagtaaaacatgaacagatcaaatatgcgcaacatattgaacacgtaccgaggtggtagaaagacctgctgctcggcaggaacttttcgcgattgcaggcgtttacgaaggcgcgcagcatgcgagcgaagaggaagacgagccatcgcggacgaacagggagcagtcgcgctaagcgcttcccaaaaaccttattgccgccttctcccggtgcaggacgtcgaaggcagaggttccggagacctgctctcctgatcgccggtgcacgccggcgagcgggatggagtaatctacgagcgacggcgcagcacagagtaggaggcaaacactagattgatttttcgtgtgttgcgtgaagacggcaggtcggtttatatagagaagggtcgcttgatcagggcgcccgcacgatctccactgcgcgtaaccgaaccggataagtcgcgcgtaacttatccggactccacgccgttttcacgcaccggatttttcggaacatttccaaaacaaaaacgaatccgaatttgcagcaaaacaaaactgcaaaaggaggctgcatctgcgcaaggtgaggaactaatttttggcagaccattcgacgcgtgcgtcgtgcacgcgcgccgcctgccctgccaggcgaggcgagcgagcgcgcgcgtgttccccctcttctctccaccacacatgcttcaagtgactaggagggcattctcccttttaaggaggtctccctctcctagaataagtaaggtggtactaaactccacatgcatgccatcctatgaggtgggcttttgtgattttctaaagaattaatcttcgagtgggctaaggcccatccattaattccaacagcctagagcagcggcggcaccactcgtcgccggagccggcgtcaccacaaccactgccaccgccatggctggggccgcgaaaggcgcaacctttccgccgcgttccggggccatggccaagcaggatctggtgggggtggagaaggagctccgcttcggatcaccagccatggccacgcccacacccaccaaaggcgccaaaggagctgcctttccgtgccctggaccaggagccttggtcactctggacctggttccaaagaagctctcgtttgatccactgcccggcgctgctgcagtcggtggcggcgaggctcccaagaaggtggtcacctcgtcgccgtcgtcaccctcgaagaacgctcgtctttacactggtggagaaatgctctttactcctggtttagaaccctttgtagtcccggttttccaaccgggactacaaatccgggactaaagatcgctatctttagtcccggttcaaataaccgggactaaagatcgatctttagtcccggttggtaacaccaaccgggagtaaagagggggaatctttagtcccggttggtgttaccaaccaggactaaagaggggaagcgacagttcctcgagatttattattattattattttgttgttgatttgctaatggctagtgttaatctatgtattttctcccgaatccaatgagatgcacatccccaaatcaacatcacaaatcaaatacatcacaaatactacacacagatcaactacatcacaaat

SEQ ID NO: 75429 - DNA, 637 bp, Oryza sativa
caacatcatacccaaatacccatgtctcacagatgtccacatttatatataaatatttaaaaataccacttctaccaattaattggataaaacaattaaacttatatatgaatactcctctgacgatcgggtgaagccgactattgccgctaaggagttttcgctaatgccttattcatgggtcccgtgatatagtcgtgctcctcaagatgagcgtggaccataattttatcggcaagtaggccagttaaactttattgtcaacggtggattaaaaatttgtggtatgatttagatgttatagttgttgaattgttcagcacaaaagttttttttctagctaataaagtatgataataggagaataaatgtgtgcaaaaatataagaaatcgagggaagaaggggtgcaagtacgtacgtacgtactatccttaaagaaatgtacgtatacatatagtaatacgtacatgtccatggtggacccggtttggggttaggaattttttttataaatctaatggtggtaaataattggtccattaatttaatgaaaatcaatggctagagaattctctaaattcccgtgatatagtcgtgctcctcaagatgagcctgaaccataattttatcggtaag

SEQ ID NO: 75430 - DNA, 525 bp, Oryza sativa
ttcgatttgtgtttcaccgggtttcggcggtctaaccagcggtgcaccggcggtcagaccggcgggcacacggcggtcagaccggcggcgacaggagtcggcggcaggcattctcgacagttcgaccgatcgatctacatcggtcagaccgacgttcatcaggcggtcagaccggcgcaactacttcggtcagaccgcgatccatcgatttcgagggtaacttttattttcgctaaaagtttttggtttttgggtataccaaccattcacccccctctggttggcttagttcttgtgattcgttcctacaatatatgttagatattgtagaaatgattaaatgatttgaattgaaatattttgaaaatgatttaagattgatgatttagcatgtgtatgtttagctttagaatgaaataaattatagatataattactatatgcttgcatgttgaactttgtgtgcttagtgggttttataaagataatacccactaaacacatgcaaacatagtatttattagc

SEQ ID NO: 75431 - DNA, 10815 bp, Oryza sativa
ttcccgtagaagggaaggacctcgttgaggaggtagtcctcgatgtagcggaggctccggccggaccccgtgtggtcggcgtaggtaagaaggcggcggccgaacggcgtgtcgaactcggcgtccttgccgatgagtgcgaccggagccactccaccctttgctccgccgccgccgccgccgacccctttttctccgacgacatggcggcgccgagcaggctcatcatgctgctcaccgcctcatccaccgccgccgcttcttgcagttgcagagatggcattctccttaactagctatagcctaattctgtatctaattgtaattagcaactgattaatgggattagcttaattagaagctcaatgaaagatcaatggcaatggaagctaagcaaatctctcaatttatcaatggcgagtagtagcttcacttaggttgaaggcaactaggtaggttgcatgggcagtggtatatatagcgccattgatgtggaattaattaaatctaatgcaatttttagaaagagagaagggtcaggaagaaaaaagaacaggaaatggggaggaagaagagggtagctgtttgatttaattaatgcgccgggtcaacatgacacaattgcttcttcggctctcaaaatatatatccctcctttatttgtgacccatttattaatggccttgaatatattccaacaccttcttgttccatcatatatactccatgctaagtacatactctcttcatctaaaaaaaatcaacctcgtactatgatgatatattctattcagattcggtactactaggataacgaggcttttttttaagatagagagtatatatactccctccagtttcatatttactatcgttcaagcattatgtgagttggatgataatatatgttgtttcagaaagattaaagaacatttttttggacaagtttacaccttctagttaatgctgctgtggtttccaacgtgggagaaacactcagtttaatatggacgggcagaaaatagacatcttaattaattaatcaattaatattactcattggcaaatgagattatgtccaaaattaataacaggaaacacggaactggagggagtatgcaaaacctaattaaccggagatcattgccttttcttcgcgagtcttcggatgctgttgatgcattaaattaaaagcgttgggctgtggattttccggttcaaaaacatcgatctgggacttgttcatacacacgacacgtatatatacagtcgaacgcgtgcgaaattaattaatattaagaaccaggggttttcaattctgaattcgatcagagtatcatttaatttcaatacgggaaaaaaaagaagaaaatatatgctggcatgaaaatcacaaggatctcgtgttgtgctgtttgtgtgcgtgtgtgttcctgcattcattcattttattccaaattcaactcctcgtatcgtacgtagctaggtcggtctcttaaaatagtcagggaatgtacgtgtgtattaattgtttctatgttgacctaagctctcttaatatcttgttaagtataggacacaaaaatatatctcagggcttatccgacaaagatacaaaatctaagccaacatgaacatagaattaacaaataacacatgtaagaaataaataattgtgagcaataaataattacgactactgcttaaatttaagattaccgttttctcctctatatataatcaggtgcgacctaacctagaggcaaggtatggaccggcctatgataaaattttcaccatctcgagccactatgatgaaaagaagtcctggcctataggctttcaaccccatgccctaggctaacgcctggggtgtctggattcttggtttgtccttgtatagattattattgggtatttacttcctttatctaaaagaaaaattaaaatagttttatagtaactcaaataaatatgagaacgactgatcgagtgaatacaattaattcactcaattggatcaaaatcacgatgtagatatcctaaaataactataatgacttagtaaactgcagcatgggccactcaacttgccaaggttggtttaaaggtgtcaccaatcttccaagctagcatatatagtattagatattggtcaacacactcatatatattattagataattacaatatgccttataatgcaatgaggacgagcatgggttactgcagagagagatgatcgatgtttcttcttggcttgttccatgcatggcaacatgcagacatgggtcatgggggtacacaagtgtcacacgatgatatcccaattagtgaccatgcatgtctactgtattgttgttaacgttgtgaaagccagtatttaaatttagcccttaaaggtgttatatggtgagtgaaaattgttacatagatatagtagtgggagtatgttgtttgagccatatatacttggcccatggcctaatataagctacctgaggcctagctagcttggccactgattattagatgtttgaaacacaccattgtggtatatagtataaaatgtagaataaatttcacaaaacaacgtatactttaaccaaactataaaacaatatagatttaagtcgatatatcacaaaactacagagatttaacaaatttatcacataacttcatatttaattaagaaaaagtatcatagaactatagatttaataacaaaattattacaaaactacaagttagcaccaatttaatagcaaaactgtagcatttataacttgaagacaacattagtgctaaagatttaaacactaaaaactttagttttatgacaacatcaatattaaatatgtagttttatcatacttggtattaaatctatagttttgtgaaaaaaattaatgctaaatctacaaatttgcgatacaataaaagtatatttagttttgtaagatatacccaaaaattacatgctattgtccttatttataataataaggttggcattcaaatgaaatagagtgtcccacttaaagaaagtttagtcagataattatactgttacggtgtttgatgacttgcttcaagtcttcaactggcatatatgcgaaagctcttatatatgcaattcattcttgaagcccatactccatgtagcaccagttaatttatctatatatactcatatgggacttcatggtgcccgggctccgaggtataaaacacacaaattctctccaatttttaaaaatttacaaattgtaagtagatatctaggtatatgaatttgattcatacaaatacctaacaacaaaacaactcaaactcaactttattttacaattcattattacatatctaacgaattatatgtttggatgttatataccttgaaccaaaaactaacaaaaaaaaagttcaaactcagttcaaacttgtttgaacttgttagtaaagaaattaatgttcatatctaaacatgtaaaaaaaattcatactcattcaaattgggtatatacttaatttgaatcttgaagcccatactccatgtagcacaagttaatttacctatatatatatatatatatatatatatatatatatatatatatatatatatatgtctatttattttttcccatgagttgcatatacacatgcagtcaaaatatgatcagtttaaaaaagcacatgttcttattttttaagcttttttttatcaaatagttatcatatattatttcatttgcccaacaataagataatcaagatatgtttctttatataagtgagatcggcatttcttcttctaagttggattatattacctacgtaaaaaatgagtttttaatgatatatttaattttgacatacatatattttagaaataaacctttggcataacttatttctaaaggcctcttttttgtcacaccatgacaaaaacaacaacaataatagagtatatacatcatgttttgaaaatgattctttaattgtgcctcttcatttatattttactgctgtggcaaaaacaatatatgtagtcactccactgccagaacaaatttgttggtggcctggtgccaataatactaacattttaaaattttataaatatctacattaaatatactgcagatcataagcagtagagggaggtcgaagacccctcctggcctatctccagttctccacaagtcgaatggggagaaaaacaacgaccattctaacaaattgttgtggaagccgccagtaagtcattaccagaaaaactatttttacatgcggccaaaatgcattttcgcagatggccaaatactccgcccgtaacaaaaggcctacgaaaataaacacggtcataagtccgcctgcaaaagttaattttcacaggtagacccattaagaggagaacctgcaaaaataattatgtgtcaaaaaaaaaaggaaaaccaatctattattcacagcatgcaaattcacattgaaacacatatccgtggtggaagttctcaaaaacaaatgtggaagttcacgttcaaaatcatattcaaatccacatctgtatttttcacagcaatttggaagtttttttttaaaaaaagaaacatcagttggacgccgtggtggtggtcattgtcgcagggaggatgccgccatcttcgccgaggatctgatccggaagccgactttctccaccatgacgacgaggaagacgaccacgagcagcgcgaggagggtacattgtcaccttgccctcgtcagatccatcgcccatgcgcgttgctgtcgtcagatccgccacccggcacatcgtcgtctccggatcccaccaccgaactccgccgaaccaccatggagcgccactgctactcccttcctcctcaccaccaccaccctcgtcacctcccctgtagaccccgccgccgaactgaggagagggagctgggacttaaaagaaatatctgaatgtttcaattttctttagcgtctatgtaaatgctaatgccaattttcgcagacggatggcttaagaagttcactaaaaaataaaggtatttttataggcgtgcctctaaagctgtgcccgcgaaaatagattttcccagacggccggtcattagacctctctctacacaactacacatgcggacaatcatagtaaaaaataaggtccgcgtggaaaaattatgtgttccgttgtagagagattttttttacatatattttgttaattcttgtggcaaccataggagcctccttgtaggtgaaattagttaattagttgctggagagttatttattactagtaaaaatagagaatggaccaaatcaaatagtattagatttccaaaaggacacaacttgtactagcagtagaaggtcagataaatacgctagctaaacggtcaaaatggatagacaattaaagcagtaaaatttgagactagttctatattcatgcatgcatgcatttcgtccagtcagattagggtgcactagttctatattcatgcatgctttacacccagtctgtcctacacctaccttaattttcttgtagttctggatatcattgaaattaatggccacaattaggactaactaaagctgcccggctgaatccctgaaataaaaactacagttatagcgcacagttttgcggcctgatctgattagaagtcagagctgccttttcttgaattccagtatatatactatatagtactatactatatatatatatgtaatgtcggcctgcagtcaaaatacaatgtgcgcaagtaccatgcatctccctttaatttctgcgctttctacttgaagttaattagtttatttcaactcttcttatcattaccgatagcgagagttcctcttactgtattaaacataaggctgctatctaatattagtacttgttgagtgatattacagaccatgaccatatgagaggctccgagaggcatcacatattaattttttaaaatatatttttttacacttctccaaactttagggacaaggaggtaccaatatttttaaatgtaaattttgacacttctttatactttaggtacaagctagcagataacaaattttacaacaaaaatgatatctaccacctctcagggaccgtgaatcttcttaaaattgttagggaagtatttcactattagctcgatctacatcaatctttatgagtgtagcaatatttatggcgccatattttttatcaaaaaatagccggcatgtatttacattgtaagtccctaaattacatatgtaattttagtgtatttacaatgtaagtctcaaaattacatatgtaagtactaacattacatatgtaaattcaaaaattacatactaattacatatgtaagtggggtgtaaatgagatgtaaccactgtgtaagtggctgaaaaaaatcgactgtaacatatggcgccatatttctagcaactccaatctttattggtttgttagaggttatgagagatttttcagttcgtaagagataccatattttctaatataaattttaatacccgctagagcatcacaaatggatatttcctaatgtgaattttaaaacctgttggagcatgaccaacagatatccaagatggtttcaatttctaaaattttaggctagcttgttagtgaaaagttggcttcaaccgttcctatagttagctggccaaaaagtgaaatccgcttgttcgttcttatcgctctccactactaggaggttcagttcccaatccactgcgatcaaaccatgcagagggaggggcacacacaatcgaggattgctaattcgcgcgcgcgtcagctcgtgcctcctccccacgcccttctttttttggttttttttggcgattttttcctttttttctgcttttttctcatttttttaatctttagcacacatgttttttcaaatattttgagttgaaggtttttaaatcttaacgtaaaaattttcaaatttgatatgaaggttttcaaatctgagtcgaaaggttacaaatctcgagtcgaaaggttacaaatctcgagtcgaaagtttacaaatctcgagttgaaaattttcaaatctgaattaaaagtttttaaaaatttatctagcaaatttaaattacgagttgaaaattttgaacgtttgagttgaaagatttcaaaatttgacttcaaggtttaaatcttaagtcgaagttttcaaatctaacttgaaagttttcaatctattagaaaaaagaaaaagttctcgtaggtactaattatgattagcactaatcactagtcacgccattattagtgccaatcacatggttagcgacgggggcacagcgtatgcgtcggccttcggagcgggtgcgcaacttccgctcaaagcgcgtacacgcacattaggaattccccacacgatcatgctagaggaggggagaatcggagatcgatggacttatgtggatagtttagaggtggcccacctagctttaatttagggggttaagtttaggctatctcttaaaagagggaaaagtatatcttttaatccttatatcctcgttatacataaaaaggacatttagggatagaactttggataactgtcgtgacgctaaaaaatattacgtcagctatcctatatatggcatcaaattttaactaacattttactacttaacaactctataattcctccagagggtcatagaagatgcatgatattcttctcgtgttatcttggcaaaatacatatctgatccggaggctggattaataaatactacatctcacaaaagtgtaatctagtatgtatgtatgtatgtatatatatatatatatatatataggacactcatatggggcaccatggtgcccgggcaccatggtatctaatgcacaaaatcactcaaatttttcaaaattttcaaattgtaagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccggacaccatggagcaccaaacaaatttaatatatatatatatatatatattagctatagctaaactgaaagaaaatggacatatatattgctcatttgtctaacctcagtcccgatttgcaacgagaactatttcatgtacatttcaaaaatccatacttgcaaacatatcttaatttaattaattaattttgcgtgagatcgatcctgctgaacgttaaataaattgtctgaaaaattattgatttgttcgaacatgtcatcttacgctagcgcgctatcataccgatagtcactacacgtgttaattactagtaacgacccaattaattagcaagttcagcagccaaagctatggagtagctagctagaaagttcgcatgcagtatatatgcaaatcatagtactggccgccattaatttttcttgcatatgcacgccactctttgtgacgcttgatttggccaaattagtattacttcaacatatttggctttgacattgtctccggtttatgcatgcaagtagctagtttgcattagtataaacaaataaataagttcaagtactgtaaattagactacatacattaatattgatttatctgattaattcaacgatgttttaagtattagccgatcgagaggcagttgcaaaaaaaaaaaaacatcggctctgattgttttatctatagaaaaatgaacagtcatgtagaaaaatgaacaaagtaaaacttgtatgtatatgtactagtagtattaacagtataaatggcaaggatttaagaaatagaatgcgatcgatgaaaacgacatacaagcaaccctaaattaaaatttaagaatttgttatggttaataagtcaataaacgaatttcgaatggagctgggctacgtcgtgaagaaaacttctggggcatttgtgccactcagtttttcaattacgaatgaatgccactcgaagaacagtgttctaatggcattttttaattttctagcaaaagtcatgtaattaataacggttcaaaccaatgctaaatttacaatcgtcccgaaaacgtcgttgatatcaaattatcaacatttcatctggctgcttgaattatttagcagtatctcagtcttttaatacgtttggttatctgtcttttttttaaaaaaaatgtaattattatttatttttgttatgatttcatttattatgaaagacttttaaagttatgacttataactttttagtaaaacaaatagtcaagttacctgtgttacatattaaaaacgaagtgagtatccgattattcgaaaaacgaaaacaaaaagtctctgtctcagcgcggtgggatgggctggaaaaacatgttttccgcatagtatgaacgttgacagttgacacgcgttttcttgagcctaatagtaaaccaaagaaataccggccggtcaatctgtcggcgccgcgctggctaagctagcacatgctccattcagcaaattgttggtaaggcagaaagaaattaagcccaatcgagggtcaacagaaaccggagtttgacatgtattaatttcggttgaaattaatgaaaaaagaagaaaaaaaacaagatctagctgagttttttttttaccactatcaggttcttgatgaagatgtgtttgagttgagaagagtcatgttatactccctaatattctttgaataaaaatccatttagctgcatcttaaactataaattaaaaccggataactaattaacttccttaaatttattacacctgatcattcaccctagctagagtggatttggaggcagtgattttatttaatttgcatgtatgtcgatggttttacgtgatatttttcacgtatatactttttgtcagcaaggcggttttaaacaaacatcattcatgtaactcttcagtacgtgatacttagtttgagtaccgtgtaacttgttttcatgtatttcttttatcaacactatatatttaaacaaatatcatttataaattgctctctaagatttatactccatccgtcccaaaatatattagtcttgtactggatgggacacatcctagtacaataaatctggatcatatgtcccatctagtacaaggtttctagaacggatggagtaacttcttagggagcaaggggacactcgcacggtctacaaggccaaactatcaaaccacacattgacgactttatagagaacccatatcatatttcatttcttttacatatacacaactaattaaggttgtatttttttttctaccgtgccgtcctaaggacatatagttttcattactgttggatagacggggacataggtctccccaaggccaaactatattaatgtgaaccatgcatgcattgacgaattaactatatactcatattgttcatattgtacacatttattttaattttttccattgttcatgtatgcctcctagaaacatgggacatactcgatttcacaatcaaccgtacgttgaccatcacacacaggcaaggaggtgcaagtatttttttttccacgtatatattttctatacgttgaccctc

SEQ ID NO: 75432 - DNA, 7526 bp, Oryza sativa
cgccccgaccccctgtgattttggcgccacgtatatgggttaggtaagcacagcggagctttttcagctcgcggaccgagtggctcgcaaggaggaggcctggacttggaacccctccggttccggtgtggcagcttcggccgcccccgggtccgctgctcggtcagggcggcgagacaggaggaggaagaagaggtcagtccattccgacgacgagggtcatgtcctcgccgtcgagggcgtttcgctggccacccgaaaggggaggcctgcgagcgacaaaaagaaggaggccggcgctccctgacctcgactacttggaagagcgaaggcggcacgcggccctccgagccgcgtgctaccggcagaacctgcggcgctaccatcagcgccacgtccgagcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtcttgggcttgggccaaccccgcacccccccccgggcgtgcagggttggccgggggcttatcttttttctcttccgtatttcaataaaagcattttcgatttcctaaggactgcgtctgtgccgttgtttccttttaaagaatcttgacttgaaataggtcgctcgtgctcaatcctgccctcggtggcccaggccggctaaaatcgccaaaaggggcccagaaccgagccgtgccccggggcgtggtgaactccgggggggaatcggcaaaggcccacaatcgggtcatccataaccctcggtcaccatgttcccggcctggccagtctcgacacgtggatctccccaggcactagccccgacccgcgccatttgaggctgggacctgggcacgagcccttgttcaagctaagacacagaaggaccgcgggacagaccatcctcgactcatacacacaacaaatagaattgacacagaaattttctctttatttgattgcagattaaatcagtctatacaagaagggggcccggaggcttcggaagaagaaggaaaagttattaagattggcgggggcctggggctcactccgacgcgcccgggtagccggcctcgccgtcgctgtcgtccgcaccgtcgtcaccgcactcgccgtcggaggtgaaggcaaacgcgagcctaggggccgctcattattgtcggttggttttcccttgccgatgcgcgtgatttgcgaccgctgggattctgcccgaagagagagcagggaggagaggcccccgagccgaacggcggcccaaggcccccgacggccggagctggccctccgcctgcttgtccgacggtgacaggcgcccccgacccccaggatggccccgaggccactgcgggaaggccgcacctgtcgccctctgaccccgaggtcgtcggcacagaagccgagggcgccccgcgtggcctctcggacgaagagcgccctggagatgcggcccctggcgaagaagatcggctccgccgaaaggtgcagcggccggtctacttcgttagcgaggccctccgggacgccaagacccgataccttcagggccagaagatgctttacgctattctgatggcttcgaggaagttgcgccattatttccaagcgcattgggtcacggtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcggagtggaccccagctcccgagcccgtctccgcccccgaggccagctcgggcccatcgcagctgcctcacaccgcccactgggtgatgtagttcaacggcgcctgtagggaccggccccacctgtcaccgggcctaaggagtggcgtcacgcccgagcgcttccctcgaagggggcaatcgccctggcgtaacgccgggggctactgtcggtgacatggggccgcgggtatcatgactagaggcttgggtagccacgatcacccacgtggcctgaccccctcggggggggtcgggcccgaggatgatgtagccacccctccctctgtctccccgaggggtcgggccgcccctgtttcggccccgagggatggggcgccccgaccccctgtgattttggcgccacgtatatgggttaggtaagcacagcggcgctcacctaaccgcatttattgcgggttggacgagcgcgccacgccgcatttaatgcagcgcagcacgctcgcttatccggtccgtaaccggtagcagtgtgtgaccggtcaccgatcggtcagattgctggttaggtggtaacaggcggcctgtcacacgccttgccccgtcccgtcggaatgatgagagcctccaggcgctcgtcactagccggagccggcgtgctaactcccggagttggcacgtcagtcccggctagatacatgccaggcttcatcgcaaccattacaagcaagacattgtatgaagaagggcgaacatgcagattgctaatctgacgcgtggtggacaagaatgactggtttgcgaccggtctgacactggttatgtcgtcggcagacgaccgtgtccccacgttgcacctgcttccggcggagtggaggtaggtatgggccgtcccatcagaaggatcactcggacagcagccattgcaagtctccgcccaattaaaaagagatgacagggtgatccccgaggtcagacgaatgaggacgcgtggccgcactcaaaaacaagcagtgttttagcttccaagagaaggcgagccaagttttagtaaagataggatgggtccccaccctatagaaaaggaggtagaagtggtgcatgtgggatccccttgagatataaaaggaggaccttgcccacttaagggtggggggggataaccggagctggtagaggagagaaggaggaagagggtctctagagtttgaactctcttgctctccagctctttgtagctccttcatacacagatccatcagaacacaggagtagggtattatgcttctaagcggcccgaacctgtatacatcgcccgtgtcttgcgcgtttccactttcgcgaacatttcacagattgagagcttagaacttcacttagcgtccccggccgaaccggcaaaggggggcctgcgcggtctcccggtgaggagccccacgctccgtcatggctcatgaaagccgactgcaggaagcaaaggaagatcggttttggagttatcaagacaagaaattttgaagcatgaattctcatactccaaaactggggggcatgtgttaatagtgaaatttgttaagcacagagtagtcatcggcttagagtcagtatcagcttcgaagtcttgagattagtcgatgagagttgtcaagtcatcagtgttcggattcttgctatattcggttaaggaaattgatctactaaaggaagcttatccagaagagaacgagttcaaagagaatgcggcatggcaagatatctattaattaggaatagtttgttagtttctttttatgtttacgaaagtgtgtttagtgtcctataagtactttatcttttccttttatcattaggaaagtttctttcttgtccggcaaggacttgtatcaacccatgggtataaatatgtacacccagggtctatgtaatctatcttcacgatcaatacaattcggcgcatcgccaccttttaccttttctactttattttattgtccggcgggacttggcacctaacgcggggctgcatcggtgttcgatctccggctaaggggtaagtcaaatgtttcgtcggtccaggcaatagtatcgtttacgtcggcgtcgttcaaggctctatcagtacattcgacctcttggattgctctggtttggatgatatatttgcctacctatttatcatatgtctctgttaatatagtcttagcatatcaatttagctctatcggctgcttctcgttttagggattctgccggtatcggctacatcgcgttgctagattagattagcttagacatctaccaccctaaaaactcagtcaacggcttgattgtctagatattatatttcttttcatacttagtgctgcatccgttgagtttgatctactaagtcgtgcttagaaccataatctatagcctgcttcttgattgccaataagggtttcatcagggtttcagccggtgagttatatggacgttgcatcggctcataaggattgcatatacatataagttggatttagccgatggcaacaaagatttctttaccaaactctggtaaatacatgagaaatcccgtcaaaacttggcaatattgttaaattgtcaaaattttaacattgctaaaatttgataaagtttattttagctataatctgaacatgcccttaatacgttcccttttcactggatttgaacacatcgaaatctggggaggcatagaacaacatatggcatatgggcaaactggagctcaagcgcatccaccgaaccagagaggcagagacaacgctggaagcatggaaccagagactacgcgcgcgactgacgcgtccgatattttaaaacccatatctagtgtgtaacgatcacacattggaactggcacatattggaactgtccccaatgtgttgttttgcagtagtgtttgcttcttttcttcttaaaaaattttgtctgccatgcatcttcagttagcttggcgaaaggaaaataaaaatacaacgtaaaatcgacattgatttagttttgtttagcaaatccaaaaaaaaaaatctaacttggtcatagtggatcaaggacatgccagactttaggactcgttcttttactcaactttccgcttcaacatcttcattttccccatttttcattagcacgtttttaaactattaaaggtatgtctaaaaatgattatatatatagaagttgtttaaaaaacaaataaatttattattaaaaattgttatatgaattttcacatctcgcgtgcgctcgaaattcctctccacatggagcgaacgaacgagctcaaaagaaaatgaaacgccagaaatgaagccccattgttatatccagatctagttgtgtttagttcacaccgaagtttagaagtttggttgaaattggtacgatgtgatagaaaagttgtgtatataaaaggtttgatgtgatggtaagttggaagtttgaaaaagaaaactttacaactaaacagggccagatctgtagtgtatggcaaaatccaagctattaatgcctcgctagctgatcaactggttaagtcaagtctgcctcaaaaaaaaaatatatgattaagtcaagtcaacattccaactgccccagtcatctccacattataacacatggactgcgaggctccgacgtaagctttggggcatggcctcacactaacattcatcatctagaggtaatactactaacaataatatttagctgcatttttgtctcattttacctttttttctcttacaaaatacgttgtagaaataagggtgaagacataattttttttcatgcactgtagctacctttttctaaaaaacactgattataaatgaatttgtattttttaataatattttgtacaacgtattttgaatttaaatttttcatgaccaactgttcatatcattacagtacacgtctgaaaatggcatgttttgtcgacatttttacttgtttcgaggcaataagaacagatcaaccataatgagtgactaatgaacatgaggtatgtttacgtttttatttttcctgcaggtcaggtccttccgttttaaaatataaaatatattagcttattcaccgtcttcaacattgtacatttaccactatattcttttgtaatactgtaaaatgtttaaataatacagataaagtgataccacatcactaccagaaactgtattacttctgacggccaaatcccgtcagagataaagaaaattccgtcaggaaaataggacctgacgtgttaccgtcagaactagcttgtcggggaaaaataaatttgcctagcgtgtgtccgtcagggttaattttcctgaaattcaatgcgcgcgaaataccaaaaatattgccgctctgtcttgtttcctcgcgcgccattgcaattttattttacatagtctttcctgtgaccccaaatttttgcactgatgggtacgttcacgtcaggcaatttaatattactgagtttaatataattttaaggttgagaaacgtctaggggtcttcggctagcttgtcacgccccgaaccagtcccgaccggaactagcccgtgacgcttcaaattaacctgttaatcgataccagtcccaggaaacagtgctggtatcacagggagacagaatatcatagcaacagaggtctctttattatagtaggggtacagtcatgttgggccgtggacagatcccgagctcacaactgtattacaaaagggaaacggaagccaggacttggaccaaacaacacaggcgcgacttaggaactaggccgaaaccctaaaactcatcgtagccggcttgctcctggaagaactcctcatcagcaggatccgcttcatcttattcagcaactggggggggattatttatatagagcaagggtgagtacgggagtactcagcaagccatgggaaataagtgtttaatgcaggcttcaaggaagggctgttgtttttgcaattgattttatttgaactctttttctaaaaacaactaagtgagtgcttctcaaacgacacggatgagacagtgcgtctcgtccggtcggagtatgtgcaatgtatcagtctttagaattgattcaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacctttacccacacgacattactaacccagatcacccagcccgtggggatcagccacgtcgggagacctccaagctttcatgacaaggcatttcgaaagccaacaaaggtttaccatatgccgacgagaggggtcccagaccaacaacaggttaggtcccagaccatactatgccaggaagcccaggagtcctccccgacaccaccccggcgaatccacatgtctctcggcatcaaggctcccct

SEQ ID NO: 75433 - DNA, 6551 bp, Oryza sativa
agacgcccaacaacggcggcataataggccagccgtgaaggcggggacaccagtcggcggcagacgaggcggccggtcggtgaagacgtagacgcccaacagacggcggcataataggccagccgtgcaggcggagactccactcggcggcagacgaggtggccagtcggtgtaaacgtagacgcccaacaacggcggcataataggtcagccgtgtaggcggagacaccagtcggcggcagacgaggcggccggtcggtgaagacgtaaacgcccaacagacggcggcataataggccagccgtgcaggcggagacaccagtcggcggcgacggaggcaggccggcggtgaagtcgtagacgcccaacagcggcggcataataggccagccgtgtaggcgaagacaccagtcggtggcgacggaggcaggccggcggtgatgttctgactgatccattcctggagcgtaagagataagcttaaagccatgaatcccttttatgcatatctggatctggatcctgcagaacaaacatataggatgagtagtatctgatataaatataatactcgagaaaaattcaagtattttaaaatatttataaatatgtatttcttctcttgtcaattttgatttccccgagcagatgacttattacgtttaaacactctgcccgactagtcatagccaccaagcaccgggagtcggcctaagcacttcccaaacatgcatatgagtgacatgagttcgtcattaatggaacaaagtttcacgggtcggagtttactactcgggtacttttgcaattattaagagcggaaaataaattatcttatctctatgcttttgatttattccaaataatgcttagcaccttgtgttattcggtccatccaacaagcccccgggtgctaggaatcggcccaaaggcaactatccattggcaaaccaaacggaaagtataggaagatggaactccataactcgataggcacttttgtactcagaataagtcgcaagcaatcaagataaatattatgaaaattgtttaaaaaatatgatataacatctgtaacccccgactcactagtcaacggcgaaccagttgatgtagtgaggcaaaggaaaaggcaaaatatcatataaagaatgaaataaatgatgacttagctttatcgtattccctcgatgacagcaaaagtagccgatgtgggaacgaaacagtccatcaatggtgacaaaaacaccagttggcgccagtggaaccaagccagtggtgtagatgatgaagcccattaacggtggcgaagtccgccaaccgtataagcgaaaacaccagtcagtggcggcagaggcaagccggcggtgaagtcgtagacacccaacagcgacggcataataggtcagctgtgtaggcggagacaccagtcggcggcgacggaggcaggctggcggtgaagtcgtagacgtccaacaacggcggcataataggccagccgtgtaggcggagacaccagtcggcggcgacggaggcaggccggcggtgaagacgtagacgcccatgtacggtggtgtgaccaaccaaccgtatatgcgaggacaccagtcggtagcggcgaaggcaagccgattggtgattagatgatgtcacccaggaacagtggcaaagtcatgttgccacgaaggcatatatgcacaaaaaaagcaaaccaatctggttagtaccaacaaacagaatagttatagatatatagacaaatatatgctcctgttggcatgggcgattgtgttgatagcgccatgattagttgaggcgtgctgacatggattccggccgaaaccatcgctaggtgacattcatgtgacagcacaattaataactgtcacgcccagccacggacaaccggttgatcttggtcagcatatgcatacatgcaaagaaaacgattagtagattaatctgttatcaagcataaaagcatgtatataagcatatgtatatatcaatgtatggctcagagctccttgtaatcggctgctcctatatgcccctggtaatcagcaatgcttctcgcgtgaagaccgccggttaacctatgctggcgtgtagatcggtacagagcgcgaacggaattacatcagcaggacacatgaggtcgccgactgcttcgtctctcaattggcataggaacagccacaaaaaatcagaagatcgatgttaacaacccacttcttctaacttaatagcaagcatccaccatacaaggaacaattgttttgggatgaaaagagaagaagaaactaagtaatacaaattctggaagcttctagagctgagagagaaggctgtaagtaggaggagaggtaggggagagagatcgacaagggtgcccaccggctgcccaggtcgccgccgccgtcgagagcttcagctccaccaagtccaagtgatcaatcgatgcccccaaccttcctgctgctgctgcttttgttgcctctccaactgggccttcttgggctggattggaggattgttgtaacggtccaaccatagcccatccggtcctaacaatcccctctccttgaaaatcggcttgtccccaagccgatgaagcaaacctcctggatcccatgggtgctccaattcttggctgctagacagtaaaccatcgtcgaaatggaatagatcatgtacctttttgctcctgttgagctcaaaagattcagaaacttgtagagcatatttcattggagctgcaatatctttgctaaaatccatacttaattcacggttcagtacaagagcaggaattttctggacactcgaatgcacctgaatcccttctgaataaaatccttggttttctgttgagtggataccatgtccaaaaacattcacccttgtggccatagttctatgtttgttgccttctggtagatagttgttggttactgagtaggctaaattcccaggagcaacaaatgtgttcctctggataacatgctttgcccctgtctggtttctttttaatgcatcacattgtaatttctgctctgaacaaacagccatcttggtataagtcccttcagttagaattgtataatttccaaccttccattcagtagctgctagaaccaaaatccagaatattgggcatccatcacttgttacctcaagcacttttaactcacaaaaatccattccttcactaggagccatcgtgtgacaagaaacattatcatcgcccaggttcacacaactctgcatttccaacttagttaacaacaccttgtcagagccccttagatagcagctgcccttttgaactgttttagcagtcgataagccaaaggagaagtaatgtaggttcacaaacaatctagacatcttccagtgtccattacaatcattctttggcatctttctgaacttccttgtgggccatccattacaagcatatttgaatttgagtatgtgttcctctccagttcctaacttctgcatataacatgttcttactagattcgaggttacttgcaccagcttatcagatgttaattctagctgcttcaaaaaatctaaattattgccaactatgaattcagaccatactccctgacacaggaaacaataatcacccagagcctccaaagtaccttccaactctagaatcaagtcaacaatgtactgtttaggatcacacccaattggcaacttcagttcatatcttctacagcacatttcacatagtacaagtttaagccacttcttgcataataggagttgaagcaggttatagtcttcataattttcattgaggattgcataacctgagtgccacatctcaacaaaccataggtcaacaactgataataactcaccttcccttgcctcagccaaatctaattcctgtaattcaacacttgcatgtgcactgatcaggaaatgcacactgccatttcccgaaggtggaggccatggttttagatcagcccaatgcaacactttatccatcatatcagtgtgagctactccaatttcaataaatatcagtgcaagccaacttactttaattgtcggcggccaaggttgcaagatatgtactcttgtgtcataggagttgaacgtttcacaaggtactggctgcagctcacattgtaccatcatcttgtcaacgaataatctggttgctaggttgcccatggggtggacggatgctgaaacgtccttggacaccactgtcttggtttggaatgcaaccacagcttggtcattgccaccattgacgtcgaggccgaccatcgagcacatggcatgcgtctccttgaaacaaacaggggcgtcaatgttagtgttgccagtggtgccgtcagaagctaacaacaccattgatgacacagcgagggtggtgcaagtaaccggagcaactacagtgagatcgggcttggtgtcagagctagagcatatcgtcgaacacttggtgggcgtgaccttgaggaggtccttggtgacaatgtagggagcttggtccatgtcctttctgtctcctagctcccaggcagctatcggagcaagcacctcaccaatgtgacttgaattcgcagccacccaagtgatgttgttgttggagcattccgtcaaacacttggtaggcgctagaggagacggtgccatgggtggtagagatgatccagcattgagtacggcagtggtcgccttgatagaggcacccatctcctcgaagaacttgttcctattagcatctatctcgtccaacttcttcaaaattcgatcaatcttctcatcacacctacgcttggcctccatttgttcaaacttctccaatatccgatccaaagcttcatctagccatttctcctcttttttcatggtggaattgatgggaatgggctcagatatgctctgatctttcttggacatcgcaggttggcttggcgttccatcgaacagttggtgggcgctgcttggatgaaaacttccccaacccaattcctgctccctcttgcatggctgcctccccaacacctccatgacaagaatcccaatgaaccgaacggctctgataccagattgttaacaacccacttcttccaacttaatagcaagcatccaccatacaaggaacaattgttttgggatgaaaagagaagaagaaactaagtaatacaaattctggaagcttctagagctgagagagaaggctgtaagtaggaggagaggtaggggagagagatcgacaagggtgcccaccggctgcccaggtcgccgccgccgtcgagagcttcagctccaccaagtccaagtgatcaatcgatgcccccaaccttcctgctgctgctgcttttgttgcctctccaactgggccttcttgggctggattggaggattgttgtaacggtccaaccatagcccatccggtcctaacaatcgaatacgaaataaaaattaatctcataaaagtttgactggaacggcaaatctgagtggaagattaaaaccgtcgaactcattgagatgaaggttgaaaccgtcgaactcgttgagatcgatctcagcacatctctagaaattgattccatcgcacttctcgatggaaagctcgacgcaaccctacctggcgcgccactgtcgaaacatgaattcggcaataataaaagggggtagcgcacgatacctaaaagtggatggatgcagagacaaaggatttagacaggttcaggccctctcaataagaggtaataccttactcctgtttggggatttgaatccgccgggtgaattatagatctgacgatctaattgtctcatgccccctagagggcctcctgcccaccttatataggatggggggcaggattacaagataaaaaccttaaccaacacggtatcagtttcctaaatctactttacaatattaccaaaccaggactttaggccgttttgtaatatacaaggaaacgtaatacccaagtcatgatctgttacatattccatatatataagttatcccttataactagtcggataaccatgtcgtgtgggtatagggtacccataatctccacagtgcctcctcaactcggtaatcttacaaagctacaatatctcgacctttcccattgaaatggaataggtatgtactcaacagatatccaatggctcacccatctaacatcgctacggtacctaggcttatcaaatgtagatctcagcagaatatcttattggcctcgtgtcatgaacatgaatgcttatctaagggcactctatctttctcattgctctcttacaagtgcaagccaatcaattttacagttaaacttcacaagacttgaggagctcgacctctcccacaataattttaaccaacctttggcatcttgttggttttggaatttgacaagcctcaagtacctcgatctttcagggaacaatattgtaggaagtctaccggccgcggtgagcaaatttaccagtttagacactcttgatctctctgagaaccaactttttggatctgttccata

SEQ ID NO: 75434 - DNA, 715 bp, Oryza sativa
gctcccggcgcgcgcagcggcgacggctcgtgcgcgagacggcggtggcggtggctccccgcgcgcgcagaggcgtgacggcagagagaggatggacggggatgggagtggcggtgggacccacctttggcagtggaggaggctggctacatttggccagccggaggagcaatttggccatccggatggcttggctatccggatgcagaggctattggagctcgttttttctctatgttagctaaattttaacttggagagccaaatagagattctgttgaagttgctcttgtgccgccatccgtcgaagcgaccataacgctcacaaagccctttaccaaattcaactattattgttgtatataccaaatccaattcacaggttgagcggtttgactgttgtccggttcagttgctagttaaacagtcaaataaagcaaagtatatcccaataacacacgatagcaatgttgctttggtggctagatgaacttgagttcgaatccttacacaattaaggtaagcatgaaatcatctttaatctatctattatatactaaaagttcattaaattttttacaaacgctcctaagccgtcacggggtactctaaaaaattagagaaattcttaaaatggcacaacatggaaccgttgattttttattaaatttggtgacccattacttgtaaaaaatcatctcgttatcccataggc

SEQ ID NO: 75435 - DNA, 619 bp, Oryza sativa
gttttggtttaacaaattgtttagtgtgccccaatatcaatacgatctaaaattacacaattatcgaacttcaatacaaagagaagtggcatacaattaacaaaacaatatgcagatttacactagcactaatacttttcacacgcaaaaccggttgaaggtgaagccacaatttttacctgaacttcacggaatcggcgacagcgcaataagacatcatcgaatcagggttcagcaacggcggggatgaccctggtgggggcaagatggggcaggcatgacgaggacaaacagcgcgggacactgtgccgacaaagcctccggatacgattttgctaaacgttagatggccataaggctcaaggctcggcacggccatctggcccgacccaaacatggcatggcatgactggtgacgggttcgtgccggcccagcccgacagttgagccatgcctgtgcagatgacttggcacggtggcgggccggcccagcatggcacacggtccaatgagtagcaagaaaaatagtagagggacccaaaataaacttagttgccatataaacttatcgcctaaagagaagagggatgcaaaataaacttataccaaccatataaga

SEQ ID NO: 75436 - DNA, 4191 bp, Oryza sativa
taactgacatcaacctaagggtcaataacttgacaggtgaaatcacagagaaacacttagctggtctgaagagtttgaaaaacatagacttgtcttctaatcactacttgaagattgtggttggtcctgaatggcaacctccatttaaactagaggtggcaatatttgaatcttgtcagcttggtccaaagtttccttcgtggcttcaatggatggtggatattaaaatacttgatatttggaacacaggtataaccgatcaacttccacattagttttggacaacattttctaaggcaacaaagttagacatgtcctccaacaaaatcattggtagcttgccaacaaatatggaaaccatgtcattggaaagcctctatctaggttcaaatcaaataaccggagtaataccgaccctgccacctaacctcacctggttggagatccaaaataacatggtatcaaggattgtggcatcaaaaacctttggagctccaaacctaggttatatggatctatcctccaataacatcaaaggtcctattccaggttctatctgcgagttgcaatacttgagattcttgaatttagccaacaattatttggtgggagaatttcctcattgcattgggatgacagaagtaaattacctttttctaaataacaatagcttatctggcagggtcccatcttttttgaaaggttgcaaacagctaatgcacctagatctatcacagagtaagttccatggaagactgccaagttggattggagacttcccagcagtacgaagtctaatcctaaacaacaatgtgttatctgggcatatcccaatcaacatcaccaatctgacaaatctacaggacctggatctatcacaaaataagttccatggaagactgccaaattggattggagacctcccaaaagtacaacgtatattcctaaacaataattcattctctgggcatatcccaatcaacatcagcaatcttataaaacttactcagttgaatctagcatacaataatatttcaggcattttgccttgacagttcacattttaagaggcgacgaaggttaagcatcatgctatatataccctagataccccatgaaagattaatacagtttgtcggccagcattatcatttagctatacctgtctgctacgttaagtgcatagaaaagttagattactatactgcctacttcctccgtcccaaaaaaaatgaatatagcattagatgtgacatagtctagtacaacgaatttagacagatgtataattaaattcataatattaggatatgtcatatccagtactagattgattttttattggacggagggagtatggacttgggtttgtgctagcatttgcttttgtcctttatattgttcttttttgtgagtctagatatgccgtttcctctgtaaactaataagtgtttcttaattaattattgtattgcatctacaacttctgttttcacctatcatggaagctaaattaagactattactcttgggcacctggcagggggcaccgtattttatccctctttcacggcaccaacaactgattaaaccaaaaagattatttttccaacttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcatgtgctaatggactgcttcgttttccgtaccggagggatgggttcccaactcaaccaaaagaacagagccttaaacaaatgaacataccaaagcagtcaattgtggaggactcgttattcatgtcgagagatttttctggctctggctgaattcgctctgttcgcacggtccagctcttcacggagctgcccggtctctgaccgaattaatgtgctagtcaactcaacccaacggcatcgacatagtaccattcaattcggtgcatgcatacatgcatcatttcgtgctagacgccgttgctgtcggtacgtcactcacacggttgggccagaaaattaaattaaaccccattaattacagcattaagggcgaaatgcaggtagttatactccacagtccactagtcgtacgcaagaacgggtcttttaaaatgagcttaatttaaggccggtttgccgtgcgcgcacacacacacaatccatacgtgctcactgctctcctccaatcactcaaacacacatagtaagcctgtgcaccccatgaaatcatgaatcccaccggcaagccgttgctcctcctcctcctgggccttctcctgctagcaaccaccactttgtcccgagcaatccatgcgataccgtaccgaaactcggctctggtgccaccaccgtcgcttgcgtgccacgggaacgggacgcccttctggccttcaagcgagacatcactagcgaccacttaggacttctcacctcgtggaggcaagatgaccatgactgctaccggtggagaggcataacctgtagcaacctcaccggccatgtcctcaagcttcacctcagtggcatatacactaatgagcatacaggtatggaaggtttggtcggccagataagtccccagctgctctacctggatcatttagaacatcttgatctcagcattaactatttggaggggccaagcggtcaaatcccagagttcataggctctatgaagagcttgagatatctaaagctctctggcattccgttctctggtacggtgccttctcaacttggcaatctttcaaagttgcaacatctcgacctttccgacctggagggaaaggaaggtatgcacttagcggatatgtcatgggtatctcgtctaggatcattacggtaccttgatttatcctttataaatctcagcgcggcttctgattgggctcatgccgtgaacatgatcccttccattagagtactttgtttatctttatgccaacttcaaggtgcgaaccattcactcgcacactacaaccttacaaaactcgagaagcttgatctgtcctcgaactattttgaccacccgtatgcatcttgttggttctggaactcaacaatcctcaaataccttgatatttcatcgaacaatttgtatgatcagcttccaaatgcgataggacacatggcatccctcagagtcattaatttttctgataacgctcacatgggcattgtggaaccagagttgatgacgaacctatgtagtttggagaatctaaacctccaagggagcctctcctatgggaacatgacagttgctcgatagtctgtcaaattgctccaacaaattaagtgagctgaatttagcagacaataatatcagtggaactctgccacctgggatattccaacaatatgcagacttagtcactcttgacgctagcaacaatcagctcgctgggcctctgcccgttgagattggtatgctcacaggtttaaatcacctggacctgagttacaataacctggcaggtgacatcaccgaagaacactttgctaacctaaggagcttaaaatacatagacttatcgtctaatgatcccttgaatattgtggtagaccctacatggatagccccatttagattagaacgtgcatcttttccagcttgcatgatgggtcctcaatttcctacttggctccagtggtcggtggatatttggttattagaaatctcaaatactggtataaaggataagcttcctgattggttctggaccacattttcaaagctcgaagaattggacatgtctaacaaccaaataagtggtgtcttgccaacaaatatggaaaccatggcattgagttatctctatcttggttcaaaccaaataagtgagtggtcaattacctcctttaccgagaaaaattgtaaaattggacgtctccaataactctctgtctggatctctgccatctaactttggagctcaaaatcaacaaatggttacgctgattctttccttcaacaacctatctggccatattccggaatccttttgcagaatggaacagttggccgccttggacttagcaaacaatctttttgagggagaattgcctcaatgtttcgggatga

SEQ ID NO: 75437 - DNA, 3260 bp, Oryza sativa
taaaaggtcacaatatatttatctcaaaatggacttggtttcaccaatatacgcctacaaatgtggaaatttttagcacgaacgataaacagcagtaatatttcctagttcttacaagcatggttgacttataaatagtactacagcatacttaaagtagacaaacagtgcataaaaaaaacatattgctcccttaaacaacattgtcatgttctggcctcctgatgatcccagcatgagtgagaagtgcccagaggattgttatcagctcgcctcccctggcaatggcctttgcatgtgcctttgtattgtcggaaggagcaacatatagcatcatctctgaccaaaactcagcaagcatattccaccccttgttttcattctgaattccatcaaccagctgcttgccgagttgtacacctttgcacaccacctcattgctctttgatttttcactcagtaattgcatcatgcggtcaaattcgaaacacctcatatcagtgctgcccaaaacagagtcggtgatcttcttggcagatttatacaattcttttgaccatggagtgtcatctggcagtagctctgggcacgatgctagcaaatatgcacagtactttgacaagtgaatggcagtgatcatatcatcattctcatcaggagagctatgacgttctgaaggatcatgcatgtgcctgatctcaaagatgcaagttgcaatgtgccaaacaagaataatgtcagatgtcccttcaccattgcaagcccaacgaatatcgtcacgcagatggcacttctgcaaagatgctatgccattgctcagctgcccattgctacctttaagtgagttgatgagagcagccttcaccggctttggtatcttggtaggcttcattgctttagacagcctgaataggtgcctaatatgacctttcctcttgcaaggatctaatagagaggtcatgcccattttgtcaccccagtaattcatgagcttgcatctgcaccacagaaaacaagcaatcaatcgtctcatgattcgagacttttgccatgatggctttgctgtgtaggcgcaaaccagggtaactttggtccagttagagcaaacgtaagatatgatctcccatacctcaccaagcaaaactaccagaagaagggagatcgttggcaccaacacgaacaagatgcttccaatatcatgaaatctatcattatcttgttcaccgcatgttaattcgcaggacattaccctgtagtccttatactctggaagaattttccaagccagtgtaatcacgatgaagatgcaaaatgccatggtaaagagtgaggtcatgatgctcataatgggcaaccacttacccaaatgggagatcgggtgggacgagtaatagaaatcccaagcaaatgatagctcatctgtgataaccctgaacacagcttcaggatctgcgtctgccccatccgtgagcaatataccacgaacaaagtgaaaggccttctcagaacctgcctcaaccagtgggtacctagcaaatcgccttcgcagaagcttaaacaatgagaatgacatgcagagatgtttcagtgctggccttggccccaaaagagcatcattcatttctgccaaatgccaaactttgtcaatggttaccaagttaccattgcttgtcatcgcacttgtcccgttctggctaaaagtgctacgtttgaagtgataaccatgaggtcctttctcaatctgttgtttgtcttctcccattaccacgagtgctaaaagcctttgtattgtcacctctgcaacttctgatacctgtagtctgtacaattcttccatatatccagcaataagactaggattttgtcccatagcgaaggagcgccgtgccctcccgtatgcaacaaattttagaataatcttgatgaaaccaaggcccagtaatgttgatatgatgatatctggcaattcttcggtttttttttgtgtagtagtacaacacaaggaagaaggtccaaatctgtcgagcaagcatcgctattgattcaaaattcccaccttcatttccattatgaacggcagtcaatattgaacttgtattcatcccaaccattggcagcagcgctgcccatagtagcagacagaatgcgcggttgtcaacgcattccaaaccgtgaaacaagttgtagtacttgtctctgccgacgtaggagacaacataggagaggattggtaggactagagtggatgctcccagaaaaagatagcggttcaaagcaatatgccggtaacgacggccataagagccagctcccacaaggatcaccaccaagaatgcattggcgacgaagagcgcattcgtcgtcagtacatctttgtttatgcgctctatcaagtcgtttgagcggaagccacatgtggtagacgacattatagcttttatagatcttgcaaccttgttgtgacaatctggtttacatatattgcacattcattagggttagactggaaaaagagttagcttataattaagaaattaaccacaaagttatattttttgtgtccctatttattctcacatgtttgaagctcttacctgacctatatggaacaaatcactaaaataaacaaaaaagaaaaggaaaaaagaagaatgtcccaaaaataccaccttgaatttcaatgttagaaatattccactctaaaacatgttctccttgatttatgccatcatagacttgacattaggtcaaaaatattttttgtagctctcccaacgttaaatttaactggacagtgtaattaaatgaaagaaatcaggtttggggtggcatatatatttttagctatgatattctgggtgacatatatcaaatctatgtattatataccaaaagtccactaaacttcctataaacgctccaaagttgtcacgtagcgcttcaacaagcattcctaggcccgccatgtggcattctacaatcccaccatcgattttatgtcgcgtcccaaatcgaccctaaaatagatcctctaaattatgcctagaataattaaaatacttatgaaatccttcaaaaattaaaatgtgcaaagttaaaagtcaaataaggcttggaggatttttgtatatttcctaaaagcctaaaatgtgtaaataaattttagtggaattttcagagcacaaataataattattaagaaataaacaaagttaaaatgattttataaaagaaaaaccttaaaatcccccccctccccc

SEQ ID NO: 75438 - DNA, 16474 bp, Oryza sativa
cccctccgtttcgctcgccgaccaccggagcaccaccgaccccgtggacccgagccgcgccaccgcctccctccgctccggccgcctcatccgccgccgacgtcgccccggggtgagccgtggaccgtcgcctcctttcccccttccctcccctatctcggacgccgctccgccgcgccagtggtcgccggcggcgaccatcggggcgcgggcgccgcctcccgccggccgcgtcgacgtggccaccttcgggcgcgccgcgcggttgccgcgtggggcccagccgtcagccgcccgcgccctcggctgcggctgacgcgtggggcccacggcgccggccggagtgagcccgggtgcacccggtccaccgtggaccgtgaggctgccgcgtggttcccacccccgtggacatggtccgcgcgcccctctctcccggctgacacaataaatcccttttaaattaaaatttaaatgaagaaattcgtaaatattcatttaaagagcatataaacttcaaatggccataacttggctatttgaactcggaattggaccgttcaagtctctaatttttccttaagaagtcaagaacccatttttgtgctttgttcctgcttgttatatggagtttattagagtaaaagcccttttcttttccgttgctcgtgtagacgctgcagcttcggaagatccgctcttcgtggaggttgaagccgacgtttgggaaagcgagcaaggcaagtcacatcatctttgaacatattggatcccagtttgtgaaattattttgatttaaattaatgcattatcgctttatttaaattcccgcgttatcactgttttatttagccatgcctgtttacctttgttatgaccttattattattgctattgttattattaccttgttcaccctagaataaacaaaaccccaactagtgggtactctattcatggtgccactagtatgaatttaggtagatgcttcgctgattaattaggcaacattaggtggttttataactctagactttgggaatattcatatcacttgaacattatggaatggttggattattgcgaaattggatgcacacctccccctctattcaaaaccctcaaaatggttttaggctgggctcggggtgcatggttttgatagtagcacctcggccacgtaaggaccggtcttcgggcctctgttgcaaagcactcccgtacttccacatgtctagtgggtaaggcttagtttgtggctcagtatggttataaacaaaagtacacggatggagagggacgaagtcgggggtcgatggacatctctaggacaaatgaatgctacacgagctgcggcccggtagtcaagaagtcatggcacaggcctggtgtcctgctgctaggggctcagtcctgcctacctgtcccggaggttccggccgtaggtggggttgggtcggtactcttgtctatggctaggatgggttggaaactatgtcatgtcttccgtccatatgccatggtggtatgtggcacgtggttgcacgtgaggaagacgtgtcttgtgggtaaagatgtacacctctgatcaaagtaaaacctattcgaatagccgcgccctcggttatgggcaagcctagcaatgtacccaagttagtgttttcaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacagccttgtttaataatattaaatagttctaggatcgtgttttaaatttagcttcgagcaactaagtgtcttttaaatgctgtttactgcaaaacctaacccctatactataactccattgtactccctcgcatttatgttgcacttgtgggtgtgtcttgttgagtacggtggttgtactcagtcttgcttaatttttcccaaacccagaagaggagcccctggatgatgaaggctttggtgtttagctcgtgcttgccgtcaaacgcctgtggtcgtcgccctagtcttccgctgtttcccgtttgtctttgtgtgagctgggccttcgccgcccatgtaataattaactatttacgcttccgcttgttaaactctgaattgtatcaacttttggtgtaccttgcctcctgggacaaggaataatacacgcacgtaaggaacgcccgttgggttatttccggtcgtgacattttagaaggactggatctatgtcaaaatcgcgtgcacaagggcgtctcgggaccaatcagacatgcgaaaaattgtgcgcaaggacgttgtgggcccaatcgtggaagcgcgcaaaggcgcgtatgaaaaatgggcttaatcgctggcctgatcgctgcatgtggcaaggggcacatggaaacgtgcaagcccaaataattcacgcacgtctcagataagagggacactttggcgtaagaaaaaagaaaaaggttttgacagaaacataaaattaaaaacaaaacataaaaattaaaacgattcaaacacgatgacgtgccgaaattccggtgaaaacatcttcaatttttataatagtagattgaagttttaaaatttttataaaatatctataagatggtaatatgaaaccattgtaaaaaaagagaataaaatattttctctcactattaccaatccttgaactcaggatctcttggacaaatcatttttgtcttcaataaactaaccaacttaacccgtgtcattaattgtatatttgtgccttgagtattgtttaacaaacttaccaaattattttgcaaaaaatgtattatttaacagtttgaaaagcgtgctaatgaaaaacaaggaagttgatgtttggtgttgaagaaaagaacagagcctcagaaatatctctacagagttttaaatatttgattaaaatgcctttacatattgttgacggtcgttatcgatcagtttcgatcgtcaatattaccaaaatagaagagaactagtgatgcttgcaatgcataaatatgttagaataataatattccactagtattaggtatactaaccttttgcagagaatgacactaaagtggaggagaatcgacatcaacatggaagataaatcagtctgacgatgtcgagaatcagacttatgcatgaatgggccaagaactcagaattaacacgtcaaactgggccaaaattcataagtctacaaaaaggagcaacagaggtggccgccagccgaaaggtgggctggttgggccggcccctagttcgaccgaacctccctcgcctccgttggatccaggttttggctggacggttgagatgaagccccaatgacggttggagggtattaccgaccattccaaccgtcacaaccgtcatagttcagctataaaaggagctccccttctcacttcactcacacaccttaagcaatagctctctcatttctctcaagtttagtatagtagtatctagctggtaaatagaattagaataggaatcaggagtccggaagtcttcggaagagtttgggtatggctctagtagcttttctcttctcttttgtaagctttgtacttttattagaatactcttctaaatacatttatggtattgaaatactttccgagtatatgagtacctactttacattatgttcatgttatgctgaatatacggctagcttatctgggagatgctttggtgcgggtacaatgtttgcttatgcaattactctatgttatgatgatgatattagagtagtatctggtagtttagacgtggtgtctagattacgggatatcattatttagggttatatattgcggatgagaggtgggccgctgatggtgacagttcagtacgggtattcctctgcgctggtatataatcctaagttaattccctggggagggtatttctccgtatttagctccggttgtatggtcatgacaggctgtcgtaaggaactcggcagtcaggggtggcttctcgaagtaccaggagggcattggatcgaaagtattagctagtatatcagttaactagaatgtatgtatactatgtatattagaagtataggaatagattatctttctcttttctaaccacttagcttagataatatattatgagaatgagtagttaatgcttgtgtgtcactctacctttaaattatcttaacccttgcttagaatatgattataacaagtaatatataaattgttagtcaagttctctctacatgattttcccacgtgataaaataaatacgatacccttggaatattctcgggtgaaatgctacaatggtatatctgtgcgcttgcggatgaactctgtaaccatactataccaggagtatttctgcgccattgttgggaattatatttctagtaatgtcgttaagaaataccaacacttattaggcgcattttaaagtgtaaaaaaaatgcctctataaaatgtgttgaaaatatctctacaatgtctctagagtacacattttctaggcaatttttaatgtgtctataaaatgtttggggtaattgtgttcttgcccttgctttccgattcaattgtacttttacctttttagggattgtgtttttacctttttttcaaaatgaagtagctgtttgaccttgatcatgacgaaaaatttgataatttaacactttttttatttcccaattgttttagttagcacttgtgaggataacatgtggtaccatttgaacgattaaaagtaggccaggatgtcaaataatcgaaaccaattttaaaaactgttaaattatcaaatctctagagtgtggccagaattttcgagtaaaacaaatgggggagaaaataaaaaatgattttgtaatttgtgaatgactgttatacctctcgtgagtaaataaatcactcaagtagctgtgtgaatcaggctccgcatcccaaaaccctagaggatttggcggcggcggcggcacgaacaaagcggcggtgacacgaacaggtgacggggaggcacggcgacgacgcgacgtagggatgaagtatcaggcggcggcgaccgtggggcggcacgaaggggaggcgcgtgcgccgcggaccgtcgccaggactacgggcggacacaaaggggaggcgcgacggggacaacgggacgcaggggaggcgcacgcgcggccgaccatcgtcgggactgcgccgcggaacagcgctgctggaggcaagtaggcgcagaggtggcgggcgggtacggtatcgacacttcgacagcgaccaagtcggccacaacattttgccgctgggtgcatcggcggaagaggaaggtgtcgaccgcatcgtctcatgcgaatcctggacctcctccttgttggatcccagctttgctcaaagctagctaccgctgccaccgaggaactgggagggtttaatcagtggcagatgtaggaggggataataggggtctgaataaactatataaagctacaaccacccttcctatttacatatagcaaaaaaaaaaaaattagcggggctgaggagactgaaatttactccatatttctatatttttcatggattatttgaggagactgagaagagtgggttttgggggcagacctataacattttatacttgttgggtatttgaaatttgttctttggaaaaaagctttgagaattagttgaaaggtctgcgtatatttgaatgtatgatttaatttcaattaagacacttgagtggagtatattgttgtagcaatattaaaatattaatatcatgtactaaatacctcgaaggacacgtgcagatagtggtaatcaaaatttggtcgattaatgggaagtggaaattatattctgaatattgtacaggcaattgcacttgttttcataaagtaaaaagctagagtgaatcatcgttagcataattaggagtttagtgtgtcaacagatttataattcttacgtgtgttaaatgggcacattagttgatgcatacgtacgtcggtacgtgttatgtgtgtaaggtggtgcgtgtgcgtcttccacatagtactagcattttattaagtcgtatatttgtgcaactctaaccttctctccattagatgtgtctacatgttaattataataataagcttaaatttgtactaccatcatacaatgcaagcgtaacatacttgacagaaagtacgtgttgcttgaaaattaacatttttttatcatgatttgcaattaataacatcaaatagcttccatacaataattaccacaacaattgtctctctgtattgaatattgtaaatagacttgtaatctgaaatgcccaattcatgatttgttgaacaaaatggtgagtgcagtgcttagggttaggatttctattcatcttctgtattaccatttcccctttccatgtgttccgttccgccttattcgttgttgcttgagttgccgtcttcttgtcatctccgctggtgcacgagtcttgtactcctctcatattttgcttattctctacttcgtacatatatgtattatgtaatagaataggtgttcatagatgaaatctagttccaacgcaaatattttttttgagaagggtatttttttacccggcctctatatccaaccggatatatacggccattgaaatatgaaacttagacccaaacaacccaatctgaaattcgctccataggagatttgaactcaggaccttgggtactacttcggtcactgtaaccactaggctagatgccctttcgttaataactaagtattatcattaacaactaaatattatcataacaataaataattggttatcattatgataaatttctgaaatttagcgtaaaacccaaagttatagaatttagctgtgcgtaaaaatatattccttcacaatatatttttcaaatacaattggttggcattttgtggtttataaacctccaaaatgtatcagcttataagaaacaaaacatccacgccactccactctgtttgtgtgatctctctgagaaattttccactgtgacaaagagaggttaggtgtgtcagggtagaataaattgttgttatgagaatgcgtgaacagtgtgataatgtgattgaatatttgaatgggcacatgaattactacttttaactctatcagtatacacgtcaccttctcttgctaatgacacctcatcattcttttccacactttatttcctttctcattcgtgcatcccctgcttgaagggtctagaaccctctgctttttacctctagtatttaagttcgatcgaaccgttaaaattgatttcacgttttttccttagctaatccaacggctatatttctaagatgatgtggcacattcttgtctcatttcactagtgaagattcgaaaagaaagagtacaactagagaggatcatctttcgaatcctcggtcctgactactacttctgacacaaaccatcttaaaaagatgattagcgtggtggataacgagtcagccctgatcgttaaggttcgacttaattaggcttggttcgatcggattgttttaacaagccaaaggtaattaactcggttcatctcgtgagctagctcgtgaaggttgttagattcattaacacatttatatcatctttataatctgaaattgaccactttatcatatattaacacaataataaacactagctaatataaagaaatcacaaaatagatagtttggaaataactagctaaatgactaaattaacaatagctaaaaagcactaaatatgcatataaagatacgaaacgatctaatcaagcagcttaagagcttaaagtctcatcatgactataagtttgagctgataggagacacgagattcgaactttctttttaccacttaagtttgtgggagatgtagctgtatatttttcttcactccatttattttttttatatataatgtcattgacttttgatatgatgggcttatttggtttggagccaatttttgccctaccaaaatctaggtagtaccaaaacattggtaaattttggcactaccaaattgggtagtattcaatttgatctatggtgggtaaaatttggtagtaaaacaaacatctacttgctactattgaagttgccaaaattttagtagggtagtaaattggtatcaaaacaaataagcccgatatttgatgattcgtcctatttaaaaattatataagtattatttcttttgtcgtgacctttttcattaaagaccccttaagtatggcatgtactttatcatatttgcactaactttttaataacataaatgctcaaatattgttataaaagccatagatagcaactattgagaaattaaggaggtagtatttaattaattaatttttatgagcctacagttttggtagctgagaagcattttaaggcattcctaaggatataatgggggtgcaaaccagaataaatgacagtgggtgtatgagacccactactacacaaataattttcctgtacaaacacttcaatagattgtagatagatcataagtgttcgcgtctgtaaaattttattttcgtatatggccctcttaaggtgtcgttgcaaaattaggatgattttccagacgagccacttaagaggtcacacggaaaaaaatattttcgtagacgagcttcttaaggatctgtccataagtctgatttacctcctcttccttctcagcacttcattttttttttaaatcatccttatctcctctcctgtctcctcatactcctcgctctatctcaaactcctctctcccggacagaactctctactctctctctcccggaccagacggcggcagcggggggccctccatggcctagatccgcgcggatctggctgcggccgtcccctgccctgaccagtagcaggagagcccgaccagctagcattttgcgattttcttttcagattttttatttttgcgtgtggacgacagaagcacctgtacggaaaaaatgggattttcgtggcgtgtgggtcacccgtatggaaaaatagcgattttcgtagacccggcacgtgaaaatcacttttgactcgtatggaaaaattactttttactagtgacggatgaattgtaccaaggattgagcctgcttaccgtgtcaaaatcgcgatgatcaatgtaacactaacgcagtatcatgaagccaacatatgttttccatcaaagaaataactcatatttaacttggagaaatccctacaaaagattggattacattgtcaactctcaaggcaagtctgcctgaaggaaaaacactctcaagactagtgtgaaattgatcatctcaacaaaaacgcatacattaattagaaaacagaaatgggcaaaaagaaaagaacaggagaacaaagatagagattaattacacttcatcagtgttttgaaagaatctgctttccgatcgaggaacttcaagggcagtagtttcagcacgtacgggtaacatatttatactgaatgatcaagcaagaaggagagcaaacaacgcccacagcgaagtcgaaacgacattggatttgatgaagtgaagtcaacgttagccacagttgcaaaaataatagatcgagaccggtattctagaacaaagtggcttggctgtaagtctccagatcttttacggtgtagtatccatcattaacttctaaacagttaattaggaatagaaactaatattagcacgtgtagtttagtaattcctcaatcaccatccctcggctggcccaacatgtctgtctaactctagtgaaagaatgaacgcagcgagtttgcgggcgaggagcagcggggaggcaccctcaaggcctcaactccctcacgcaggcacgggtcatgggtgttgtgaatagaattgattgagcgagagagattgagtgagagagaattgcacataagaatatagagaatgaatgagcgatcatttattgataacaatggttacaatatataggggggagagaggcggcaacagaagacgcgataatttgggaaccatcgcgtccgttgttagaatcgccgtgaggcgagaagaggtgtggggcacgaccaaccatcgtgtcccagaatttattgctgctctatctatatagatggatgagatcacccaaatatttcagaacactctcccttgatcgaatccagctttgatcattactcatttagtgttccagatatctgtaaagataatcttagaaataattatagttaaatacatcacgtaaaactactcgaaaacccagtgggaaaaataaggagagaaccgtgatatatattatggactattttagatctatgagtaaagctcatagtttgatccaaaatagtataatgtctatagttatcatttagtaaaaacccagtggggaaaagccaaatgataagacatataagcttatattgatattacctcgttaaaaactttggatgagaaaacctaaagggtaaaactcatacaaaggaaaaagagtataatatgacgaaaataggttattttccagaggaagatactccccctgaatcctgcaaatttttaagtcgtctcataccaattccttcgacacatttaaagaatgtggagtatggtagagattttgtgaataaatcagcaagattatcacatgacttagtttgcaagatgtttatctctccatgttgctgaagctcatgaggataaaataatttatgagcaatatgcttagtgatgttgctcttaatataaccagtttccatctgaacaacacaagcggtattatcttcatagataatggtaggtgattccaatgaaccaataccacaagatgttaatacgtggttaaccattctgcgaagccatacacattcacgtgacgcctcatataatgcaattatttcagaataatttgtggaagtggctaccagagtctgtttagaagacttccatgaaatagcagttccaccctgtaaaaatacgaatcctgtttgtgatctggcgttgtggggatcagatagatagccagcatcagtatacccaattaaagtcgaatcctggttctttttaaagaaaagtccaagatctcttgtgccattaagatatcgaatgacattcttaactccagtccaatggcgtttggtaggagcagcgctgtatcttgctaatagatttaccgagaaagcaatatctggcctcgtactatttgcaaggtacataagtgcgccaatagcactaagatatggaaaatcaggaccaagtacatcctctccatcttcctttggtctaaatggatctttctccacgtctagagatcgaaccaccataggggttttggaaggatatgacttgtccatattaaatttctccaaaattttctgggtatatgcactttggtgcacaaggattccaaaaggtaaatgctcaagttgtagacctaagcaaaatttggtttgactcaaatccttcatttcaaattccgtctttaaatgatgatgtgcttcattaatatcttgtgtattgccaataatgttgagatcatcgacatataccgagataatacaaaatcctgtgggggactttttgataaagacgcacgggcaatcatcatttttagtatatccctttagtgaaaggaattcacttaatcggttgtaccacatcctgctcgattgttttaagccataaagtgacttctgcaacttaacacaatacatgttacaatttaccttctgattcgggatgtcgattccgccaggaaccttcatgtaaatatcagaatcaagtgacccataaagatatgctgtcactacgtccatcaactgcataaatagacgattttgtactgccaatgatattaaatatcagaaagttataccactcataactggagagtaagtttcgttgaaatcaacgccaggtttttgcgtaaaaccttgtgctacaggccttgctttatatctcaccacctcgttgttttcgttccgtttccggacgaaaacccatttgtatcccacaggaaagataccacgaggagtaggcattacagccgagaatacatctcttttgtaaagcgaggctaattctgcgtcaattgcgtccttccatttgttccagtcagagcgcttttggcactcttttatatacctaggttctggatcaacttggaggcactcagcaatttgttcagaaaaattagtgtcgacaattatagctcttctatcaaaagattctccagtttcagagtaattgatggcaatttcatcaacccttatagactcattgtgatctcccgaaacaatgtgtctatggtcttccgaattcctagtctcagcattgtgcaccaccgagctaggttgtagactatcacgatctgcttgacatatagtatcaatttggtgtgtaccaactaaaggttggtttgcatttaccgtctttctttgcttattagcaattgtttctcgctgagtggccatacttcttcctctctttttagtgagtggaagttgagtgcttttatttggtacctccactctttctggcgcattctgagcgggaatgaaagatttagtcacacctttataattggtaaatgcatctagcatgttatttgcaagtctttgcaaatgtataattttctgaacttgaagttcagtttcagtagtacgtgggtctgaggctggaataccctgggcatcccaatcaatttcctggcattctttttggtacttgaattctccccctaatgccgggaaatgttcctcatcaaagatagagtcagcgaaccgggcggtaaatagatcacctgttaagggttctaaatactttatgatcgacggagatttgaatcccacatagatccccactttcctgtgtgggcccatagcggtacgctgtggtggtgagatcggtatgtatacaacacattcgaacttacgcaaatgggaaatacttggaggatttccacgtactagctgcattggggaagtttcatgatatgcagttggtcgtagttggacaaggtcagcagcgtgcagaactgcatgaccctagcacaacgaaggtaatttgcaattcattaataatggtcgagcaataagcttaattcttttgatcaatgattcagccaaaccattttgtgtgtggacatatggaacagagtgctgaacctgaattcccaatgccatacaataatcatcgaaagcatgagatgtaaattcggcagctttgtccatacggattgattgaatcctatgttcagggtaatttgccttcagccttataatttgtgacatcaatttggaaaaggcatggtttcgtgtcgatagaagacacacatgagaccatctagtagatgcgtcaatcaaaaccataaagtacctgaacggtccatatcttggcacaatagggccacagatatctccttgaatgcgttcaaggaatttaagtggttcggctctgattttgagataagatggtcacaaaatcagtttcccagtagcacatgcagtgcatacgaaatcagaggatttgagaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaacccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattaggagtgtaataattgctctttctgagccaactatcacagtatcgcgcccagcgatagtcaaactttgccttctctctttttgagagtttgaaagtatttgatctccctaagtatagagtttatggtaccactgtccacaagacataattcctctccaatcggagcgatatccttagacatctataatgaaagaagaattgcatgattaagaattctttatccaatatatatacatagatacaataattaaaacatcaaatacatagtatgacgtttacatatgttaatagtacatactctaatgactaacaagccatacaaccttacaatacaagggagttcgtacttatttacttattacaaccaatattatttggcaaacttataggatatcaatatactgtttcaagcacactgagataagggcagcttcatctccaagtgggacgcatcgagatcattgcaaatctccaagtgggtccgttgagcagtattcgatgaacatatcatccatcgtagagagtggagcgacatcttctgggagaacattgaggttgctctctggttcagcaggagcctggtgagaacttgcaacctcagggtgctcttcatgtgtaatattgaagtgtgcttcaaatcttgggttctcagaagattttttgtccttgagggatttttggtacaagaggataagatgtttcgggatgcggcagtctttagcgacatgagtgtcagatccacacctgttgcaatgcttgttgccattgctacgaggttgtggtgccttacccttcccttttcctttctttcgacccttgaatttgcgcctgttgttgttgcgtttgcgctttccagtcagattcttatgattattcgaagaatttcccttgaatcctttcttattctcagcattattctgtacattgaagtgcacctcaggtagtggagcagagcccggtgggcgctgttgggcattctttaaagaaagctcatggtgtctttctgcctgagtcaatgtatgtataagcagagaatgtttccagaaattgttagcgcgatactgttgagtcagtatcctgtcctccggaagcatagttggatagagttttttctatcttttctgcctccgttggctcttgttcgcaaaacttcaacctggaacaaatgttatgaacagcatggttgtattctgccacagttttaaagtcatgtaggcgtaaatgaacccactcataattagcctcaggccaaatgagttccttttgcttatcataacgctcttttagagctttccaaatgttgagagggctcgtctctaacatgtattcatgtttgagatccttgtgaatgtagagtctcaaaagaaaaagggctgtattgagcttcctgggctcaattgccggatccccatcattgggttcctcaattgtctttagaatcccccgagaggcaaaattgattttgatatcagaaacccatatgggatagttagtcccatcgagggcgagttcgtcgaactcttttgtttccatgtccctacaatcatggttaacattatcaatttacagaggtaaattaataaaaacatgatattaaggttgtaatctcaatgcgaaatgtaaaacttcatattctgtaatgtttcgaaagatgtaggttatggacctgacaatttttagttagaattcgaaattaggtggcacaatgtggataatcttcaagtaattaaacagtggagtagatctcttaatagtgggcaaggtatacttgctgcctaaaatacggtctccaggcaaatatattatggtgaatataccgtagccaatgtttagaactccactaccttgtgttcaaccaaatttcaaataatctcatttctcaaaacatattcttggaaaagaacacatgtgggtaatcatcgtgagatgtagacctctgtgagatgggcgaggtgctcgctgcctaagttatgaccagtgcggccaatttctagggctccatcgggtaatcatctcaaaatatagaccactttatgatgggcgagatactcgctgcctaagttatggtcgatatgaccaaagtataggactccatcgacatgtgattaatttccaagttaaagtgtgaagtggaacatgcattaaatcctccattaattatgttggacataattaagagaatttgctaaatcaaaatacaaaatttatagagaaagtagagcgtgtcttgaaataatatgcaaaaggcatgttattaagacaacaaataaatttagtgaaacaaggtatttaaataaacacctatgttaataaacacataacatcagtggtctataggaccattacataattgtttgtacaactgatgaactgtttcgactaaattacataaaatatagggactaaagtgaaattgctgctgaaaataaaaaataaaaactaaatttaaggggtaaatgggtggtgggcc

SEQ ID NO: 75439 - DNA, 22624 bp, Oryza sativa
ggggccaaaataagtgaaactatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctcccaccatgtgcgtggacggccgccgcttctccctggtgggtgagagatccgccgtcgttcacaagggcgcggcgcactggctgtttattgatcgtgtatctagcgcaacccaagatgacatactgtacaaactcaccgcggcggtggacacctcagaaatctccttgacaaggctcccctttgtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtagcacggcattgtcattttgatatggtttgacctttactggtttccactgtaacatcccttcactggaaaaacaaattctcttgatcttacagttcacaactacgcaggtggcatttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatccatggcgcccaaggcggagaagaagccggccgcgaagaagcccgcggaggaggagcccgcggcagagaaggccgagaaggcccccgcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggttcaccccgacatcggcatctcctccaaggccatgtccatcatgaactccttcatcaacgacatcttcgagaagctcgccggggagtccgccaagctcgcccgctacaacaagaagcccaccatcacctcccgggagattcagacctccgtccgcctcgtcctccccggcgagctcgccaagcacgccgtctccgagggcacgaaggccgtcaccaagtttacttccgcttaggctgcatgccttcctctagtttgttagtagtagtagtagcagtagattgatctgtttatgtggtagtttaagtggaaatgatgattgcaaatgaagaattgtgcggggcttcttttggggaactcactgatctggaatagtaatgctttttatgtcatgtgaacatatctctggttgccaattgattttttgttttgtagaattgattacatcgttgatgtttgcatcgtcttgaaaatactctgcttgtgactggaatatgattttcggaacatctgtctgtactccctctcccaaaatttgaactggaaatttagctaggactccatttttggtactgctcaagtacccattggctcaatgtattttgtaggtttgatggaagggaagcttgatggccattttggttcatgatgttgcatttggaacataaaaactgtgtactattttgagctgataactttgaaatctgaaagtaagttttgcttcagcttcatttggtactgtttcaaatcgaaatatagaagttgaaatagtaactgaaacgccatatgtcttcgcttactgtttcaggagaatgctgttctctttactccttcctgttctgaatgtccgaatgggtgctttttctttgttactgattcgcttgtatgctagtaactgggaaacatgaggtatgcatctcatctctactgccacatcttctatcatgcttgctgttgtggtgcctgcagccctgcagtacataccatgcctgaaaaatgtgaccaaactcttgtgggttctacttgtaaattgtaatgttatcctttctattctctgtccagcatggttgtttgaggtgtactcaggttctactggaagattctcttgtagcagcatttttggcacgctcatataaaagcttcggtagctactgtggaatgtgatagaaataatgggtctgatgtttttgggaactctccttcatttctatttggttaactgtttgagcatttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatctaagcttaatataatgctataacaccttgtgtacctctgattatttcccaatgcaatcatcaactctacatgtggacctcacgtcctcacccaacatttagctcaagtactttactgttcatttcttaaccacctgagacagaagatattcatctctgattgcatgcatctttgacacagcatctgctaacaacattcgatctttggcttgttgctttgagcaggatatgccaagtctaaggacagaaaccaagcagtcttgaacaatacttcgtgttatgcttgcatctgttatatctttattttttgcttcttcatgtagccagattgttcgatcagctatatctaggactcggccaggaaatgctgctgatgcaaatttgtgcagatccaccgaatccttgaacatgtcatcagtagggctccttccggtaaatatctcaagcaataatatgcctaagctgtaaatatcacctagtctggagactgcagaaccttctccgtactctgcaatattttcaatttcagttaatatttaagtatacctctaaatgacataaatttccaattcggaatggcccaagttgatcccccacccattagggtggagggagactaggaagtgggaataaaggcagaatgcaatatttggaactacctggtggaatataaccaatggaacctctgattccaactatgctgtctgaatgttgcagtgctttaactatactttcagggaggattcttgatatgccgaaatctccaaccttagcgctcatgtcttctgcaagaagaatattacttggtttcaggtcgcaatggatgatcggtggctgacaatggttgtgaagataatccagtgcatccaagatatcaactgcaatgccgagtctctgcgaaaggctcagtgtgttgctagaagtgggattgcctgacacgggatgaagccaaccatctaagcttccattgggcatgtactcaaaaactaatgccttgaactcgtgaccctgtggattgatacttgagcaacaggtgatgatctttataagacaacgatgtcgtactcttctcaaagcctcacattcaacctcaaaactcttggcagatcctgattgtcgaaggttgaacacttttacagccacaattgcaccttcatcttctaaagtacatctatagacggaaccataacttcctttgccaagcaaattagcttctgaaaattcattacttcctctggctaatgcataatatgaaactctatgatagtgttcatcagtacctgggattgttgctcgactattttgtctccgtttaagcttcctgcagaactgaattagaacagtagctgaaactaacagcaagattgatcctgttattggcagggcgattttaagagacttatgccaccgtttgttgtttttgcttgcatcaataatgggacatggagccaagtgaagctgaggtattccaccacacaagttgtcgttccctgcaaccgatgcgtacgtaaggttcttgaaaactccctcatctggtacttctccttgcaaattattgaatgacacatctaatttccacaacattgtcaaattttgcagagttgctgggatgggtcctgaaaaattgttctgtgctagaaatagttgttgcagattgccaatcctaccaatggtatcggggatcctaccagataacttattcatggttaggttcaggatgttgagccctttcaggttggtcaaagattgaggtatgccgccttcaaatgagtttttatctagcagtagcgattccagcacctgacaatttcctatactgtcaggtatttgaccagacaactggtttcccgacagtatcaactggtttaggttagccaaggtagcaacttctattggaaggggtccagagagagaattgtatgacaagtccaagtaccaagagagtgaaggaagctccaagatttcctttgggattgacccattaagacggttggtcgataagtccagaacaaataacgtttttagcttcccaaggcttgcagggattggcccttccaaattggtgtagtatgcgtagagcctattcaaatttgtaagatttccaattgatgatggtatgaggcctgacaagctggtgttgtacagggcaacttcaaccaaatttgatagcttcccgatgctcgctggaatcactccagataaggaagtgaaccccagatccagcgtgtccaagccaatcaaattgccaatgtcctcaggtatgctcccagagatgctattattatctaagtagagcttatggagtgtggtcgacaagttgacaacagagtttggaagttgcccgctgaaagagttgtctgagataacaagctgttgcagctgactgcagttggttagtgaagtgataaattcccaacccttcctgttatttgcctcaagtcggttgccatacaagtataatcgccgaagagatttcaaccttcccacagtaggaggcacaaatccactgaatctattaccataaaggagcacaattgtgagtgatgaaagattgaagagagaagaaggtattactccactgaattggttatccgccaatccaaagtattgtatgccagggaacttgtcaccgatgttggcaggaatgcttccttgtagcatgttgtcatttgctgcaagcaccgtcagtgttgacaggttccacagagaggacggaaatatgccggagagactgttctgctgaaaactaaattcacgtagagctgcagctttgccgaggtccagcgggatcaggccctccaggttgttgttgtccatgtacagatactgaagcaatgacaggttcgctagcgatgccggaattggcccagtgaagctgttgttttgcagctgcagcttctggagttgtgtcaatgtgttgcccagctccaccgggatgcggccgccaagctggttaaaggcgaggcccagattcttcatgctgatgcaggaactcagattggcagggagctcaccggaaaacgagttgcctccaatgtccaggatctctagacgccggaggcggccaaggctcgggggaatttctccatacagctcgtttgagctcaagtttaggctctgcaagaagctgaggttcccgatgaccggagggagcccgccggcgagattgccggagggcagcgtcagcgccgccacccgcgccggcgtccgacggtcgcacgtgacgccctcccagctgcagaaactggtgctgctgttccaggaggcgagcgcacttgagctgctccccctgaacgctgccttgaaggcaagcaacgtggcctcatcgctgctgctgctgctgccaccaccagcgacggctgcaacgatcggcgtcaggatgaggacgagggataattcaagcctcaggctcatcatgatcgtcatgggacgtattgtgtttcttgattggtttgtgagagtggtagtgctatatcttagtaccaatggctgtccgtattatatggagagtatagatggtctttgaagcaaatttggagatgatgacagtttgttgattgcattcttttaattccttttttccatttctggaacacttcgtttgactttataatatagtactccctttgtttgtttgttctaaataccttccgttcaggatatgtatctggacaaccatatctagatgcatatcttacatccattatttatggacggaatagtacttgtcctgatacatcattcatactactaatattgctttggtcacttgtttttttttccctaaaaaattacaaatatttttaaaaaaatcatcattaccagtttaccacgagctgcttttgctcatcttagcattaacatttagttaataaaactactactgtcaaagctaaaacagtgctaaatcaagctaaaacagtgctaaatcaacaagaccgttctaaatcaacaaaggtcttggaccgaagtggcgaaagcaatggcgaaggagaccatgctttggaagtcggcttattaagggatccccgctgtttcgtctttacgaggtcgtggtagccaaatttagcacgagatattcctctagtttttcataatgtcctttatcggtccctgcttgttttccttttatccttataaataacttttatttctcttaatgaaaaaaatacgccccttgcgtattaaaaaaaatccacaatgaaaagtatttcgtgaacgagggaatatatacatttcgaacggtcaacgcggccaggtgcatgttgttagtattttcgttgagtcggagagaattgactttcagaacacggcgatttaggcggctaggcgatcgacggaaggcttgcatgatcaacgcactgttacataagcctacttgcagatggagatgggtttaggctagctgcctgcttgaagacgacgacgtcgttgtcgtctcactgggatgttgacgtgggcagattaccgaatacgtagcctaacaagtcgtggagtggctttcagagcaaagaaataggcccaattagcccataaacaaagacagcccgccaagaagcctgacaactaaattgggctggactgggctgtaggcgtacgccgaaggaaagctcaaactctaaaaattcgcccaccgacgcgcgccggaaaccgccttaactcctcccgttcccgctcacatttttcggcatcccaccaacccgtcgaccccggcatccaacgtcgtacatccctccacgtcatcgatccgcgccgcgtgctttccaccaatcaggttgcacatcccctcctctacaaaatcatctccccccgtctcctcctttccccacgccgcaatctcgcaaatcccaccgcttccctttcctctcctctccccgagaagaagagggcggcatccatggcgcccaaggcggagaagaagccggcggcgaagaagcccgcggaggaggagcccgcggcggagaaggccgagaaggccccggcggggaagaagcccaaggcggagaagcgcctccccgccggcaagggcgagaagggcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaatgatatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggccgttaccaagttcacttcctcctaggctgtacgcctgcatctagtcctagtagtaatagtagtttttatatgtttatgtggtatattgtttaagtgatatccaagattggaaatggatgttaaattgttggtttggtagtcattggctgtaagaagaatggctttgggttgcttttgggaaacacttgcttcacggatcgggcataagtaaccatgcttttataacatgcgaatgtgtgctttctcttgtgccatcattgataagaatttaccttgtgccagtgttggtgatgccttcgtttaatgttgtggaattacatggttgctagtattttgtctcgtaaatttcttttcatgtcattggaatttgatttctgcagcatgtacattggtgttaggtactgctcttttgcgtgtgcctcttttgcgtgtgcctcatgtattgtttagagattttagaagcacacactttgggacaataccaaattgtttttagcctgacaagaaatttagtttcgtgctgtctgcatttgaaacaaaaagtttgtacacattgtttggtgcactagtacatgatataatctgtcctccattgctgttttattctgagattagaacttcgacaagtaagtttttcttcagcttttgtcaggtactgattttcaaagaaatatagcgacaaggaaatggtaactgaaacatcacattacaattattgatttttaagattatgttgtgcccgcatgttttctcattccgttctgaatttctgagtgctgctagcttatgagctaactgttaggtatgcatcttataccaaagttttcagtcaggctattgctctattcaagatatgcattgccttaaggcatatgtgttaagattagaccaaactcttgttgattctacttattgtaataatgtgtcttgtcctttgattcactctccagttaggtgattctccctccagcgaagttggaggtgaataagttacatccaaggttctacgtggaatattgtcctgaatttcggttgggcttgttccataatacattcgctgtcaaataactctaatttttatgacagcataaggattaatatggatgtatcataatttttactcatggaataatttcagttgctattatgaatttgcagtggttggaataacatgcccatattttgagagcaaatcccttggttctatctggttattggtttgagcacttgttcttttcttttcagacaacatgaattattattgatttggtattcagtgttagatctatttagatgcaacctatgttgatgctatgtttatgtgggtgggaatcgtggaactttgttttcttatggttgcaagggtatccctatcaggtaggactgtaggagtagttggttatattttttttattatggatcatggatgcgtagaagtttctgttggaagttgctaccatggtttcgtgtgtaagaagccatatggtcagctcttcagtattatttgatcagcatgattacattgacattctgtatacgtctttgcaatgacatgcatctgagctttatttgataaatataaatcatgcagccttgtattccaacgattatttctagtacaattaattgacactacatacatgtcttatccaacatttagttcaatgccaaccatccaagacctgagatattcatctctgatggcatgaatctctgatacagcatctgctaagagcactcggtctctgggttgttgctttgagcaggatatgccaagcctaagaacagccactaaacactgttgaataattcttctttttgtgcttgcatttgtcacatctgtctcatttgcttcttcatgcagccagattgtctgatcagctgtctaaggctctatcaagaaaagaagctgcaataaacttgtgcaaatccattgaatccctgaaaatgtcatcatagggcttcttccggtgaacatctcgagcaacaatattcctaaactgtaagtatcacccgctctggttactgcagaaccctccccatattctacaagatatgcagtcaaaattagtttctaactgtaccattagcatgtaagatatacaaagtgcacaatccgaccccacccatgagggaggaggtgggaggacttgtgggaataaatacaaaaataaaacttttaactacctggtgcaatatagccaatggagcctctgattccaattgagctttttgaattttgaagagttttagttgtgctgtttgggaggatttttgatatacctaaatctccaacttttgcactcttgtcttctgcaagaagaatattacttggtttcaggtcacaatggacgattggtggctgacagtggttgtgaagataatccagtgcatccaagatatcaacagcaatgctgagtctctgcggaaggctgagtgtattgctagtgagattgcttgacttgggatgatttcagccatccaagctaccattgggcatgaactcaaacaccagtgccttgaactcttgaccctgttggtcaatactcgaacaacaagtgatgatctttatgagacaacgatggcgtactcttctcaaagcctcacattcagcctcaaagctccttgaagatcctgacatttgaaggttgaacattttcacagccgtggttacacttgcaccctcatcttctaaagcacatctattaacagaaccataatcttcctttgccaagcaggttagcctctgagaattcattacttcctcttgataatgcatggtacgaagctctgatattgttcatcaataattagggatgtcgctcggctattttgtcttcatttgagcttccggtggagtaaacaatagaagcacaacaactgaaactaataccaagactgctcccgttgttgttagagccagtgtaagagacttaggccaccgattctttttctttcttacatcaaggattgggcatggagccaagtgaagctgaggcattccgctgcacaacttgtcatccccagcaattgatgcataagtcaagttcctgaaaacaccccattgagcatgtttccgatgttagaaggaatggtgccattgaacatgtttatatccaccgtgagcatgatcagtgatgacagattatacagcgacaccgggagtttgccggagaggtagtttctgttgaagagaagataccttaaacctgcgatgctgccgatgcctggcgggatcatcccctccaggtggttgccgttgatggcaatgcctgaagcggcgacaggttggctagcgacgcaggaattgaccctatgaaggtgttgttcgccagcgcgagcgtgggagccgtgtcagcgtgttgccaagctcaccgggaatgcggtcgccgagctggttgtattggaggtacacggttgtcaatctgacgcaggtggtgaggttggtggggaactcgccggagaaggcgttgtggtccatgtcgagcacccggagtcgccggagccggctgacgctctgggggatctcgctgtggagatcgttggagctcaggttgagccgccggaggaaggtgaggtttccgatggctggtgagagcgtgccggcgagatcgctggacggcaggtccagcgccaccacggacgtcggcctccgccggtgactgcacgtgacgccctcccagctgcagaagctgttggcgctgctgttccatgaccatgaagcggcgctgccaacctgccggagctagccaccagcgcagccgccgctgcgtgtgatagagatcctaacctgcagaggtcatcaggctacggaggaccagagcggggggctggagatccaccccactgtgtgcaccgccatctcctcctattcttcattggtgatttctgcaggaccagcaccacaaccatcgtgtaatcaaatagcgcatccacccaaaccaaataaatcaaggtacaagcctgctctgattccagtgcatttgattaacactaacgtttctgtttgcaatgctgaaccaagcaacatctatgttagttgatcctatgtctgtgtgggagcctgagaactttggtgcctcatagctgcatcggtatctatatcagatagatggaaattttgctagtaaatatggttcatggttgcataggaatgtgttgaaatctgctagtaccatatatggtttcatgtgtttttctgaagtaaaaactacagcagttcaatattatttaacaaaccgattacattctctgtgtacatatcgagaaatttgatcaaattcctcgtatgtattttacaacggctaactgggtccttgttatggctttcaatagaagccgggtcttttgaccttctctaaaaaaaaaaatctgggaccttgtttacctccgattattccaggcaaaatgattgacactacatatgtatattatctagcatttagctctagtgctctattgctcgttgcccaaccacccgggacttgaaatattcatctctgatcgcatggatctttgacacggcatctgctaacaccattcgctctctgggttgttgctttgagcaggatatgccgagcccaaagagagacaccaaactctgttgaataattcctcttgtcatgcttgcatctgtagcatctgtataatttgtttcatgcagccagattgtttgatcagctatttccagggctctgtcaggaaaagcagcggtagcaaattcgtgcagattaagcgaatccttgaacatgtcatcagtagggcttgttcccgtaaacatctcaagcaatattatgcctaagctgtaaatgtcacctagtttggaggcagcagaaccttcaccgtactctgcaatatttgcaacacacacagttaaactttaagtgtaccttcaagacaaaaaaaaatacgaatacccctaattctacttctatctattagaagaggagggaaatgaaggaaataaggacagaattacaattttttttagctacctggagcaatatagccaatagaacctctgattccaattgagctttttgaatttagatgaattttagttatgcttttggggaggatttttgatatgccaaaatctccaaccttagcattcatgtcttctgcaaggagaatattgcttggcttcatatcacaatggatgattgatggctgacagtggttatggagataatccattgcttcaaagatatcaataacaatgttgagtctctgtgaaaagctgagtgtgttgctaggactgcatttgctcgatttgggatgaatccaaccatccaagctaccattaggcatgaactccaaaaccagtgccttgaactcctgaccctgtggatcaatactcgagcaacaagtgatgatctttatgaggcagcggtggcgtactcttctcaaagcctcacattcagcctcaaagctctttgaagatcctaattgttgaaggtcgaacacttttacggccactagtgcatcctcattgtctaaagtacatctataaacagaaccatatcttcctttgccgagcaggttggcttctgaaaaatcattacttcctcttgacaatgcataatatgaaaccctttgatactgttcctcaataaccagtgatgttgcttgtctgttttgtcttcgtttgagcttcctgttgtgtaacagaataagaacaataactgaaaccaacaccaacattgcacctgttgttggcagggctattgcaagagactttagatgctggttcttgttcttgcttacatcaagaatgggacatggaggcaagtgaagctggggtattccaccgcacaagttatcattccccacaaccgatgaaaaggtcaggtttctgaaaacacctttaactggtacttccccttgcaaattgttgaacgacacatctaattgcttcaatagtgtaaaattttgtagggctgctggtattggtcctgaaaaattgttatgtgctagacacaggtattgcagattgccaatgttactaatggcattggggatcctaccagataacttgttcacggttaggtttagtacgttgagccctttcagattggtcaaagattgaggcatgtctcctccgaatgagttattatctagcaagaggaattccaacacttcacaatttcctatactgtttggtatttggccagaaagctggtttcctgacagaattaactggtttaggttagctaaagtaccaacttctgatggaaggtgtccagagagggagttgtatgacaggtccaagatccaagctagagaaggcagctctagaatttccctgggaattgaaccgtttaggcgattgaatgacaaatccagattaaacagattttttagcctcccaatggttgctggaattggcccttccaaattggtgtggaatgcaagcagcctattcagtttggtaagatttccaatggttgacggtatgaggcctgacagaccagtgttgtatagggcaaggtcaaccaagtttgttagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccaccaaagaagttgtgagagagcatcaattcttgcagctggctgcagtttgctagagaagttacaaattccgaaccctttccgttatctgcctcaagctggtttgttccgatgtatagatacttaagagaatgcaacatccccaaggtgggaggcacaaatccagtgaagttgttatctgcgaggtacaaatctgtgagccttgaaagattggacagagaagatggtatggccccatgaaaacgattctcatgcaatccaaagaagcgcatggcaggaaacttgtcaccaatgttggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgccgggattgctcgccatgccgtgaagagggccgacgtccgtggttttcgtcaccgacgacgttcgtccacaagcctcttgctggaaaccagaactcctcaaccatttttgtcaagccattacagcgcctgatgtccaagtgccttttcgctgccgtcgctggttgttcgtgagcttcggaacagacattattcaccagcgagctgcattacctgaaaggtatggatctcagtgtttatcactcacacatcttacattcacatgcagtccctgttatgtatagatgatttgccattcctcttctttttatctactaaactgagcacatgatgaatcacctggaacctaaatttatagattttttgttgaaatgcagttgaatttagattgttttaggtatataacatgcccgttcgaatatctttaattgcatccagtgaataaaatttaggtaggtagtgaaacagcagcaatgtctcttttacgtggacatctcaattataatctttgtaaatatagatttaattaattttaaattgaagtatatgacccgaagagaatcatattgcttgttttaataatggtagtttttaatagcatgccgcggcttccaaagtgtgcgagcgtgagaagaaatgtgaagcgtcgttccattcatgatgatgatgactttgtcactccacctacaaggaagaaggctgttcgtgttaaattcgtggcaccggtttcgcgttgtgtaccatcttccatcacacctatcatacagagatttagtgctgaaaagaaagagctggtagctgagatgggttttgaggggctgctgcatatgcccctcataacaaaccatcgtgacttcagctactggcttttgtcacgggtatccccaacacgttcggctatcgaactagaaagtggtgaggttttgccactgtctcctgaggatgttaagaaggtgcttgggattccttgcgtaggggaggagctgcaagcacccaatgttgagtttgtttctcatgtcaagaggttaattgctgaaagaatgaaagttgctagttttaaggacgttaacaaggaggtattggaggatgtattagataaacaccatagagggcaaatgtcaaaggctgagaaagaaagtttcaaaacagcattcctaatgcttgttatgatgaaatttcttgcgccacaatcaaatatggacaataaatgtccaagatatttttctgcactacttgaccccaatgaaatagcaaagttcaattggtctgggtatgtgttgaacgagatattggacgcagcggcaactgttcaaaagaagcacgctgatg

SEQ ID NO: 75440 - DNA, 541 bp, Oryza sativa
tgttttaccaaactctagtaaatacataaaaaaatcgtcccaaaacttgataatattattaaattatcaaaattctgatattgttaaaatttaatcagatttattttggcgataaactgaacgggcccgttcatctcgatcgtgggtgggtacgtgatcgaatggactgaattgggtgtacgactagtcgatgtgcctgttcaaccgatcgtaccagtcaacggctcctgcagctagagctatagtagctcgatgtccctcttgttgctgtgcgatgctctgtagctttcagcttgtcactgcttcactggtgactagtcagcatgcatagctagtcaaactattctatatttaattgaatttatagagaaaacataatatttgtgatatatcaaataaacaccattacatacattatcaaatatttttcatagtttacttttcagatgtggtagacattaattatctcgttttctataaatatatagtacgtaaaacttaagagatacgatggtgttttacttgcgacaaactcagaatc

SEQ ID NO: 75441 - DNA, 794 bp, Oryza sativa
accaggagtaaagtttatggcgatctttttttccggttaatgttatcaaccgggactacaaatagatctttagtcccggttggtaacaccaaccggtactaaagattggaaagtacccctggagctttaaaaccgggactaaagatgtttttagtcttggtttttaatacaaccgggactattgtgaaatttagtcgaccgaccaaagatggtttctccaccagtgcatgtattatattaacactggtggagaaagggttattactaccggttcgtaacccccctatagtcccggttttcgaaccgggactacgaatccgggactaaagatcgctatctttagtcccgggtaaaaaaaccgggagtaaaaatctatttttagtcccggttggtaaagataaagcatctttagtcccggttggtgttaccaacctggactaaagaggctaatccggttgctctttccggttcctctttattattttcttttcttcattatttttaaatatattgatttcaccccattccatccccaaaatcccaaatcaatcatcctcaaattgcctccaaatccacaaatcgatcatctcaaatactcaaatacatcacaaaatcttaaaaaaaaattacatcacaacctctacaaaattcatcacatattcacatcacacacaaatcaaatacatcacataacaatctcagatccaatcaaatacattcacacaacaatctcagattctgcaaaaaaaaggaaaacgaaaaaacctaaggagaagacgcgcggcgaggcaccg

SEQ ID NO: 75442 - DNA, 37202 bp, Oryza sativa
  unsure (1)..(37202): unsure at all n locations
aaaggaagtagcaattatagatcgatcggcgatcgcacatagaaagagacttgagtgttggataatagtttggctatagtgtattgcagaatgtcaagaatcgatcgtttgtttgtgaaaatgtcaagaatctttcagtctttcacggggctgcacatatatagacaccagcatgctgccacacgtaaaaagcgactcgtgtctttgtatcttgtgctttacgactccgtgatgtacgtcgtcgtacgtatctagcaaaggtcaaatgttcacaaattactaatttgaaacatttcaaacaatttttgagaggttatgaaagcgctaacaaaaccactcaagacagatacgtggtgatagagcagtgggtggctgggtgcatatatacatatatattctactattatctataaaaaatatacatattctactatctcctttcggaaatattttgcctacatcaaacaaagaaaaataaaagagtacttatcaagatacaagtcctagtattcacaattaattacacacatatatgctctccatatagtattacatcaaggtgatatgatttttctaagaacatttctagtctatacataactaagatgtacgcagtcgaacatataaaatcatactaaaaaatgtgtataccaaatgagagtttctcgagcataacaagacaatcactaatatttcatcttctaatctcaagtcctcaatattctagtggagactggagagtacataaattcagtgactagtgagagtgagccaaaactcctttttgactcttggggcccctgcacgaatttttcaagctgtgcaaaacaatggagaaggaatcaatatcaatcaatcaaattataatccgcacggaacgatcactaaataaagaacattaatcaagccgctcaggcatgattgatggcctaaatttaaagacaaggggaaatgcagattaaaggcgaggaatgaatcatttcggcctgattatatattatgctgctgcatgcaactactagaacattgctgttcctagcttacattattacacaggtacaggatgtgacaagctttatttcgatttacagaatatccgcatacgtatacagtacacgtagcaaacaccgcacatttcttgttctttggaaattggctcgtgggttccactgtatgttgggctatttggttagtagaaataatatgatttttttattaaaacactatcaaaacctcttatttgcaggtactttttagggcaacatattgactccagggttaggctcaactacaaaggcacgatgatgatatcaagctaataaagtatgcatgtcgtaaacttgagtcgacgattacgcacctttacaccaacttcagatagagattctcagatagaatttagtaattgtgggttcttttatcttgtgttggtgtttactagtttgtgtttactttatgttatgttagtgtgtgctgagattgttcatgtgtggactttgtaataattgaatgtaactcgttgagcaaaggtcggaatgttattccattatcttaaaaaaaagaccgagtttttcaccttgccctagttctatataattccaagcatttttttccctaaatttgtaaagaatttgtatggagttaagatcctagacctagagcttgagtcctagctagtccgcttagaccagtggtatatttttgatcttactatatcttttgttagaatcttactataattactaacattaagattgaaagaaaaatagattcacgtatacatatagcatcccacttacgacaccatagcggtggcaactttgcaggcagtgccggattctcaacccctggccgaaacaaaaaaagttgcaagtaaagatcgtgctgagatgcattataccccaccaagtaatgtacacgtggacggccaggaaggcaagattcagatctcaccgcgggatgagattgagtggctcagaatggctctcgatcagtctctcagttacaccaagtggcagcatgcactcatcactgatcgcatcatcagctgcaggaaattaaatcgagcagctaatgtatagtggccggggcagtgggccagtgggacccacctgtcggcctcacgtgttcaagagcgaaaataaagtaaaatatgaccatttgatagccaccatgcatatatatatatatatatatttatatttaagagaaaaaaagggagaaaaggaggttctagcttaggttcttccacgttcaaaaattcattcccatgggtctggacggttgccatggaatgtcctgcctttcttcacctaacgaaccaacatatcgtcactgttttttccgaaatgattaatcatgatgctccccactaccaagcatgcatgtatcaagctcctattgacacgagtaaagctcaagcatagccttcaaattaattaaattgacctctaattaattaatttttgttcaaaccacacttacgtagttatagtgatggagccagcaacaaccgtaaagcctagtcaatgaagagctcctggtgattattggtttgtcggttgttctatacaatagttatttgggtagctcagcatgatgtatactgacgacactaatttattcgttaatggctagaacaaaacaattgtatgaaattgtgagtatatatatgcatttatataaagtgttcttcaagtacgaaaagttcgattggaatcttgttatggaggtcaggatacatggaatcacaatcaccttgatctgcaagtggagggtcactactccatgtctccacatcgaagggaccaatttggctatctaagtagggtatgctgccttgacaaagagtgcatgtgtgtgcctttcttcacagttcacagttaccatacattgtggtcttgtggatgagtttggaaccagatcaatgctagctcatacagctttctttaatttttatcttgcatctccatcaatgtttggaatgaagcttcctcctatctagcttaaagctgtcgcactacattgacacatgtcacatgcatggacactttagtagatatgttagaatgaaggcatgagctagcttgtgtgaatgtcaacttcaattctgtttgttactctcggtccattctaaattgtatttatttttagcatgcattaaatattacaatattagaatttaatattttaacataagcatttcttcacctatgttcttgtctcaaccgatcactattatgtctcattttatttctcacatactttaatttctcatgtcccatctcagatccaatcataactatttatcatctcgatcttaatttcttctaaaacttttataaatacttatattttaaaacgaggggattactatttgacgcagggctgcgaacaaattaaatcaaacaagcatggacaactagggcttgagcctcatgcctgactccatgatctccattaattgtaatcttgaacgataccgtgcaatttttgagaatatttaaacttccattagttaaaccctacgcgtgtagattttctagctctgccactatctctgaataatactactgttcatgtgttgaaaacatgaaatggatgggaataaagccgaaaatcctggcacaggaaagtctaaaaagctagctcgatcgatgcaaccagcagatgtgcctgcagccatccatggtggatctatcaatcatgtctattggccggctggcctggatggaattttctcggcgcgtgccggcctagcttcttcgtctaatggattaaagctaccatttggaagatgagataagaatttaactcccaaagattttgagagcaactttgttttgaggacagtgttgactcaaagtcaacgacacaataggatcagcgtatgtacagtaacggtctgtttggtttgaggaatcaaataaccatctaggatatgggtcacctattatgagatcatatctcaaatttagttgaacgttacatttgtcatattttttttacttggtactatatgcttttgatgagtgaagtcgatcgatgggcaaaccaattcccattacatgtatatatatagaccaaactacacatttaattagaatcaagtcatcagttgaccatctcagtacttaaaccaaacgccctaaaccacccaaagagtatatattttgcgtggttgctattgctgatcgatatatatttataatatattttgactgaattacagtttgggttattttttattgctaaagtttcacgttagactatccttgaacaaatcatttctactttgaattgggtaattaaatttacaattcactcatataacatagatggttagggacttatggtgtgcgtctagatatgaagagattgtctacattagactacattgaaaaattactgagatgaaataaaatatataatgtatctatgtgggttttagtccaaaagcctcaagccacctagatccgctcctgccgatggtaacattctctaacagtatgacaagcattaatcaaaataagtgtgtatttttaagttttttaagcaaacattaacaatctctatagatctctctattaattcaaagaaatagcttgcctctattatccttaactaggaagatagcccacgcattcacgcgggcatgtgtcgtatgctaagtttgagatatttataagagcgaaatattaaacggagcacatctaccacgatttcttcataaataataaacgtcggcattaattgattttataattttctaacctattagttttatattgtatcatatttaaataatatctcaaagcaattatttataatcttatttatcatttgaaattaagtagacttattttttagaaaacatgtcaactaaagtaaaaataaggtgtttttgaaattgcatatctattatcatagttcattaaaggattaattaggtggaacatgaagctccactaaatgtttgggtttatatagtttaatatgattgatgtagtttgagaggcgatcatatatgaacatttcatgtagggtgggtgagaggctccatgcagcctaatatgaatacgataacgacgaaatataattgcgcattaatattttaaaaatatcatgtaccatgaatatattcttatttttttattatgtaagatagatttaacgattataactaatagtttactggtttaaaaggcataggagtattgcagaaatgtagtttaaaaattatggttgttttaacatccaacgttattgcgaagtgagcgcacctcaactggttaggtttcttgtggtggaacttgcccacctggattcatgtcctagatttgacatgggtatcagtatttacgactaattattctttcagtaggtgacgtacccatcgacagcaagacgtcgtggtaacttcttcaatctcaaaatgtgccggctcattcttttagaggtactaaaggggtagggtgcgtgcagtttctgaaagatttccaatattattggttgtttctgttttagttttatagctaagagagagggaagggacgctaaaatcaatttgattttttcttaaaaatgtatggattagtgaacaatagctagtccgtagtccgtagaatatatataatccgaagtaatgaagttttttaataatatagttaacttggttctttaattttaaattttatagtaaataatctaatttatctctacttaggctacattcgatctcattggttgagcttatgtagggcacacaaaacgatataggtcattaacacatgattaattaagtattaaatattacaaacatgaaaatagtttttttattaaaaaaatgtatagaatgtatttgcacaacatgcacagtttagtagttgagagagcatgctcaagataaataagggagccaatctgataagcacattacaactcaaccttaaatttgttacttatgtacttaaaagcgtagattgagccattaacgactaaaattctgaccgtgtttagcgagaaaaacatgcgacatatttttagaaaatacattttttatttgtgttttcaacaatgtcctgagtaatattttaattactcattatttcatcttgaactatcaatacaggcttattgatgaaaataaattctatctatactcaacaataatagtgtgaaatgatacatttatttgttattttatattatattatagatctacttttggctgtgtatgtttgtgaaataatatatttttcttatactaccaccttcaccaaatatatgacgttggtcatcaatatataaaaaaaataaaaatacaaaggaggcataacagaaaatccagattaaagagcgttgtttctttcggtagtttcactaaatatttaacgttggccgtcataaaaaaatacagcggaagtgaaaatctaagtttaaaaaaagcgatatatttttttaaatttccagtagtacgtacgtatacagtatttttttgccgtatatagtttcttcttttctcagtgatggttgttaatttgtagagtaagtacgtatgccttctcaaccttttctggtcaattttttatggaaagtgttactcggtaaattaggagggatagattactatttataatagatctaatccaatggtgtaaactaatgggtccaccaacttaaatgaaaatcgagggctagatttttttctttcttctcagaatttttaagttttttctattttattatagcgtcatgtagcagcttgagagcgtttttagagcacaatgtggcagcatgagagcgtttgtaggaagtttaatggacttttagtatataatagatagaagatagatagatagatagatgtacatagacaatgtactccctccattttatattataagttattttaactttttttcttaagcaaaattatttaaatccgatcaagtctatagaaaaatatattaatattttcaatacaaaacaaacatattatcaaaatatatttaattttaaatttaataaaattaatttggtgttgcagatgttgctatttttttataaacctgatcaaatctaaagaattttgattaagaaaaaagtcaaataacttataatataatacagagggagtatgtctactgcgtagcctaccacacatgccctagttgcacaaaatatgatttttgcctatatatgacgatctatgtgccatcatatattctattactcaatcaatcaaagtagtgagcccatcaaagtatataaagtttatatattgggaatattattttcctattatgatacaagacaatgtggctctcacgtgtaaccgctatagtttctgcctctccgacaccctaaaagcttttacactatttatacctcgtaactaatgctcttggttccgccactgatagtgcatgcagtagtgattctactcagcttgaatgagaacatacatggcatctcgatatatctcatcaaccatatatatgtggtagcaatgcaaattggatcgaataaaccgatccatacctaactcgatctgttatttttgacgtgtgggccctgtcatcgtacacattccctgcacgtacacttcttcggccgtgtgcatcccgatcaatgtcgacgacgatcggaatcctgacgtcacatatatagcacctctgttttttaattgataacgttattgactttttgtcacatgttcgatcattcgtattattaaaaaaacattattctaatttatcttgttatgacttgtgagtagttttatcacttaaagtactttaagcgtgatttatatcttatacgtttgcataatttttttaatacgacgaatggttagacatatgtttaaaagttaacggtgtacatcatcatttaaaaaccgaagtatgtacctagaaaccttatcgttgacagtgaattagtgcgcgtatatcacatgagatcgattgccagaccgatcaatgcaaaggtaactaataccttttgacaccagaatattaatgtgatggatctggatcaatttcagggccagaaatcgcctgaaggagctagggagacagcagaatatatgatgaatcctgcagtgactggcctgcagagaacgtaactgaagaagtggatgcactggtccatgcatcgagatcgatcgatcagtgtcgacacaggcagctgctgcaatgcatgggccagatagatagcacttcgggtttgtcaatttggctcatcagacattcgatcgaacaggtcaaatttgcatccatatatggtaccctgtaggtatactggcccttggcaccgtctagaagccagggcatacatgcgtatcgcgatccatgtgtacatgtgtatcgcgatcattgtatatacttcattcgtcccaaaactgaaaactgttgattcctaagtttaaaatttgtcgtaatattaaataagttgatttatactcttttattctctttgtcctataaaaacttgatttctagtttcaaatttgcactagggcatattcgggggagttcagattcaagttacatagatgcagaattatctgggattcacacaagctgtttctcagaatctaaggccctatttgaagaagtactttctggccgccgtagcttcttacataatctccacttcctccaaatagtccagattctgagaatttgtagctatagaatcttaaaataaactaaaatccaactaaggcctagttttgttctcaactttttcttcaaacttccaacttttccatcacatcagaactttcctacacacataaactttcaacttttccgtcacatcgtttcaatttcaatcaatcttctaattttgacgtaaactaaacacactatgcttattataattttaagctctcccagacatgccaaactctcctacataggcaaaaaaaaaactttacttttaggagagttacattaattagtaatagtacaaatatttgattttgggataaagaaagaacgacgagtaattaacaggtggaaaaattaatttcggacttaggggagtatgcatactgctactgattaatctgatcccggccggtggcttactaaactatcggatcacatgcatcgcatcagccatcaggtgataacattcgtctccgcagcttaaaatgcacagaggtcgaggcgccgccctgcactcaccgaccgtcagatcgaccatcttagtacgcatgaatggaaagattacatgttaataaggttgatataaacaattcaccagttagctnnnnnnnnnnnnnnnnnnnnnnnnnncgtttagtaagcgggaggtcttgagttcgactctcaacgaaagcatttttttttctcttctatttttgttcattttgtccctcacagcacttgtcttcacgtgtcagatttcaccaactatcaaaatgtgcatggttgagtgtattccaaactcatcttcttttttttttttttggtttcattttgtccctcacaacagttagtcttttcacatcagatttcaccaattattcaaactctgcatggttgagtgtaatctcaaactcatttgtttccatgtcactgatgacacataatcgcacaacaaaattatgcatccgatgtgattaaaaaaaaattgagcccatccaccgtgcaaataaagatctaaccacttcaaattggacttgtccatgctgtgtccaaatggcaacaattactgcatgccactgaatttcccagagcatgaaatggttgcaatcagtaaaacgttagtggaattagatacccatgtcgcatcgaatcttaaagcagtctgaatgttggacaagtcctcaatctggcctgcagaacagatgcatgctcatgaatcatctcacatcaggatgacaggatcagttgcaatttgccagttcagctccaacaaaccgaggttggtgatccgggaaaaagtttaatgaaaagttgttaatgtccaatgctgcattttgaaggcagacagatgggaacatgtgtgagttggctctgtaattatttcaggtgttgtttgtagtaaactagtattgttcttgctttgctgctagctaatctctttttgaccatggtgcatattgatccatctggttttgaccatgtgcttatatatttcacctcagatcagctcaattagtggtgttgccttttgaatatagattgactaaccttgtagtcaaatattagtggaattggatcttgtcaatctgaaatgtgtggagatgaaagcgcgaaatcggtgtctgttcatacaatacaggctgcacatactttggtcagggctaaatgatcggttttagaatataaaggaagaacagcaactgttcttttcgcgatcggtttttttttttttttttgaaactgagttgactactgaggaagaacaatgaaacttgataattcctacttcctagttttccaaagaggtgggaaacctgttgaagatgacaaaaggtggtcacctaagaggtgatcatttttttcatggtttatctggtttcttgattagttactatacaatatcgtgtacatattctttccggtttcaagctcttcactttgatacattttgcaggtttaatttgttgctttttatcctttgacaattctgtatgagcttatgttctttgctattgcatttgcatgacttggattatgtctatgttaatgggcccaaattatgccatggaagtagcacaagtaccatgattctgaaggcccatcactgcaagtcactgggcctctgctatgaacatgctattcctgaatcttgtgaaccttcaacagttttgggtctcaaatgcacctctacagagatcaaatttttattttaaacacacaagagatcaaagtatgaaagtaacaattttaacagtgtaccgtttggagcatcttgaaacttaccaaaaaaaagtaaggtgttaattgatcaattccaagttgtcagaaacacacctgaacttgcatgtgcttcccatggtgccaggcttgtatgagctactgaaccgaattcaatcaagtttgggtggtccatcttagcatggattcaatgtattccagagcacactaattaacaccattggctctgcaagaattctctgatcatgaattctaacatgttgacttgcatttagttttcttcctgtgccattcccatttctgaaggttgagtacagacatgtttgctctgaattcactgcattcaagaagaatccaaagcttgagtctttggacaagtcattgagatttgttggttaagtcagtgcagggaagtacaaattaaaccattttcagcaaccaaacatcatttcattagagagaaacagtattgttcagatcatctactgtaactgagatgatgcttactatacatgtgtcactaaacattttcagagtcctactttgactatgcacgcagtaaacttcagtgcagaaacagctgaggtgagttgattactgcctccaaaaagcaccacagggtggtctgcagacaatagtacctgcagaaattcagatcttttctctatgtcttctagtttaacctgcatttctagtcatttctatccagttaaatgatgaaaccatgtaataattagggttggtcgatcgtgtgtatctgatgaatcgattgattccactaagatctgtctcttgttctctgaaacaatggcacgtcagtcttcactcttcagtctttcacccacaaattttatagatttttgtaaggcaaaaaagctttttttaaaaaataacccggctttaagactatagttggattgctattattgcagattaatgttggcccttctagatgaaaattctttgcccacaaattaaaattagattttactgaaaagtgaaagtaaaaaaaaaaacaatttctttgatttgtgttattagactgaagttacaggtatgcaaatgtcattgctgaaaacactggtaagatcagaacatacagttatacttatactacacaacatttgtgtgagccacctactagatgctagaagtaaaatagtttacctctcctctctctttttttttcttctgagcatgcagcaagtcatgcatgcaagaactgcacctaggagcttgtgagaaaaagcattcttcagtttctttcagaaaaacatgattcagagccgtaactgtaagcctgtaacaacgggttctatcctctcatcatccttctgagagcagaagagaagagaaagaagaaaacaacagtgtgacagtatgacaatatgggatcaagctgctacatgtaattaatctgtagtactatatatggtcccccattattcataaaaaaaatttctaatgtgcagcatccactgcacaaaaataaaaaaaaacacaaacttcagttctggaccaccaaaaagcctcctttttttccccacaaaacactgtggatggattacagaagcagtcagtccaaaacacattcaagaacaaacaaatcatttaaactgatctgaagtagtagttctgaatctaacaaatgtattgctggagcttggacagcacaaaagcatcagaaactagtagtagtgtcaagtttctaatgttgactgatcagaattaagtagattggtcagtgtgaccaacttatactcagcttgctctgaactttctgatgatagctgttgccaaacggcagtgcataagcaatcgaagatctgtgggtgcgtgtgcggtgagccatgatcttatcttgaaatcgatcttggcctggctggctgaatcaagaattgctccaaaagacatgaaaactgctaataatgtaattcgagtacttgcagtgatcatcgatgcatgcatgctcatctgtaaagtgtacatatggcagttggtgcaatggcttttcagtggtttaattcatggactcccttcaaggaggcagcctcctttgctctcaatcaatgtgaaaagaggatagtggaggataatactcttatgttttaactactccctccgtctcaaaatataataatttctaaaagttttagcagaaattaagagattaaggtgaaattaaatcatagattgttgtgattggttgatgcgaagaagtatgcagagaaattaaataggagatggtagtaattggtcgagatgagggagtaggtgaagaagttactatattttgtgataaattttgaatgatagaagtcgctatattttaagcggtgtagaaaggtagtgtgagatactgcaaattattagggtattagagaatatcacaaattaaagctaaatactattggaccttcatgtgcctctttaagaaccataaaattgctctttttaactatggtagaagtaaatagtgaccaagataggcttttttggagatcacaacattaggtttaggcttgttggttagatttcttgtcacctttgcagtaggagtgccatgttctcttcataggacgacaagaacatcaagttggaaaggactatgataattgtgaaattgcagatgctcaggaacccacttaagaagaggaccctcaagttggtgtgcatatatgtgtctgaatgattgagtgatggataagattagagcagttgtacggggctaaacacacatggtgttgcttccttgcgattgtgaccggggagatctgatgctgatgacatcatgaaaattttcccaatttgcatcccaaaattttccaaacgaatggttgccaaaaagaaaaaaaagaaaaactgaattcatcttgttctttagcactgatgttttactgaagaatttaccacaaactcaatattttttctgctaagaaataactagaatgtagatagttcaaggatgtgtttatggaccttatggtcagggaggcaaatgtcaaatgtgcaattagttagtagggtttaggtagagttgcagttggagcctcccaggcttctctgaagaaaacagcagagttgctggtccagcatgaaaagtcaatgacatgtggggcccactttggagtgagagaaggctggcatcagccaccatgctatcatggatcttacctcatgcacatctttccagctcacacattttgacctctttacagagatagtagtattgggcatctgaaagtactcctaagttttatcaagtcaagatgctgagtgtgctactctgatgaatcctctctcgctttcacttcactttaaagttttgctcccatactgctgacctgatcctgacctgcaactctgcaaccacaggttggtagttagttgttgttattgttaactgaacaaaatacacctgtttgatgttgtaaagtttcactctgaatcttgcccaaatccttttgcaaagccttcattatgctgatcattgctattggagatttggagtgatttgaattagtatagccagcctgcagtagtaaactgcattcgaaatatgatgaaccattaaaagatgagtaacatgcagtaatgtattcggtaaaagaagaaagaatggtgaatgagtatagtagcataatcttcagtaaattaagctaagcaagcaaagcttaaggacgaaagcattaatatcacccagggtacatttcaacagtcgaggagaagcatcttatacagtggagaaagggatgatatgcattaactggccaaatctgaatgagtggttcttgttcaccagatgtgaaagtacatttgttctttgccttcagacttgaggtttttgagtacaactcttgaatgcaacacctgctcacttcagcagtttacactctcaagtacagataacagaacaccttgataatcatgattccacagttaaaaggttatgctgtcacattggatggagatagcatttgacattttggggctcagattgaaagaaaaaaaaaagaagctaaaatggattcagataactaagctcttaacttcctacaaagtttcttgattgtagcaggaaactggaggttaagaagcttatatttacaacacaaatacctaagataccaaagatacatgccacacaagaaattcagtggcctacaatttccacaccctaaatgcgaaggcctacataccacacaccctaagcattccagattagaaacccaaacttcaccaaatcaaactgaactgtaacaatttagttcagcatttcttcatatgctgatgagatcaggtggcggtgaagatggtgagtttagctgctgctgctgctgctctttggcttcattggcctctgcagattcagctggcactacaagatcaaacacagcaccttcaccactaggaggctcctctccttgcttcgatgtcggcttgggaagctcactgaggatctgcaccacctccctcattgtcggtcgctgcacgctctgctcctcgacgcaaagcaatgcgacgtagaagacgtgcatgacctcgtggaccggcacagttgagagcctagggtccaagatcttgatcacatgttccttgttcgagtccgtcatcgtcttgacccactgaacgatgtcgacgccatccccaaactcccctaccggcttctttccggtgatcagctcaaggagcacaacaccgaagctgtagacatcgctcttctcatcgaccttgagcgtatatgcatactctgtaaatccacaatcacaacacagtgcatgattagccaacttgaagacatcaattctcttctagaatagcaagacaattcttaacaagttaaaacaagactacaacagaaacacaatagtggtatatcaaaatcaagcgaatttaaaccatatacgaaggcagcacaaatgaaccaaagatcaatcttttacctggagcaatataaccataagagccagcaattgcagacatgcactctgatgtgccagagtcctgcaagaacttggcaagcccgaagtcagcaacatgcgcttcgaaatcggagtcaaggagaatgttgttcgacttgacatcgcggtgcaatatcggcggtgagcaatcatggtgcaggtagcagagccccttggcagcctcaacagcaaccttgtaccttgtgtcccaatgcaggtggccacccttcttgccatggagtagctccccaaggctgccattgggcatatactcgtaaacgagtaggttcgtctcattgttcgagcagaagccgagcaacctcacaatgtagcggtgccggatcctcccgagcgtctgaatctctgcggagaacccgtgatcatgggaggaaccacggctcatggcgggaagccgcttcaccgcgacatgttcaccatccggcattgtccccttgtacacagtcccagctccacctttgccaatgatgttctcctccttgagactatcaagcacatcgtcgcaggtgaattcgaggcgctggaatgcggtgagcttccaagcacgcgcctcactcgccttcttcagtgatcgggccttcaagatcgccatggcagcaaatgcaattgaaagggcaagcaatcctagcacaatcagcagcttgaagctattggagagtccaccatggctgcggccgccatggtcagtgccgggagcaccgggatggcatggcccgaggtacggcccgcacaatcccgggttgccgacgaaggatgtggcattgaagtagctgaattgccctgtggccggcacgagcccggacaggttgttgtacgagaaatccacggcggtgaggctttgcattgcggcaatggtggccggaatctcgccgtcgagctggttccttgacaggttcagatagttcagtatccgcatcccagagatggccggcggtatctcaccggagaggttgttcctactgaggtcaaggtaggtgagcagccggcatttcccaatctccggcggcacgccgccgtcgaacgaattgccactgaggtcagccttggacagctgctgcagccggccaatctccggcgggatttcgccggtgaacgcgttctgatcaaggagcaatttctgaacaccggagaagctcccgatgaacgccggcaatgctccggtgagctggttgttggagaggctaatctggccaagattcggcgcgccggtgccggacaccgccgggaagccgccggagatgagattatcctggagctccacctgagtcaggttcgggagctcgaagagaccctcggggatggagccattgaggtagttgtcgccgaggcggacgcgggtgagcgacgtgcacttgccgagggaggcggggatggcgccgaagagcgagttgccgagcgcgatgagcgtctccagcttgccgccggcgcagaggtccggcggcagcgtgccggtgaggcggttcgacgagaggtcgagcagctggaacctcccgttgcggcccagccggcgagggatcccgccggtgaagttgttctcccatagctgcagcacctcgaggctgggcaggtcgccgacgaactccgggatgtcgcctcgcagcttgttccggaacaggttgagcagggtgaggttcttgaggtcggcgaacgtcgccgggatctcgccggcgagcgcgttgttggacaggtcgagcgagctgaggctcgcgagcttgccgagctcgcgcgggatgccgccggcgaggccgttcacctgcaggaacagcgtgtccaggttcgcgaggttgcccaactccggtgggatctcgccggagaggccgcagttggcggcgtcgaggcggacgaggtcggtcatgttgccgagctcgggtggtatcccaccggagtagctgttgaagtagccgatgtagagctccctgaggctcgtcaggttgcctagctccggtggtatcttcccggagagctcgttgccggagacggcgaggtactggagcctcccccaccggccgtactcgggcgggatcccgccggagaaaaagttgccgccgaggtggaggtggcggagctgcgccatggacaccacctcgagcgggagcgcgccggtgaggttgttgttgtagaggtcgagcacccggagcgcgcggagccgcgacagctgcggcgggaaggtgccattgaggccgttgttggagaggttgaggtgggtgaggaacggcgcgaggcgggacagcgccgccggaatgggccccgacagcgcgttcgcggcgaggtcgaggcgcgccaggtgctgcagccccgacagcgcggcgccgggcaagccgccggtgaggttgcgcccggacacgtcgagccccaccaccgcaccccgcgcgttgcacgccacgcccgaccacgcgcacgggctcgaggtggtgttcgtcgtccacgacgcgagcgcgcccgtcgggtcgtcgagcgccgccttcaccgcgaggagcgcgtcggcttcgccaccggccgccgccgtcgccgccgccgccacggcggcgaggaggacgacggcgaggtggtggtagtggaggcgcattgcgcggcgcggcgtggcgtggcgcggcgagtggagacaagagagtgtgaggagagtgaggaggcaaaggtgagagctttttggcaatggagtcgtctcctctcctctcctgctggctgctactgctataaaaaaaacacatgtgattattttattttatttttatttttatttttgctaggaaaaagaaacatgtgatgttttgttggattttatgcttgaatttttactctctttatttatggacgttttttcctcttttcttgcataaagtttgtgttcttgttttttctttttggtttttggctggggatggatggtgtgttgctgttgtgaatttgtactggtgtctggtgtctttgagtgtgaaattgggtgttgttaactttttaggatgggacagacaagtgtagatttgtagttcaagtgttatttatcaaaagttgcttttctgaggtgacactttttttttcctttttgttgcttggctaaatatttggctgccaagtttcaaaaaggctaggtagcatttgtcaatagtaaccttgatttaaggtggtgtttggattcagggacttaactttagtctctatatttagacactaatttagagtattaaatataaactacttacaaaactaattacataaatgaaagctaattcgcgagacaaactttttaaacctaattaatctataattagagaatgtttactgtagcatcatataggctaatcatggattaattaggctcaatagattcgtctcgcgaattagtccaagattatggatgtgttttattaatagtctacgtttaatatttataattagtttccaaacatccgatgtgatagggacttaaaaagttttagtcccatctaaacagggtcttagcttgattgtgatcaatctaaggtatattattttttataggaaccttgcaacaattattgcaggattatgttggagctagtactatatttgtgtttaaggtctttgtttttaaattgaggttgttatgactttgtggccattttagacatgccgttttggcctacaatttcccctgacaaatgtaaattatcatttttctgaagggctggaaaaacaaactcatataccatgatctcatccctgaaatataccatgaacaaaacacatcactttctaaactaacaagacatcattccataatcatccttagaagtttagaacatgcacttaaaagagacaactgcatatttagtggtacatgcaagagccattttcaggggcagatatccaattaaaccctgtcaaattcatacaacgtccgggtcaggtaagacctcacatccaataccagttatcatcggcaaattcaacataactaatttttggagtggtatatgacacgcccaaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaagcagctcaactggggtataagccaaacgccttctccttctggatcctttttctttaactgaggttgattgattattgcaaggtgagcatatgacatactcagcaagccacacagcaaatatgcaaatgcacaaggataccaaaggatggcataatatagtctcatttgcgaaagcaacatttagcaaagagttaagagtagtaaaacaatagagtaattaatcagaaattttaatcaacactgaacagcacacccatgctgcacaggcccaaccatcctgaacaaccatacccggctgtacagatctaatctccaaaccaggagctaagcaaattattaccaggtataacatctataattattgtgagaagtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaatccaccgcagcgcaccattcctgaatcataatcaccccctcaaaaaccagaggcatggactccccagccacttctcagtctggtgccccacaatgaaccatgctatacaaaaggtaaagccgttgcccacactggcttgtggttggcacggttaatgtttcacaatagtagctcgcgaaccggtccttaatcgtcatgagcacgactttcaaaaccatgtgctcacaacccacctttaccatattttagttggcaagtaattatttaaccaatcacgattgaccatcgtgaactatcattaatccatcattaaataatagtgaataataagttatcccaatagtgtgctaatgtttctaagcatggctaagcaatcatatctaatatctagctgaaccaatatatatagctcaactagttaagttataataacccaagatatcaaggaataaagtaatcaatacaaacaggccataacaaaggaatagattcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacgaagaaaaagactaataaaaaccaaataaacaatacataaaaagtaaacaaacaggtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacctttatatggattttaattgaattatgacgcaataatgaattatttttgaaaaggaaaaggaggattattgcgtcagcgactagggtttgcggtggaccgggtgcacggcagcggttcacgggaatggacggccgagatcgatcctatccaaaacggacagccgagatcaaacggtccacgaccggctcacggggaacggcaacgagacgtcagcgatgacgtcagcactggcggcggctcggcaacgcaagctcaccggcgaacgacggctcgacgacgcgaacggaaggcaccaacgggtagagggcgacgcggcgaactcaccggtgaccaaaaccacggcggaagagcaacggacggcggcggcgacgaggaagaagcggcggcggtcttcgggtcgacggtgacgacggtgctccgacggtcttcaacgacggcgaaggggcggacgaggacggcgacgacttggcgatcccgacggtggccttcccgagtgatgacgacgaccgaaacgacggcggcgcacggctgaagcggcggcgacgacggcgacgctaggctgcacgaggctagggcgctacagacgacagcgagcaaaggcgagggtggcggcgggtagcggcggacttggggatccttttataggtgcaaggaggcggcggcgaaggcccacggcgaccggcgacgagaaggaaacttcgggttcgggagagagagaggaatccgattcgatctcgaatccacgaacttccaaagcgagatagacgatgattccaaaagagaaaaggtagaggagatcccgaggatcatttcccctctatcattcggccggagaaggaaaggatcgaccgaatttggaaagcgacgacggcggcggcgctagggtttcgggcggcggccgacgcgaggaggacgacggatccgacaggtgggacccacctgtcagcgacggcgagggcgcgcgcgcggctgcggactgggccggctgggccgggggagagagagagaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagattttctcttctaggcttttaaaataaattctaataattccaattaaacaaaaatttatatatttgggatttttagggtgtgacagtatatcatttatgtttgttcatcaggttcaggtttagccattgtttccaagccgaatccaatgtgatccattaattctgatcatgttggtagctgctagctatgatgcaaatttggcattttgacagctctgtcggctaacttcatacagattcatgtatacatcttgttcattaaagtttttatttctctaccaacatctttgactcggcagaaatgcaacattgcattgtacgtataccagctaggtagattccttgtattcctccgaagaacagtgctgtatagtagtgcatcattgtacattaaaactccataagggcgatgtttggatgcagcataggaaaaatataagactagggagagagggagagagagagagggagggagggagggagggggacatgtttgagatagctgaaattgatggataatttatttttttaataactatttgagggtactcataaataagtgacttaactactacaaagttggaaaagttactttagaaaagtatttcaagaaaatttcatataatttttgtacacgaaatacattgtttaggagcttaggaagtgagcaaatgaaaatccaaaatccatgtaaacgaagaagattaattttctccaaaaatttctttgaattaattaaaccattttggagcatatatatgacacatttgtgtgttctaagacctctaaatagaatctctcaacctatttcctttatttcaaagagccatatataatcttcaagttttggcttttccttggaacactggaatttcacagcaattttaagagaactttgtgttcctacaatcactctaaaataacaaattagataatcactcgttctatctagtacctaacatgcaatgcatgatacaagtgagacgaagttcccacttgatatcgaacaaattctcacaagttagtcacaaaaagaacacgaacgtgtgcttggaagcatgaaggtcatcattgtaagtaactttgtttagtttaatgttcttactcgtaacaaagcatacactttctgttttataggttccttacttgagagcatgcacgcttctttttttttcttttcttacagaaaaagagcatgcatgcaagcttgatgactcacaaatgtatcatctttttctgctgaagcttcgacgattgttagctattggacactagcagctgcgctctgcctcattgtatgttgtgtttgaactgttagaataggtgtcgaatatactagtcttatttggttacagttagacttggagttataatatgtgttaggggatggagttagagtcggactctgtaactcagaaactctcttaaatagagaggggggcaccacaatgtaacgatggcatctacaatgtagcgtagacacgcaaggagatgatggcggcgaggccatggactcgtagcggctaggtgctatattggttggggaggagcgcccataatcaaagcctcggggatgtaggcttcggctgaacctcattaacaaatatcgtgtgttcctgtgttgtcatctagcgtatcttagatgatcaataattaaagcgatctagaaggttagtcatcgttccgctatatcgactaacttttataacatgaactaacatcaatttatcccttcaggtctcaactattacatttgtcaaaattcaccccaatttaaaaacgggtactagacacatcttaactcttaaaattgttcaaataacccctcaattcaaactaagctggtttttatctgttggtgctagcatgacggtacaatcgagagacccaggcccagggcactctaggccatggctcggggcctacggctaagaacccatgaaccaacattgattttcgcttgttaagctaagttcctagaaaattaccacaagctgacccgagatttgctattaggccatgtccgcccttaagtacaatcagacacaaaaataaaagaaatttatagacccacctgttagtgagcccttcatctcctccttttccatttgatatgcttcttccttctccctcattgtcccttctatgttgttgagatctccaatgtgtctctcctccaaggtactacctccgttccataataagttcatttttagctcaatcaatttatctcaaaataaattcgtttttagagtaatcattgcatctgggtttgtgaaaatagagaatatttgtattctgagtagacaaagtgatgaatagttgtattaggatttgttaaagtaaacgtattctagtcttttttattttgtattggtatatatgtaagaaagatgaaaaataaacttattttgaaacagagggagtttgtccaaggcgaactcagcttgccgagatcggcgaccacgaacgaagatccaagttcctccaatggattgttaaatatgtgatctgaattttggacccacagtatatccggattagttatctaataggactctagtttataggattagtttcctattatgactcctagatttctcctatatatatccttgtaagccttacggggagggtgcgatagcccaatgtatctcttgcgtttgtatccaattcctctatagtgatcattaccggccggcgtgtcggagcccaaaactaataacttggatccaactgagattaatgtatcaatccctggatcagtaaaaattgatacatacaatataactggttcttcattgcatacgttaaagtcttacaatactaagggttttacaataataggtactcacctatttaattagtacacagcggaagtttctatacattctgactagtgaggtataacctttagggattttctaagttatcggggtcttcgtagtaataatcataagggtcctcctcttgacccagatctgaaaaaggggttattagagcaaggatgagtattcacaatactcagcaagttatcacggaattatgttatgcattgacatataatagggttctttgcaaaaagcagtattggacaatctggaaaacattatagtagaatttataaaacataaaaactttagatttctaactagggtaccatatgagtcccggtactcaactccatgagtacggctattcgaatagttttgtagatattctactgcagcagatgtacgctttacccgcagtccacgacttgctgataattatcggctttagtcatggcccagcattaagtcattaacaattattgcacctgttccatgaacttatatcctcatatgctctgaacgtaatgttaacagcaacaagaggagttctggcattcccgaggtatttaaggggaactgatcgtatgacaccacgtcatcttgatcagggtttagaaatataccatatagtttatactcgagtatcacaaaccatttacctgtacatggtaatggttaaagttgcctttcgcggctatagttgcctcctgcgcgaggacttaaaaataagaaccactatacataggtgccatattgccaattaacctaataactaggtctgtccccattctagaaactgcggtcgtacccgttcgtttgacataagtacctggtaaaacttatatcgattgagacaatactagccacccggaaatcatccaaatcttacgtattgtcccaatctaagtatagggtattttaaccagattgtaagcaaaataagcaatactaaattatctgggtttctatgattaatttatgcatagaaaatagaatattgaatagaaggctataaataaataatttgtaaaatataggcttaaatgatcaataggtatatggtaacttgccttgctcgatgtcctgagattgattgatattatctagagtgtcaaaggaatccttaagacctagggttagacatataaaattcaaattcaaaaaggagtttaaataaaatctaaaaaaataagaaaaatagagaaaataaaataaaatgcaaaaatagcaaaaaggggcccaaaagatagagaatgattttaggagaatattggtccaagtttcactgaaattggatttatattttaaaagatatgggcttctaaagtttgaaaatcgaataaaagtgaaatggcactgtgtgcggtcccacctgtcagtctctctctctctctcttctcttcttcaacctccggccgttcccccaaaagcggccggcggcgctagggtttgggattgcggcggcgttagagggagaaagtggttgcgaccgaggaggggagggagctagggatctccggcgatggcgagtggcggcggaggagttaatttgaggtgtggacggcttagcggctagggccgcggtggcacggttaggccgagatggcgatcaaggtgataagagttagacatggctaggggaggggttctagagcatctacgaggtgtctagagggatttcgacagcttgccaacctttagcaaggcgcggagcatagttgccgacgagcgcctccctaggcggcggccgtgctcacgtcggcagctcagagggtggcaagatagtgcaaaccaattgcaaaaatggactctaggtggtatgtagatggttaaaacggaaaaacttaccgagatcggttgaaacgacgaattgcggccggaaaaacttcgcggcggcgaagaacagagcagtgcgggggtggcggtgctcggcttggtgcggcgaggtaaaacttgacgcagtgctttggttagggcttattatgctagaacatggtaggatataggtgttctaagggttatttaggggggaggatggatagagaggggtggagtcgatcgcgcacaaggtgttcgaccgacggggatggtggttgatgaaatggattggtgaggcagagctttggggttgtggggtgatggttgttgatgatcgatgatggacaaggaagggattggggtcctatttatagggctagaaggagcggatgagctcggacaccgtcatcgccatggatgagctcgaccttaggatagggctggggtggcaggggctgtgagagggcggccaagatcaattttagtggtgagaagctacgttcgaatacttaccggcgaaggattgacttgaccgcggttggaattagctggcgacgtgagggcgccaatccgggcgcgacgcgcggcggcggcgtaggtgaaaacggccggctcgggggtgaatggtttgaattgtgagaggggaaacccctgtctattctcaattcaaccgtgcggcaagatttggcgcgattcaccccaggtagaatcaaaatcgcactcggcagcggcttggacgggagcgcacggcgtcaagcggcaaattctcgcggcggtcgttgtcccagctttgtcgtagtcacgattggtgcggtggcggtgggctgagggcgtcggacgggcgacggcgcgccaagacagtaaggcacgcgcaagcggccccgaggccgacgtgcggcgaaacggcgcgcggctaagtcggatgcccgggcggcgcgcgtgaaggggaggagaaggccaactaaaccacggtttttgagtgggttgtggtcccctaggatcaaatctaaactttgcacaagattgggtagttgttaggctgctctagctgggatgggcatttcatcgagcaccttatgtgcgatgaacagtgaatttcagaatttttgaatatttccctagaaaagatttaaatttaaactatcaatttgcaatttggataggtttcactagggtttggagtaaagtaaatcctcactaatattagggtaagctaaggaaataatctatagtttgaaatttgagagaatttgctcaaattcactaaggtttggaataaagggaataattagagtaagttagtagggttctaaagaagtaatacttgaaccaaattaagaatcaaatagatttttaaaacacactaatttaatcaaaagccagcatgatgcagtcaaattttagtttaaaatttaaggatgttacacggcgtccgtggttttttcccgcaagggttttccacgtaaaaatttatgtcttcgttgtgcatctatttcataacaagtggtatcaaagcattggagatcgatctaataccatctcggctgccgacgagttcgtctgcttggagatcctatctgcaagttttagccgccggtacgctcgtcgcaagatttgatcggcagtagcaggcgcgtgtcgtcgcgttgttccatctatcgctgccgtcagattgatttgtttgccgagataagattaaccggtacgaagcggagtcacccgtcgactccgatcgggatttggtgccgccgtgcagcgtgttggagaaaaagcagcaatccatctactccagcacgttgatcaaggaaagaaaaatcagcagatgcactcagccttgttactgttcatgtgaattgaatttcacgttggttttgtgcgcgtgcacatgccccttcgtaccagggattcaattcaattgcggtgcttcggttctgtttgggtgaatcaaattcaggttcaattttgtgctatgttcacaagccatgtttaccaggaagttgtatacggagatcaacttcgttatatgcacccagagtgtttcgcgtttctgctagggtttgtcaaattgtaccagcagattcaggattttattcccaaggtgagtttgaagtttgatctactgcttctggattgagatgcaatattctcattatgatgagcgaagtttcattatggcaagtgaagttttgcagcggggtatttacctaggaggagaagtatgctaaaaaaaaaagagaagcacattcaagtcatcgagagggagtctcgctcctgtctagatcacaaggtgatcaaattgtccggcgaattttgctaccattgtacccaacatacaaggaggttatcaggggatctaagtacttcattttgtgcacaagaatttttcgcgtttctgtttggattccagaaattaatgccagcagattcaggattttattcccatggcgagtttgaagtttgtgcatcagtttcgcgtctctgctaggttcagacaagttaatactagcagattcaggatttgttcccaatggcgagtttgaagtatggtctacctcttctggatcaagggtgttatggattatagtccaagtgactatttggcgcatattgatcttatcatcacgaggttttttttagagattgaagttttttatgctacaagggaaattcgtctcaaggtggagattgttaaatatgttatccgaattttaggcccacagtatatccggattagttatctaataggactctactttataggattagtttcctattaggactcctagatttctcctatatatatccttgtaagccttacggggagggtgcgatagcccaatgtatcccctgcgtttgtatctaattcctctatagtgatcattgccggccggcgtccgtagttttttttcgcaagggttttccacgtaaaaatttgtgtctccgttgtgcatctatttcataacatggattgcttcacaagcccgccatcctcttcaagctcctccagaactatgtgtcacctctcctagctctagcttcaccttccttgacaagttttgcctcttacgcctcaatatcgatcccacgccgtctgccacagtggatgaacttggtcacctttccataccttagttcttggcctctagtgtaattgcccactatgacgaagttaaaatcgatggtgatttcttaaacttctcttcatttttaagttgacggtgatttttagaaaaatgtggtagttgaaggtggtgataaaacggctcttatcccaattttagatacacggactgtaccatgacctgtaaaagaaaacggaggtaacattataaataggtaaacatgttgtgtgcaaattaaaaagctaggcattccatgcaatttgtcaagattcgagattgcccgtgcaacggtgcaagccagcaatcgcgatgagacatggcatgtgagacaaaaatatttggacacgagtttttgtggctatatatgcgcgactaattataatcaggtcgtcttccctgtagatcagggctcggtctagtgagcaaatcgatcactgtaaacaaatgtcactaatatgttagtgaagtggagtatatgatgcagtccccgttgatgctagtagagcaacagactataaaccagctataaatatattttaagaagataaaaaaaaagataaaagtagcgggctacatacttatagccagctgcagcacggactttaaaacgtatgtgtgtatgatatgtgggaccagatattgattgtgtagtatatttatatataactattgtgtaaattgattattaagttaactatagatgacatctataaagttagaaattggctattctattaaacttgctcgtactagtagctatgcctaaaactttgggttatgtagtgatcgatttaattgatagagttgcactacctcgagccagccgtatcttgtcccctcttccaacaaccacatgaactcagatcaaatactagagccctagttgtagttaactagtggagtatactgtactagtactactattagcaggttttttcgttgatgaacactacacgatctgatcattgatttagtataggcttaattagtgtttagacactcaagtactacaatactcctacattggaagctgatcgaacaaacaaatcttgtacacatgtccactggaatattgttactatgatcataattaagcaggttcatgatattaaagactcgagatttaattagaagactaattaagtacacaacgacactgtctgctaacagtttggtttaatttgcaataattcgtgaccggcctattacgatgaccatgatgtctcaacgccagtcgcagcagcagtacagtacactactggtggcgacataatatgtcagcatctgtgatcttgttcatctcatctcatcacttgcagggatcagtgccccctacaccattcatcatgtactcccataattaattaattgagacctatttaagctaatggtattattaattatatatttgattagtacattggagtacgtagaattctactgttgcaaaccacgccgatgcgtgctatcgataggagtaaaatactgtccgcgaagtctgaaacttgcacagtctttgacgcatgcttgcaggtcttcagaaaccacaagttcagaagaacccatcatccggccggccattattttaatctgccaatattccgtacgctgtcaaaagaagaagaaagaacagtcgaacaatgttgtacagctcgatccgcagaatcgatcagagtttagtacttactactataattgtttagcatgtagaattgattagaagtaagcactaaaagttcagaggaagtcaaggaagttcagaggaatcaattaacttgcagattaattcaacaaagctaccagctgatatatgctcctaatgatgatgattgccatgatcataaactttagattcttccatgctccatggtgaagtcttaagctagtttggctgtttatattagggcctacacataggtcctgattggatccggagggctatttaatagttcggaggatccaaacaaggccatagttaaagttcagaaaaatgattgtccttttatctgaagaagtatgtactactactgttgcatgcaatgaacacgtacatgagagagtagatggatctgatcgatactgctactgatcatccagccttgcaaattatccaaggacaggacagggagacagaaaccaatcaatcagacgagaagatttgcgactcgacgaacggccggccgccatataggcaggattccaaacaaggccgcggtgataccgttgggttctcaaaaccgcgcttttaatttgattcatctgctcgccaattaatcttccaatctttgatctgtactgctccaatccactgttcgtatagtattaatttttagtaatttttagctcgccttggctacccatcttagtagagaagtaaagagagagaagaatggtactcttctcctatcataaatactaattgatttagcataaatttagatcatttttactggtactttgatacgtcatccctgtttcagtcgatttctaagtccgttctcttttagaaataagaagaagtcgtataaaaaatctctttaaaaaactcgtatgctaacttgagacgattggacttttaattgcagcttacaattttataaaaaaaatccaagcgaacaacagtaataatattaaaatagcccttcacccactgcaacacacgggcattttttctagttatgataaatataaaaggttttgttactatggcaatgccttcttaaggtgaatctctgtagtgtaacattttgattttatcacaagtcaaacctctctgactttaatcttgtttatagaaaaaaacatcaacatcaacacatactaaattagattttatcaaaaccatcatgaaatatgtcttgacattgtatttatctgttagtgcatttttctataattcagtcaaagttagagaatctcactaaagacaaaaagaataattttcaatatgaaacagatgtggtgtatatttgataaactattgatcaaatgccaaaatatttataaccacagtaacagaatagcagtaaggcaaagccatacgatacgacgacagtcagcatctatcgtttgacccgtatataaatgcatggtacgaacgctaaaaaaccagcgttactacttgatgaaattattgatcagattggcagtagctaggcatgctttcatttgatgggtttttttttttactggcataggattcgccggagttgaggtgaaacttgtgttctttgtacggcgtgtccggccaacaaaagatgggcagcgttgagagccaatgcaaggcaaaagggttgagtttttatcggcagatatggaggccggaatggcgcagggcggtcggtcggccggccggattcgcgcgtcggagcatgggtcactactcactactgtagtcccttttttccctctgcaaaatccagccctgcaacctgcatcattcctgctctcatgttctatggcttcttgctgattcgttcaaaaaaaaatgcattgtactacatttgtagcatgagtctagctctgttttgaaaacgcgggattgaaaaaacagatgaatagaatttttttttaagattttgctaggaatacaagtgcaaaatataaagttccgaaaacggaatgatcgtttggttaggagaaaacgtaggaatcggatagtaaaagatatagactcaaagggaattttccaagaggttagagctcttgctaaccttttctccaaaatctctctctctctctctctctctctctctctatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaaattttgaaaaatttgagtgattttgtgcattagataccatggtgtccgggcaccatggtgccccatatgagtgtcctatatatatatatatatatatatatatatatatatatatatatatatatatgtcattccataggaacttcaaaggaaaggaaatgattcaacccttataaaggatttcataggaatttttcatataagattgaaatcctccaaatttactatgtttttttttttacaagtcaaaggggtctagtagttagaataccttatagctagaaaaaaacagaagaggatattaagttacatgcaccagatagttcacatgaaagtttaaactgaagcataagctgaggagaaaagatagacaatttacttgtatttcaatagaggacgatacattgagatggatagcttaacatattacatatctgacaataaaaaatggccttccagaactgttgttgatacaaaccagaagataacaaatcaaatttcaaatactgagatggctgaatatggcggcccttgttctacaagttgggtcatctcagatgttgaggtaaaagatatcagtgattccattagacaaaatggggtattgcatcagcttcacagagcaaactacaagcctatacatctgctaaaaaaatatggttacatcattttgttttggcgtcacaggattgtgtacatactatcttctaccaccatctttcttcgaaaatatgcgcaagtttgcagtctgccggcgccattcatttatagggacctaaattcagtgggcacagcaaacatttgtgagtgaaggaaaaagttaaacatgtaatgtcatagctataaaatgaaaggcttactgctggaaacccgccatagtcaccgggtttctgaatatcctttgtcaccgaactatttgctgcaagccgaacctgtaaatggattgaggaaaaaaaaattgaatggttaaagggcctttagagttggtcaaggcttaaaagaatagattgagcaatgtagttaaatttgtaatacagataaacacaaaactgaatagagactgaagtagtattaaatcatgttagcaggaagctatgaaaaaagaacagagatgggaaaacagcacctttgaagcaatggagacgtgatcccgaattgccaccctaccacccaaggttacatagtcccccaatctgttgatacatgccaatgacacaagttactaaatctcaaaaagcaggcaaaataaacatttagtcaatgagatgaaggaatgcatacgttgcagaaccagcaattcctgcttgtccacaaatcatgcaacactttccaattactacattgtgaccaatctgcaagaggaactgtcaatttggacaacaagggcggcggaagtccaatcacattaagcagaatatccaatacctgaacaagattgtcaattttggtttcatctccaattactgtatctctccaactgcacttagtaaataatgatgaaaatttccgctcgcgggttaggttcaaccaaacatatattcacaaagaaagagctgatattacaaaatgtttggtatatttaaatcaaccatggagtggccaaaggaacatttgccatttcaaggctgacaaattacctccctctgtcaatacatgtatttgcacctatctccacatgatttccaatttttacatgcaacatctggagaagcataaagcttttcaacatatagccatatgatgtttcaattgaatccaaaacaaaacatctaaatacagtctatgagagtgatagtcatcaaacatttgtatcagaagtacttctcccatgtcactggcattttctcagtttcttttttctgtatctctgataccaggtaagcacattgggtgaacgtgacaaatgaaggactgagcatttccttatccttttaatacaaaatgaaccctctttgcgatcctagaatatttcagctaaccatttcactgcccttccatttggaaactactaactcatcatcttcacagaacgtttactaagaaaagggttgttagagagtactagcctgcagtttcttcttaacctgtccatcatcccccacaaagaaaccaaaacctgaaacagatgcatcaaactaaatagcatcaggatgcaagttttaatgcttgatcggagtacataaatcaatatctactggagcatcaaacaagaatagcataaaaacaaaggaaacccaaaaggttgacatttaaatagatggactggacttcaatccacaacaataaatgtaattgggcaaaagtagtgaaattctgaagacagttcacaagttgagaattttttttcctagtttgacatgtgtgcaggtagcagaaagaatccaagattgcagcaatcttgctagttactagtaccctcactggcagaaagagtccaagattgcaacagtcttacttatccctcactgcatcg

SEQ ID NO: 75443 - DNA, 1018 bp, Oryza sativa
atttcagtacaaagacagccactccagatattaggtggtggtagtacttgtcagtactgatagctaaatacagtgacatatattaactatttctttatgtcttattcactcggctctaggcatcattggtattctgatctagacatattgtaaaaggaaaaaaggaaaaagaagcattgctaaggcctagttcgcgaaaagaaaatatttgagtgtcacatcggacgtttgaccgaatgtcagaaggtaatacacgaatgaaaaaaaataatttcataactcgtctgaaaaccgcgagacgaatctgttaagcctaatttagtgcagcacttatagctaatcatggactaattatgctcaaaagatttgtctcgcaattttcatgcaaactgtacaattaattaattagattttgtttttatctatatttaatgcttcatgtatatatctaaagattggatgtaatgttttttttgttaaccaggcctaatactgatattctggccttgaaatgtactagcccatgctgcacagtgcacagctagcacgataaaatataatcttgacacagctgcacgttgcgccattagccatggagtccggcggcttccttgcacgtcgtcccgagccatgcgccgccgccgccgaccccgacgacggcgacgcccgccgcggcggttggcgcgccgccttcttcctcgtcggtaagtggcggcttctcaggctttagtgatgacatcatctctctcagccaggcttaatttgttgctgacgtgtgcatgcatggccatggcgcagtcgtcgggttcttggagcggattgggttcttcggcgtgcaaggcaacctgatgctgtacctcaccggcccgatggccatgtccacggcggcggcggccaccgcggcgaacgcctggggcgggacggtgctggtgctcacgctcgccggcggcctcgccgccgactcctccggcctcggccggtaccgcgccgtcatcgtcgccagcgcgctctacctgct

SEQ ID NO: 75444 - DNA, 730 bp, Oryza sativa
gcagccctgtgagtgatatcagtgatcatcagagtgtaagatcccctcatccagccacaatatccgtttcctacattattgagcattgtgccgcactgtaacaattcatctagagagtatttggcacacatgacggaccaattgactacctcaacatgtagcaatttgcgtggttagacttggtcaaaaccaacggggcatgggtacagaaaaaaggatattaccaatggtcccgatcagaccccttaacttagctgtctatagctagctagtctctttccaagactttcttcttcttttttcttttttttttgaggggctttccaagactttctgcattgcctagagtatgtactttctcttgttctttaatttgctcttcttttcaaaatatgatggagaacactagcacatagtttagtccgccagtgcttgactactccacaaatgtcttcaaatggtgccaccatctgctagtccaaattccctgtggaccttggtatttccgtcttagtgaatttgacgcttttgatgttcttgctcaatcgtactacgtacatattccatgccctgcttatcctacccggccggagtggaattatctactggaaatcactagaggtacaatgttggagttgtttcttaatcatggatagacgatgactcgatccacttgactacaaggattttaaatcctgctgtcacaatttcgtacacataagtgtgcttt

SEQ ID NO: 75445 - DNA, 699 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttc

SEQ ID NO: 75446 - DNA, 15413 bp, Oryza sativa
ccaaacaaatcattagagttcacagtccagttacaatccttttacaagttcaaaattgtttacaacccacgagcaaaacgacagcagacaagcatatccatctttttaattaagataggcattttcacgcatactcacaccgttcacccccttgcccaagcctacacccccaattccttcccccgcactccacctctctgtatcgtccctggccgagtcagccactgtgtcccatgaaacctccactccaggcgccaagacaaagaaggtaggcagcagtggggattgtatgcagtattgttgatgcactagcagacacggacccacactgctactgtatcagcagtactgcaaggatctgcatccggtaggcagcaggcagccaccgagggaagctgtgtagggagaggagaccacaggagcgagtttgtccaccgaccgcgccatccactgtacctacccgcttccgtcaactgaacagggcagctggccccgcttggccgagcttgcctgcttcaccttcgttgccacccaccggtcgtgacagctataaacgatggcatgcttttgtcccctctgtccatttccccttcctgcgaagccacggctctgcttcgccccatgtgccaccactgcctccatcccgaaccgccatggccaccgccatcgcactgatttccagccaatagtttttatggtaagtactacacggtaaattaggagggatatatttattacagatctaatctaatggtgtaaactaatgggtccaccaacttaaatgaaaatcgagggctaaattatttttttctcagaatttctaagattttttttctattttattagagtgccatgtgatagcttgaaattgtttttagagtgtcgtatggtggcatgagagcacttgtagaaagtttaatagacttttagtatataataactaggaaggtagcccgcgcattcgcgcgggcaaagcatttcttcatcatttttctactcagtattgataagatgttttgtgctttactattaatttctaagttttttgtaatttttaaaatgtgacatatggtgacttaatagcgctcggaacttttattgtcaaaaacgtggaggggcattattgtcagaaaaaaaaggtgtggatggtataatcatcatttagcagtgactaaaccttttttcctccttttttggttttttcgatgaaatacgagaaacgccaatgcaatcgatgatcatatatcgatttagctaggaaaaaaatataaatgacaaagtaactcataatcattgtattaataaattactaatttacccctaataatactggtagtataatactaccagtagataggaccggagcatcgatcttaataaaaactatacggccacttattaagagtgtttgtacatgcaggagaaaatagaaccgatgaaactgtcgttgcaagtggaacaattggtgtcatgttgctcagcgacttttgcttgctatgcatgactacttctgcttgaatactcctgcaagttatgaaatgattgttgaaattctatcaaactcttctatatttgacaaattttctaacaacttgtcaatactcaaacatatttgaaataagtggacattcaggttaaaattgaggcaaagtttatgtcacatcctgatttttgtttcaggatttataaattatttaataaattattattagaatttatattaaatgttctttaatttacaagtgaagtaaaatgtgggaaataaaatttcttaaatataaagcatggatggatttaatttttattaaattctctatgattaagtatactctctgaaattttctcggatttttcggagctcaagtcctaaatgatacaaagaacagttcagtaattatttgatcattaataatctaattatattttttaagagcttttcttggttaaaaatcctaaatatataaattgttgtttaattggaattattagaaatgattttaaaagcctagaagagaagatctaattttaatttgttaaatctcaatataaaattgggctagataaaattttattaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctctctttttctctctctctccccggcccagtcggcccagtccgagccgccgctctcctctctctctcgctgtcgctgacaggtggggcccacctgtcaggttcgtcttcctcgtgccgccgccgccgcccgaaaccctagcgcaagccgccgccgtctccttccaaattcggccgcgtctttccttctccggtgaaatctttagaggggaaatgatcttctcgatctcctcttccttttctcctcttcgtttggaaatcgacggatttgagctcaattcggattcgattttctcgaagtttccttcgcgtcgccggccgtcgtgggccttcgccgccgcctccttgcacctatataaggacccctggtgtctccgctacccgccgcctctctcgccttcgcccgccgtcatgtgtagcgccctagcctcgtgagcttttgcaccgccgtcgccgccgttcgtccagccgtgcgccgctgtcgctacggtcgtcgtcgtcactcgggaaggccaccgtcgggatcgcgaggtcgtcgctgtccccgtccaccgcttcacttccgccgaagaccgccggagcaccgtcgccgtcgtcgacccgatcttctccgccgctccgttctcgtcgccggcgccgtccgttgcttttccgccgcttctttggtcaccggtgagttcgccgcgccgcgctctacgtcctggtgcccttcgttctcgtcgtcgcgccgtcgtttgccggcgagcatgcgcgcccgagtcgcccgagtcgccgccggtgctgacgacatcgctgacgtcatcgctgacgtcatcgttgccgttccccgtgagccggtcgtggaccgattgatctcggccgtccgttttggatagggttgatctcggccgtccgttcccgtgaaccgtcgccgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcattataactcagtttaaggtggttcaagttgcaaaagttatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtaaatctattcctttgttatggcccgtttgcattgattactttatttcttgataccttgggttattataacttgactagttgggctttatatatattggttcagctagatattagttatgattgcttagccatgcttagaaacattagcacactattgggataacttatgactcattattatttaatgatggcttaatgatagttcacgatggttaatcgtgattggttaattaattacttgccaactaaaacttgataacggtgggttgtgagcacatggttttgagagtcgtgctcatgacaattaaggaccggttcgcgagctactgttgtgaaacattaatcgtgccaaccacaagccagcgtgggcaacggctttaccttttatataacatggttcattgcggagcaccagactgagaagtggcggagataagcccacgggggtcgctggggagtccatgccttgttttataagggggtgattatgatccaggaatggtgcactgtggtgagttgtgttgtgcgaagggtattgtcacgatttccccctttgcagtgccgtggtggtacttcggggcatggcaacatgtgtgaaatcgtgtcttgtgggtacagtggtacacctctggccagagtaaaactattcgaatagccgtgcccgcggttatgggcgggttgagcaatgtttttcgtgattagtctcacacctctcacaataattatagatgttatacctggtaataatttgcttagctcctggtttggagattagatctgtacagccgggtatggttgttcaggatggttgggcctgtgcagcatgggtatgctgttcggtgttgattaaaatttctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgtctgtgggagtggagccggagcttcgctagattttattttccgctgcagttttcttcttggtgaggactaagtgcctcttaagtaagtatttatcgttttagtaaatttgatgaatctgtatattaaattgtcagtttgtgtacctcggctgattcctggacgaggattttatgcacaaataagttcggaaattactagtgaatttccgggcgtgacagtttatgtcaaaacgcttggtataaaaagaagggaaaatataactagtgtagaaaagtaagggaaaaatataactagtttagaaaagtaagataacccttaggatgatttaacagaccggagatagacctaagcttgctttcgtttgaaaacatgatgccattcccagtgggaggtgtcacttttacgttttcaatggtgtcacataagtaacaagacatttaattgatgattaaaatagctcatactcccttctttcacacaagttagacatataacttttgtgaccaagatcatgtagacattaacttatcttacatgtaacaaagatatacacgcatgcaaccaatgagtattaagattactcctcgggttttaatcatcaaacatttaatttacctctccatttaagttttggattcatacatagaataacttttttggaaaaactaaataaaatatgaaatatatctaactcttgtggacggagagagtactataatacggttttatttttgttgttttataggtagtacatgcaagatacaaaccgtgtagacattattttatttcatacttcattaattttttaccacactatgaaaatattgatacgacaccctatttaatgagaatgaaacttccactaaaaatggcctaaaaagaagtggtaaaagcataaccactcttaaaaataggaaacataggagttgaggtcctctgcattgaaaaagaaaatgcagagatgctacagtacctttcattgacgcatggtttaatctgttggatcttcatcgaatggtacaaaccatcttgctataatacctcactacagtaaaaaatacccaacagtatggattactgttagaatactgtctctagtgtgctaatagaaatcactgtagcgcgagactcggatcactgtgcaaacagtgtcctcttccgttactgtaaaggacctgcatccgtaacatagttgcccacgccaccggaccgctgtaatccccagctgccttaaaagttaaaattagcagcttgaggcctggagtgtatgctctcctgcgtgatgcttgcaacttgtgcatgaccgagatcgaccgatcgaggccctttggaactgaataagttatcccatccaaatgaactaagtcaagtcaactaagtcaagtcaacgatccaacttgtacttgccaaataatgggcatctcatctcgatcggccaatgcaaagccgtcgatcgtatcagtcacggtgcgcagtagggccaactgataattaaaccgacggacgatgactcagtcacacaagaaccagtccacccgaggatttaagttctaaatcggacagcaagatgtctgatgaatttattaatcttaagatataatggtcgctgatgactttattaatcttaagatgtaatggttcaatgtctcatatgtgcttataatggtaggttgtacgtacgtgcgtttgtgggcacatgtgttcctactgtgtttttaaaagggaaaaaaaatattggtcttactaaaactgaatatgacatatcttaatacaataaatttgaatagcaattggtatatgtcatatctggttttagatttattttttgtgacatagggagtacttttttttttgcgggggacatagggagtacttaacaagagctgcatggctgcatatccgcttgcttccacagttccacttgcatcttggagccattcacacgctcccaccatgcatcccaagtcatcctgctgttcttcctcatgatcggagcattgctcaccaatgccatggcaaaccatgcaccggctccagccgccgtcaactgcgtgccacgagagagggaagccctgctgccttcaagcgaggcatcactggcgaccccgcagggcgcctcgcctcgtggaaggaagacgaccatgactgctgccggtggaggggcgttaggtgcagcgacaacctcatcggtcatgtcctcgagctccacctccagagtaacctcaccggtgttgtttatgtagattatagccctttggagttcaacgcggtagctttggtcggccggataacgtcttctttgctttctctggagcatctagagcaccttgacctcagcaacaacaacctcacggggccggatggccgtttcccggtgtttgtggcctcccttcgcaacctacaatatcttgatctctctggtttgggattcactggtatggtgccatatcagcttggtaacctttcaaagctggaatttcttgacctttcgggaacaggtatgcaatcagcagatatatcatggctaacacgtctacaatggttgaagtacctttacttgtcatcagtaaatcttagcgcgatatctgattgggctcatgtagtaaacaagatcccatcactaacggtgctttctctctctggttgctcacttacacgtgtagaccactcgctcaaacacgtaaacctcactagacttgagaagctccatctctctggcaacgattttagccaccctttgtcatcttgctggttttggatcttgaaaaccctcatctacctcgaccttgaatcaaccggtttatatggtcgatttccaaatgcaataaccaacatgacgtccctccaggtcttggatttttcaagaaacaataatgcgggtattttggaaccaattctgctaaggaacctttgcaacttagaaagtctgaaccttcaattgggcctcttgtctggtaacatgacagagctgctagagagtttgagtcattgctcaccaaacaaattgcggaaattatatttgtccaacaacaatattacgggaactctaccagctcagagtatgggccaatttaccagcttagccaatattggtttctctttcaaccagctcacagggcacgtgcctcctgagattggtaaactagctagtttgactcaccttgacctaagtgaaaataaattaacaggaaccatcacagatgaacacttcggtggtctagtgagcttaacatacattgatttatcttacaacaaactcaagattgttatagaccctgaatggttaccaccatttaggcttgaaactgcgtattttgcatcttgtcaaatgggtcctctgtttcctgcctggctccggtggtcatccgacattgatatgattgatatttcaagcgctaatataatagacgagtttccagattgggtctctacagcattttcaaaggccatatatttggacatgtctaataacaaaatcagcggtaacctgccaaaaaatatgaaaatcatgtctctggaagaactctatctaaattcaaacagaataatcggtgaagtaccaacgttgccgacaaacctcacctatttggacatctcaaataacatactatcagggcttgtcgcatcaaacttcggagcgccaagactagatactatgaatctatcctcaaacagcatccaaggccagattccaagttcgatttgcaggttgaaatatttgagcaccttggatttatccaacaatcttttgaacgggaaacttcctcgatgcattgggatgagaaatcttcagaagcttctactaagtaataataacttatctggcacattcccatctttactgcaaggctgcacactgctacgttatatagacctatcatggaataggttttatggaagattaccgagttggattggagacttccaagaattagtttctctacaactgaggaacaatactttttcttggtaatgttctttcactgaacatagcaagaattactctatgtatatgttaggtgcctcaaggaaagtagtcgtattcagaggtacagcagcgttgatgagaatgccgtgccatgttcaatgatgaggatcaaactgcttatctggtttgggcctcctgaaaatacttgcatcaaagcaactatataataaagttagaggtctgtcagtaaccttctgcaatggagctcaagcttggtataatatttgctattgtcttccttattcgttgatgtccgttgttagtttctattgtaagttagctgttaatacatgtacaccttttgtctggtggtggtgtgaaaggagaaagaacaagatgttgagccactgaagagatttgctctggtcaagcgaaaagtatctcacggtacctcaatgcactttgagaccaaagatagtatcgtctctcctacctctgcagttcggctgccagcgcagttggaataatttctcgtttactagagttattcttcctcttctaaggaaatattagaaactaaattatatatctaaccttttctagttagcacatggcccatacttttaagtacctttccgtaggtatcttttattatagttttttaaaaaaaaataaaacatttttattgaatttgaataaattataaccaaattcacaaatatttgaaaaaaatccaaaaattttgctcgaaatatttgcttgccagaggaggggggtgaaatttccatccctgcacctcccttgcgcactgctctcctcacaagagctagctctgtgaggctttcggctaaggggacgaaaactggagattgccaggaagagaagaagcaagaagagaacatgaaggaggaggagagggaagaaggggtgctgaatgccatgccactatggatgggaggctgagtcagtgtgccaacatacattcagcgccatgctatttggcactgaggtatctaaattcagcaccacacgatttggcgttgaacaaaagggtcagtttttaaataagttttgacggcggttcacttgtaaaattagtttttgcaaagggtcaaattgtcaaaatttgtgtgctactcaaaatttgtcaaaatttagctagataataccccgcgcgttgctgtagtaataattgagaaatttcaaattttcaacatgagcatagaaatatttgagtagaaagaaaactactccaatataattaacttcctaaaaactttattgtagtaatagtaattatagattatatgatgaggtaccttgttaagccgctgatcggatagagctagtactggaaacaacaaaattaaaggatgttcactcagtactgaagaatgaaaaatatacaccatcaataacattatccagaattatatgtttaatttctatatgaactaattaagcctgaaaggataggtgttgtactgggattgattttctcgttgacttgatagccttgtattttgcatgatatcattccatggtacaaccctccctcaccgatccatttagcacagttttagaacctctgcagttaatcttgtaatagaatgccaatcagttcatgaataaggtgctagaataacatattttactatggtaagaaatatgcatttagcaggaagtacaactatcatataaatacgccaggaatgtgcagtcaaggcatgtatcaaacctggactatgattaccatacaattaaaaaaataacaaccataactaaaaaaactaccattttatatttatacatgtacatagatagtccaatctatctattatatactaaaagttcattaaactttctaaaaatactctcaagacaccacatggcttactacaaacgctcctaagtcaccacgtggcgctctaataaattagaaaaaatcctagaaattttaagaaaaaagaaaaacatcccgccattggttttcacttaaatcagtggacccattatttttaaccattggattaattttaaaagaatatatatatactcaatccaacctatgggtttatacttctaacgttccccctcagtcataatgggagcgaagcgaatgattgtgactggatttaaaatcttctatttcttcatctttttcgactcaccatcatcgattgcatctctgacggatggtcctccacctggtgcctgtgtccccttctgtgtcgtcccttaactctcctctttttttgttagaagtatagatgttagttagagataagagtcatatacaaatatagagataaaatatatcctagagataagatagagtcctagagatagaatcctggagataaatctactcttacttgtattatactctaagtctctatctcctatgtactcctatatataccctatgagagggtcgatgtaatagatcagaaaacatcaaaatacaacatattaaatttttacgcatggtatcagagccttagagactaatgtcggtcgatccccgcatcaccctggggagatgagatcaatcctataatctcattggggtgccacatctttagatgccacaaataatccatagattagattttactaggattagattagatcaattccttcattagctacatagaacctaccaatcctcccgatcagatcaggaaccttgtcaacaacacaaccgtcttcgctgatcctacatcactagtagtcttcatcaacttgctgccgccaacttgtccacatagatggacaactcgcgtcctctacgacggcaacgaccgcgacaccgatggcattgatcacatcatctataatgacaacgactacatcaacactgcatcaccattgtgatgactgccacacagcacagaaggaccaaccaaattggtggcctcatcgccaacgacatcctctgatatatgcaagacgtcctcaatagcattcttctgacatctataagatgcaagatgctaataattacattttcgtcttcacaccatggcgtaaatttttttttcgcctttgactatgtgtggctacacctacaatcacggctactgcatgatcggttacatcgactaatgtctacaacaaaaatcattgatggcaactccagtcaaagcgtcagtgttatcgctatcgtccatgacactcccgctatgattgcggaagggaatagaggagagtcacgggacgacacagaagtggacgcaggcaccaagtggaggtctgtccattagatatgcaatcgatgatggtgagtagaaaaagatgaagaaatagaagattttaaatccaatcgcaatcgttcgcttcactccattatgactgaggggaaatattagaagtatagatgttagttagagataagagtcaaatacaaatatagagataagatagagtcctagagatagaaccctagagataaatctactcttacttgcagtgtattctaagtctatatctcctatgtactcatatatacgtatataccccatgagagggtcggtgtaatatatcagaaaacatcagaatataatatatattatatttttccacatgatggacctccacacgtcacagatgagttacgttattactaaccactgatctgtgatgaggggtctacccgtcacagatgagggattaagcccgtcacagctattttgttctggcgtagtgtaccgcggccagtctcacgaagatcaccactaaatgtgcatcctccatgtgcagcacgacggcggtggcggaggcggcggcgctagcccatgacgctgagatcgaggtgcgcgggattcttggcaacaacgtgaagaccaacttcaaaattctttttaaaatataccttttttttattggttttgtataaatatgctcatctctactactttaaaattttatagtggtggcggtgactccaaccctaacagacacgtgtgatattatccgttggatcgggacatcggacggtgctgagatcccatcgcacgcgattcacttttcttccctcccccgcatcgcgcgtgtggctccgtcgcgtctcagccggcccacgcacggctccgccgcctccgtcggccccgcgcacccgccggcgcacgcgtggctccgtcgccgccaatggccgcgcaagcctgcgccgcgtccaccacctccgtcggccccgcgcacccgcgcgtctccgccgactcccgtggacccgcgaggctccgtcgcctccgcgtgatcccgcgcgcctccgccgactcggtagcggctcccccggctccgctgcctccgcgcgggcaagccccgcggtcccctttgttgcgagttgccatccccgcgtcgacagcggccgaagcggtttccggccccgtgtggttcggttgcatgcacatgcacttgattcccatcctgcgagtgtaagtgacatgcacgggcgcatgctgcatgcatgtgcatggcactgttcatgaggaaaaaaaaggaggaagaagaagaagaaggagaaaaggagacaagaaagacagcacgacttaatggctgcggaagcggttccgtgtcgtgcgtaatcgctaagcggcctacgccggcctcgctgcgtgaagccgcccccgcgcatacgaccaagactccgcgggcgacaccctccgccgactcacgcccggcgctggccccgtgtggcgcgttttgcctccggctcggccccttccgccggaccacgtcacgacacagaggctcgcgcccggcggactccacagtccttccgctggccccggacagctccgccggtcacgccggccttaaaagccaagctccaccggccacacgcggcttcgcgcggcacccccggcactcgccttcgcacactccggacggcgctgcctccgtcgagcaccgcggctttcaccgctagagggggtggactgaccttcatttctagcgggctccggacggtggtacctccgtcgagcaccgcggctttcaccactagatggggtggaccggactccacatctcaagagctcaagatggcgccgccttttcagtgtggtctttgctgagcgtgagggtatccgatgcaaaatgcaggcatagatcaacaccctaagaaacaggggctggaaatcatctgctcccccgaacctcggagtcagcagatgagggggtaatgttggggaataactccatacttaaggtgttgtataaactaatgtataaaagattaaaatacccctaggagaatgttgtatatatgtagccaatcaagggtaaagatgtaatttcccgttacatatgaataaaaggagtcctgcaaaggcaagagagagggatctctcccacattccatcgattctctttctctcttcattcactcttgttgtcctcacagggctaagcttgggggatcctcacagggctaagcttgggggatgctctagccatacatgttggattttgttccaacacctacattgttatattgttcaatatatataaagaatatcatttcacctttttatgtaatatataaacgatatactttattaaacccgttgcaacgcacgggcacctaactagtttagaaaatatttacagaaatataccgttgttgccaaggatcctgcgcacctcgatcgatcggcgtcgtgggctagcgcctccgcctccgccgtgtgctagctctgccgatccataagcagcagcccccgcaacccagctccctggaaaccatgcttgctcaatgccagctggccaattttttcaccttgtcaggacacctgccgctgctatccttacagccacgcagtggtggacactcatcgacggcgcggaagggatcgcctcctttcacggtgctgatggttggggatgggaaacactccatatcacaattcttgtttttttagaagggtaagtatcttctacaggacggcctttacatcgatccaacaggatatatatagtcttttttaaattaggaacttatattagcctatgaagtagggaacttagccctcaaataactttttttagataatggaaatggattacatctccggcttctgtcataagacacatagccataagtttaatagtaataaaaagataaaggtaagattaaatcaaaatgagaaataaggtgatgggacaaatacccaacttccctttattattgactagagttaaaccaatttttagctagcaattataatggaactacgccacccatagtggaataagagaccctttggctaccgattacaagagtatagcaccattgcacataatttcctgctcctcctgtagtagcatcgtaaccaaaagtggagccagtagaaagacatgaagataacctgcatagggttagataattgtttaccattaaaaactttatcattacgacaacgccaaattgaccaacatacaacactagctccaattagaatcatcttcttaatggacctagatacctctctaagccaattaccgaaaatgtttttggcgttacggggtaggggatattaaaagcaaaaaacacacatctccaaacaaactgagcgacatgacactcaaagaaaagatgttggattgtctcttgtgcatagcagaaagaataatgtttgcccccccc

SEQ ID NO: 75447 - DNA, 12844 bp, Oryza sativa
ataaagctagcatatatctcgattcatttatgaatcaattaaaaccctaaaatattttatattgtgaaatagatgaagtaattaacaacatatttgcgggcacattcgcagatcatgaaacaatttcttcgcccaattgccactgtggacggagacgtgatcgggactagtatttttttaaaaaaaatcgtaagttacatattttctgtgggcctgttccggtcaatgtcacaaatgttaagtatgcatgcttaggtgcatatgaatctaagaattaattacggcgataccttatatattgtgattcattagatcattaagcttcctttagaaagaaaaataataaagagcagaacaatagagaaaatacccgttgtactatggctgtatatatcatagtgcagtcctcaaggagctaatccctgttccgtgtgaaatgctgggtacttctgaaattgaatcggagctggagttgtagatcgataagaatgccgctccacatcacaagttcaattttctagagcgatccggtctgatcggctccatatttttgtgaagttagatcgtttggttggattctagctctaggaaatatgaatctaggagctggagttctgtcaagtagacccgttgttcagtccgattggatgggccgcacgcgtcatgcaatcccgctttggcccaaccatatatgtggggacatgcacgtcccagacagtcgtgatccggcccaaatgttatgggcatttcaaatgaatccctgtattgacccaatgagctacataattatttcggtcttcagacttctaaagcttaaaattaaggttaaatactcatttaacgctatatgtacaagtaccgtgcatgccgattttctagttggactaacttttggttaaaatcttcctagacagaattacaccttataaaaatcatcttgtttggcaggcaaccaaaacacagctttctatggaaagctgcactcagctaggaaagcatcaagcatgcactcaagatatatcggcctaattaatactccctcctttttaatgtatgacgccgttaactttttaatcaacgtttgaccactcgtcttattcaaaatttttatgcaaatataaaaatacttatgttatgcttaaagaacatttgatgataaatcaaatcataataaaataaaatacaattacataatttttttaaataagatgaaaggtcaaacgtttgttaaaaagtcaacggcgtcatacattaaaataaaatacggagggagtagtatatcttccaaagtatttataagggtatggtaaggtacatgtatgtgtgtgcgtgtttatatgagtatcgtgtctatttaaataataataatatatctgcgtatgccatggggctcatggccatggatttatcaaggtataccaaccctagtcaagtctagcactttgtgcgtatgtaaagcgtcaacaaagcaaaaccactgccatcaggcgcagtgcctaaatacaataaggttattttactatagaaaagcacagctgtgggtgagtaactattggtgccaagtaagtgaagagacctgtgagtgagtcaacaagagtcaagagacatgtatacatatatgtgggtcaacgtagcgcccgttccgtcgtggcgcctagcgggaaaattatcttttaaaaaccctaattgcgaaattatttcttgcttgttgtctagtgtccgtgccatctcaagatctcaaatccccgatctatcgtcgagttcaatcccgaatccaaatccttccaaatcaatttctccgcaaaagtctattttgcctcccccagggtcgatgggccaaatttctctcggcccatctccccccttcctgccggctatctctctctctctctccctctccccctccccctccgctccgcccgcgcaccgcgcgcgcgtgcgcgtgagccgccgagccgagccctcctcttcgctccctcgctgctgctccccgcgcgtcgttcgcacgcgcgcccgcgtggtcgtcgcccgcgtcgcgcctgcgccgtctgcgccgcccggccccgctgctctgccgcgcctgcagccgctcggccccgcagccagcgcgcgtgcccgagccgcgccgctcaatccaccgcgcctcccgttgccccccgcgcgcgcgtgccgtggtggccgaccgcttggtcgccgcagccgtcaccctgtgccgcgcctgtcgctcgtgtcgccgctccgctccaaaccgtcccgccgtcatcgctgtcgtcatcgcctcggccccgccactccgcgcgcaagccaccaagggacggaggcagagcccctcctccctctgccgcgacgccccgctcccctcctccttttcccaaagcggcaaggaggcaaacccctttctctccctccttttcccctttttctcccgctggcgtcatcctccctccgtcctgtcgccgatttggccgcgagcgccgagcgccagctcgcgccttgaccgcccaaagtcggtttccaaaccgacattgccgcccttaaaagccccaggcgccctcccttcctcttcccccccccttcctccccgtttctcatctgcgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgcccgcccgcacggtagagcatctccccgttctccctcctcgctcagcgtagctccgcccaatccgacgctagcatcggattcccgtagccgcgtagatgctctcgccgccgggaattggcccctcgtgacctcgtcgtcgtttcccccttttccctccgccgggcgccgccgccacaatccgccgccgacggactccctccggcgaatccgagctattggctcgtctcccctcgtcttgtgcaactacccggtgtgctcgctttcgcctgtatcgccatggttcgctccgccgctcgccgctgtcgtccgccgtccgttccagccggcgtcgtcgtctacctcccgccggcccgcgtggcagctacgtaggcgccacgtcggcgccagtcagccaaagacctggtcgagccgaccccggtcagtccatccccgtgcgcgcgttccaccgcgagccgtgaggctacgcgtgggcccgccgcatccgcgtcctccgtgaaccgcgcgcgtgcaccgcgtccctcccccaccctagcgccgcgccgcgtgctccctccgcacggtgaaccgtgtcaccgacaagcgggtcccacccgggaccacgcgtggtgagtccggtccaccggcgctctctctctcctcccctcccgcgtgcgcgcgtcttgggtcgccttgggccggccagcccatttagctcgaccgtaccgctccatttctcttgggccgcgccctagccgcccgagaaaagtctatattcccttcctcttttcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcacgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgtagtcccgtctgcaaggcagatcggcggacttacctaatttgttgcatttgatccttcctttgctaattgatataccatgtccccttgtaaccatctagttgcgtctcggtattcgtgcaccctgtgcgagtatcgacggacgccttcaaacttaaaattctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggactcctgggcttcctggcatagtatggtctgggacctaacctgttgttggtctgggacccctctcgtcggcatatggtaaacctttgttggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggaggtgaggtgattcctagcgtagttttgattgactactgcttgtgaaattgctgttgtggaaaagggttcgatgattgaaaaatctgtagctgatggaattagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgacttcagaaagagttcaaatgaaatcaattgcaaaaacaacagcctttccttgaagcctgcaataaacacctatttcccatggcttgctgagtactcctgtactcacccttgctctatataaataaatcccccccagttgctgaagaagatgaagcggatcccgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctcggttgctgtgataatctgtcttcctgtgataccagcactgttttctgggactggtatcgatttacaggttaatttggagcgtcacgggctagttccggtcggtactagttcggggcgtgacagtcaataacagggagttatggcaaatgatgattttgttgatctcaacatatgttgacagttttctagagatgctcatatatatgaataggatgtgtgtgtagtcatagagatgagtaaggtggtgtttgaagtgtttcatgcaaaacgaggtggtaataacatgtgattaattgagttttaattgatacaaacttgaaaatggattgatctgatattttagaacaacttttatatagaaagttttcgcatgaaacgcattgattaacagtttggaaagtgtgccacgaatatctaaaactttatccactctctgtagtagaaacaacgaagccaagcgtctgcatttatattatgtttctaaaaaataatttgaaaccttgactataaatttttaaataacaaattgtttgcatagatcaatttgtcttaaaagtattatcacaatatcataaatgtagtatatttcatatacttattttcatataaaatagatctaagtttgacaaaacaaatcactactacaaaaccatctttcgtggcggccattttaggttttcgctagcagaatttggtaccgccataaaccaaaagccagtgaagatcaagatcttaagccagctgccagcaaagatccattttcgctggcggttggattaagacggccgccagcgaaaataaattatcgctagcggctgtgttaaatcggccgccagtgaaaatctattttgggccaaaaaaaaatacccatgcagctgcccagccgcaagcgtagatgatttggagaaaagcccattgattcattttcaaaattcaaatccacatctagagatctagattcgatgctcatttccaaattcaaacatgaaatacaaaatcatcatttacacagatcaaacatcatttacacagattaaaacatgtgcatcatctggaacaacatgcaaaaaaaaaattcaaatcgaagaggagggagctgggagcatggtcaggacggcgtcatggtcggagaggagggagccgggagcatagtcgacggcgtcgaggtcagtgccgccctccccgtggtccggcggtggcggatccggcctccccgcggcctggtggcggcggatccgtcctccccgaggcctggcggtggtggatccggcctccccgcccgcgcccaagcgctgccgcccgcgcccgaactcgtcgccaccttcgctgcgcagtcctccgtcacccggcgctggaggattggaggaagagagggttggagggagagagggagtggagaaaggaggaggagagatagcataaggacaaggctggtgtgggggcggtcattttatagcgttaaattttatttcgctgacggtgttgttacatgccgccagcgaaaatcggacgccagcgaaaacccgatttttttatgacgggcctcttagcgccgccaccataaaatagagctgttttttgtgacgggcctcttagcgtggctgccagcgaaaaccgattttcgctggcggtccgtaacccctcacctctcgttacatttttcgtgacggtttttgcctataaccgccagcgaaaattatagggcaacaccataaaaaatctttttttatagtgaattaacccaatcttatcctaaacggcaaatatttatgaactgattttttggatggttctactaagatgcaaatcgaccatacaaaaccacaaaaaagcacgtccatcttgcatttcatgtttagcatttaacttaacaaattttctacaacaacacacggggatttaacaattatcttgtaaaattgatccaaccaagtgtagttgttgatatttcctttttttttataatacagaaccacttatattgaattaattattcactactacaaaagtgatttttctgtacgagaccccttcatttttgcaaacagaccataactagtggcgtctgcaaaaatcaagcggcattttcgcagcggctccttaagacgcccgtatggaaaaatcacatatcttacaaaatttatatatatctctcttatagtttataaaacaatataagagatatgtacattttgtgaacaatcttacaaatcactttgttggatgaagaaatgaccaaaataaaagttatcgatttcgatgagttatacaactttgttatagaagaattttccatttgaaatcatttagtatttgaaaatgttgtttgaaattgtcatcatttgaaattcaaattcaaactgtcgaaacaaagtcatatagaaaaatgaccaaaacaaaagttgtagatcttgataagttatacaactttgttgttggcaatttttttcatttcaaatcatgtactacccgaaaaattatttgaatttcctatattttaaaatttaaattttatatagttcaatcaaactcggatcgcgaaatgaccaacagaaaaattgtagatctcaatgagttctacaactttgcttttgacaactttttcacatgagttcatttagcatctgaaaattcgactcgaagtttatttagtaccaaattaatatttttaataattattttcgcatgcggacggttatgtggtccgcatgtaaaactgccggcattttttcactcctcctctctctctttccctcctcaccatttcaaaatttttcaaccaccccatttaatttctctctctctctttatctcctctctctccctctctctttctctcctctcctctcctctctctttcttctctcctctcttctcatcgacagcgggcatgggtgcacggcgatggcgtcggcgggcagcgagggcgaaggatctggtggcgccgtcctcgggagggccaatccgtcaccctagggaggagctcagcgctcgacggcggacggcgggcggcgggcacggtgatggcctgcggcggcggatccggcggcgccgtccttgggagggccagatccgccgccctagggaggagctcggcactcggcggtggatctggggtcggcggtggcagcggtggtctcgggcgacggcggcagcggcggtcttgggcagctggcgacgaacggtggcggcggatctgattggagcggatccggcggcgccgtcctcgggagggccagatctgccgccctacggtggagctcgacgctcggcggtggatctgggggcggcggtggcagcgacggtctcgggcggtggcggcggcggtctcagcggctggcgatggcgacggcgatggcgatgacgagagcagaagcggcggctgtgacgatctcgcgtgggcggtggcgctaggttttttttcgtttttttatttttggaaatttttttcgcgattttttctctttgcatgcggtcggcttaagcgcccacatgcgaaaatccgattttcgcatgcgggtgccctggccgcatgcaaagatttgcatttttgcagacgatttggcgcatgcagttggcgcaactgcatgtgaaaatcgctccggcccgtttgcgaaaacggtttctgtagtagttattgagcaatcaaatttcatgtaaaaccctaggtattatagtttttgttgcaaaaaatcatagaaattttagcatgtgatagataaccacatgcaggtatagtttcacaaaatcatgctattaatcatttgttctttgattcatgatacttctgaaatcaaaaatcaaatctcaaatttatggtttattcgatccatcacataagttttagcctctaaggtatgctttttttatttttctacaataacaaattaaatttgattaacatttttgtttttcaaactataaaatcatgatactcgggatttatgcgtcacttgtggctttgctaacttgtaccataatacgcgcgtaggtttatgaaatacgtaccctttgatggatggttgacctagggtttttgttagatgacagattgacagtccttgtttttaaatactatacataattgtttgtagcatttagatagtttatctaagtacatacagaccgcaaaaaggctattagacgagagcgagactaatccgctagccatgacacagacagtgtcagctgtttttgaaacttactaaagttgagctatagtgcgttgggtaaaaaaaaaaaagcatttgtgcctccagctttattctatacgtatacgacgactgtgtgtgtattattattaaagttgacctactacggggggtgtttagattcagtggtgtaaagttttaacgtgtcacatcggatattatatatggtgtcgctgaggtgttcgtgtactaaaacaaaaactaattatagattccgtcagtaaaccgcaagacaaatttattaaacctaattaatccgtcattagcaaatgtttactgtacgtagcaccatattatcaaatcatggagcaattaggcttaaaagattcgtctcgcaaaataattatttttaggctatatttaatactttatacatgtgttcaaacatttcatgtgacagggtgaaaaaattttggttggaatctaaacagggcctacatacctaaacaaaaacttgagccaacagttttttttcaagaataatcatttttacctctatatatattgtgactttcatgatccaagctagcctacccagtatccaccatggatcctacacagaagttccttctcttcctcctcgttggagtagccgccaccttgtcccttgcaaccaattcaccggtgccgcagtggccagccagctgcacgccacgggagagggaggccttgctggccttcaagcgaggcatcaccggtgatcccgcaggtcgtctcacctcgtggaagcgaggtagccatgactgctgccagtggaggggcgtccggtgcagcaacctcaccggccatgtccttgagctccaccttcggaataacttcccgcgatacgacgaagcaacagctttggtggggcacataagtacttctctgatctctctcgagcacctagagcaccttgacctcagcaataacaatctcgtgggtccagccggccgattcccgcggttcgtcagctctctcaggaacctgatatatattaacttctctggtatgccattaacaggtatggtgccgcctcaactcggtaatattacaaagctgcaatatctcgacctttcccatggaataggtatgtactcaacagatatacagtggctcaccaatctaccagccctaaggtacctaggcttatcaaatgtaaacctcagcagagtatctgactggcctcgtgtggtgaacatgaattcatatctaatagtactcgatctttctggttgctctcttacaagtgcaagccaatcattctcacagttaaacctcacaagactcgagaagctcgacctctcctacaataattttaaccaacctttggcatcttgttggttttggaatttgacaagtctcacgtaccttgatcttataatgaacattttgcccggtcagtttccagattcactaggagacatgaaggccctccaggtcttcagattctcgagtaatggtcacagtatcataatgccaaacttgctacaaaacctatgcaatttagaaatcttagaccttggaggcctaagttcctgcaacataacagagcttctcgatagtttgatgcattgcttaaccaaaagaatacggaaactatatttgtgggacaacaatatcactggaactctgccaactggggtgggcaaatttactagtttggacactcttgatctctctcataaccaactgactggatctgttccatatgagattagcatgctgactagtttggctaagatcgacctaagcctcaataacctgacaggtgaaatcacagaggaacacttagctggcttaaagagtttaaaaagcttaaacttgtattataatccctacttgaagattgtgcttggtgatgaatggttaccgccctttagactagaggtggcgagatttggatcttgtcagctaggtccaatgtttccttcgtggcttcaatggatggtgaatattaaagaacttgatatttggagcacaggtataaccgatcaacttccacattggttttggacaacattttctaaggcaacagacttagtcatatcctccaacaatatcagtggtagcttgccagcaaatatggaaaccatgtcactagaaagactctatttaggttcaaatcaaataaccggtgtaataccaatcctgccacctaacctcacctggttggagatccaaaataacatgctatcagggtctgtggcatcaaaaacctttggatcagctccacaactaggttttatggatctatcctccaacaacatcaaaggtcatattccaggttctatctgcgagttgcagcacttgcaatacttgaatttagccaacaatcatttggagggagaatttcctcaatgcattgggatgacagaactacagcattttatcctaaataacaatagcttatccggcaaggtcccgtcttttctgaaaggttgcaagcagctaaagtacctggatctatcacagaataagttccatggaagattgccaagttgaattggaaacttctcagaagtacaaattctaatcctaaacaacaattcgttctctgggcatatcccaaccagcatcaccaatcttgcaaaacttgctcggttgaatctggcaaacaataatatatcaggcgtcttgccttgacagttcacattttcagaggcaaggcgacaaagagaaagcgtcatgttatatatacccttgatacccccatggaagattaatactacagtttgtatgtcggcattgtcgttgaactacttgtatgctatgttaactgcagagaaaagttagatttccatctactacctacagtcttgggcttgtgctagcatttgccgttgtcctttatattgttcccatccatatgttgtttcctctgtaaactactaataagtgttgcttaattattgtaatgaatgtagaccttttctcacttctcattgaaactaaattaagactatggatggtaatgggctgatggctagagaatagatcagcatagcaaattactcggatctcaatacaagcatgaacaaatgagaccattaatacacacggttcagctcctgaagcttcctgagagcaagtttaatatagccaattactagctccaattcatatatagccaatctaatagctcattcatacaatagttacatactacactatcaatacctggtcccacctatcatacacacactgtgtcttggagtccgtgctacaactggctacaaatctgtagcccgctgcccttctctctcctatttatctacttaaaatatgtttgcagctggcttatagcctgctattgtacctgctcttagactgcttacacttaaaaagcagagcagtagacaatttaaagcattagctgcgatgatagcctattaatattgcagttcattgg

SEQ ID NO: 75448 - DNA, 16768 bp, Oryza sativa
tgcacgctgtgttgcgatgagatagtgagccacagacttgtacccaaggctgacaacctgcatgaagggaaaatgcttgcttgctcagaactgttggatagattactacattgtttgtgaaatagagtagtaagcaccatcttacatatcatccattatttagtttcttgtcctaccttgaaagtaggacaagtaccacaaacaaacaaaagtgaacacatgaaattggcattttgtgcttccaaatgtaaatagatcatatcagtaccttcctatacgcagcaccagttggaaaccatcctttcttagttctgcagatactgcaattgcaaatgccacgacaaactggacatatccaatcaggattcttcttagcttcgagcacattctcaccatacctgcattaattataaagtcagtccaaaatggagagctcaatcggtttaggtactagtagtttatgtacagtctatttgtaatcttccagtaactaaaagtgtgtgggaatttactactttccaatatctattgctgatcatttcaacttgatattttaatgcaagcaaaaactaacgggtaggcagttaaaaaaaacactaacaggtaggtgattaccaattcataaaaccctccatgcttgcaataaattcagaagtcaaattttaaaacttgaatactaggaaaccctgttttgattcacaaattaggacacggatattaagaattctgttttgatttgcaaaaacttgaagttagaaaacatatccagatgcaaaaactgagtagttttgttcctgtaacttgaaccctggctcaaaccttcaagttaaaggatacagagatgcaaacataatgtaatagacaaagatggcagagaaggatgtatggaacaatcgattaaaaaaataatagcactaagaaaagatgcatgttcgctacagctatcatatgcaatagtgtgtccacttttttcaggaaaatcattggtcgattgagaaagtatgagaaaagaaaagggccccacctcatgtacaaacaatccccacagaactgcccctggacaatctggcatttacagcagctggtatgatggccaagagttttctgcctgtatcatggaaacatcaaactattatgtcacagtttcacaacatgaacagcatttaacagattcttcagtagaagtaatttaaattgtaaattggcggctacactaacttggtttatttttctcattttgtcattactaagaatgtacactgttccatacagatcctattagtttaatattatagaaggggaaccattgtatatttgtgcacattgtctttcttaaccttacagtaacagtcaatactattacatctaagcaaaggaacctgtagcaaaagtacagctatacaacattgccatatgattcttccagggaaacttaccggcactgatgacaggtttggcccctcacttgatcatagatgcgcttaccatctttcccataaccatccacaaagagagtccagggttccacacaagggcctaaaagtttctcatcctcttccgtgtaaacttcttcctttgatccagcctcgattagaacagagtttccaccttcattgtcgtccttgtcctttttagtccgaatttcacagtagctaacaggctctacgttcttcagcctacattaaaaatggatacagaacaagacgattcttgttaagccattcctatacaaaccatagtaaaggccaagattgaaggaatgcatatgaaccaacagaaacttaaatcaatatatagcttcttgttaacacaagaaagaaattaacacactgcagttttaatttgtggcaaataaactaggtgccagtaaaacatgagaaagccatacactttcatgaacgtaaaaattgtaactgctggttttagtagaatccttaagaggaaaagcatcagttgcaactatcaaccatatgtagcattcgatgattgaatattgtgttaatcacaggattcagtaatgggattatgtttagagagttgcctttttttttccaactacaacgattcatattcaggtaccaagagaggtgcgtgcaagataagaacagcatggtaagcaaagatttgagcatttagtactgacatgagccgtaatgaagttttaacacatgtaagcaagtagcagaaggggatagaaaataattctaacaaaatcgcatgattgatgaactgatgaacaagaactgtaaatgagcctaatcacagcataccgtacaataatttcccaaactatcataatcgaaatgtaacggattattgaaccaaagatacgcatatccaaaagaattgaactgcatgaaagaacatttcctttttttcccgctacatcaatcaaccgcagtccgctcaagcaccgattattacaacaaataaaaaaagaaaaagaaagaatagaactgcataaaagataagtaacagatttccccgcgactaagcatagaaatttctcgatccatcgccaccaatcaaccactcaagcaccaaccatttctgcataaacccccccaaatggaaacttccccccaatagagttaaatcgcccaacccccaaacctgagagaccgacgagcaggcgatggcgaggcgggcttgatcatcctccccacgccgacggaccccggcgtcacggccgccttcctccgcccgcggcctctcccgctcccgctcccggcgaggccgcccgcggactggttgaagcgggtggcgaggtcgagtatccccagcttctgcatccgctccatgttctcccggatcctctccgccctctccctctcgtacccctccgccgcatccgccgccaccaccggcgacgacaacacggggctcctcgccgcctcctccgcagccttcggcggccgccccctccgaccaggcgcattcgccgcggccccccgggtgctcaccatggcttgctagctagctaatacaacttgtcttggttggtgggtcgaagccttctcgctcgccggcggcgaagtcgtcggcggcggtgagccgagggttttagcggcggaggaggaggagaaaagccgcgattgcaacggtcagattttctcgctgcctctccacgcggattttataggcgggggctcaccggggcggtgacccgaccccgctcgccctcttttgcacgcgttcggttacccagcccactcggctacgctcactgacgtatgggccctggattgggtgggtcccaccagtaggtgaggtgatgtgggtgggtacatttgtgcgtgcgcgcacgctgtgtcgcccgtgcgtagtggggtgagtggagaggggggagtagggtggggttcacgtgcgggggtgggttgtgtggcgctcgctgacaggtggggtcaggttagcggcgcgttaactgtggggcccatctgtcagtggaggtggggaacctaccttcgtgtgttcggggtggcgggaatggaaaggtgtgcgcgcgcgggtggccgaagaggcaacctacctgtactaaagtagtagacctacagtggacttgtaaagtacaggcgatggtgtgaattttgggaaattgtttaccagttgccaattgtatctcggttttgtaccgttggaatcgataaactttggaaactactaggatatttggtttttgaaatcgcattgatgcatttctgtgtgtgttgacagctaggacaacctttggtttaagatgatttcttgccgttgatttcaaaaattgccattacaaggtcattaggtggttgcttaattttgatgcctaattgtcaatatttggtaaaattgaaatgtgtaagttgtatttggtttgtttcctttctcaactttttttcttgtaagaggaagattttagaattgcaggtaatggaggctagtttaggcaacttataatttattttggcaacgaacatatcaacactatagctcatttgcaactccgtgtatgcattattttttttatctaatcccaacaaatcccttttttctattttttaatctaatctcaactaatccttactcatgagtaggaattgcaacaccactaatctccgatgagactacaactccgacatcgagaatgcaagaaccgagcaacaaagctactcaaaagcctgccctaacccttttttttcggatcaacttccatatttcccatagcctaatttttcattgataacgcaacacaaataaggttaagacaacaagttatttttaagggagagaggcataccatagagcatgtggtaaaagattagatggtgatgagacaacgacttcttggcaaggatgagaggcgtcatcttcgtcatgacgagcaacaacttctcgatgatggtgagtgccaatatcttggtgaagatgagcggcaacttgtggtgatggatgccgacatagacgaaggggaccttatagctataggtagatttgattaggagaaacatgagagagggggcggcgggtggaaaggagagggagaatagaagagggcattgttgacggaatatatagatgtccattttctgtcgggcctacttgggcttccaaacgataaaccataagatccaagccctgataggtgtattggccatcgaccgtttacgctttgttggaatgactagcccataaaaattgataaagcccaaattatgtacacaacatgggtgttatgtgctaaaacgagtattagctaagtagtggttgtatgacttcacctattcagattcagatccatattgaccacaaatattacatacacgtgatatgctttcaacgtaattttattgaggttagcaatttttcttttggaatgctagggaacatcaccggcctctacctgcatccccgcatggtatgttccctcgtgtgagggattcgctaccatgatctatgcatcctagtttaacacacacttcttatgcttatcatcgtcgcctttgtagctggtggcaaagttgccatgcagccaaccgtagaaggtatatttttccatgtactcgtagatgagcacgttgtcgtgtcatcgctgtcgttttggctgctccaaagatgaggatcttaacatggtggcagtgatagacgcgggcgaggagcatgccgatgtccatgtgcatgatccgctagttggacatatctcacccatctcgcccgtggatagttcatcgactgctctgccagagccgatgacaaactggtcgcttggattttccgttgtcttcgatcacctctgcctagaactttcgtcgtgtcgaccccttcaccacaaactatcgggcattcgtattgttgcttgcccatgcgaaatgagaatgtcgtgcagttcaccttcctagactgctgcttgctacccccacactatcatgaacaccaatgcaaccatcattgagcacccccatagcatagttgggtggcttcgacctgggctccaatgaggaagccgtgttcgaggtgtcaatgggggtggtcagggactcatgtggccacggtagggcaactccttcaacactcgtgggcatagctgtagtgcaatgggcgcgacggtgaggtaccacaatagagcatgtgtttttgaatatagacgtggtactcacatgtattagagcatgtacccacctagcacctatcacccacaggcatgagacctggtatcataatataatgctcgaaacaggttcctacctactacttttgtttcaggttataagactttctagcattgcccatattcatatagatatcaatgaatttaggcacacatatatgtctaaattcattaatatatatatgaatgtggataatgctagaaagtctaataatatgaaacggaggaagtaacaagttaacaacaaccatcgcttgtttttttctttggcatgttaatgggggcacactatattcacctgtgcgcgcgtacttgtaccgatgttcactagatttggcagcattttctttgctgataattctttttccggattccacccccatttaccttgttttctttttactgccaatatttttgggaaaatccatctgtttccagttttgtgaccgaattatgatgcaaaatttccacagggttagttatgcgaattatgcacaaacacatttaaaatcagtatccaattaccgttattacacttatgggttatctgaatatctgattccaattaccaaagcttttagaaacggcccatttactaacccgtccagtgaaagcccaatcacagtcatgggctgcgccattagcccattattcatgtgaatacttctattcacagggaccactacgtaaaagtcacacctaggttttcacctcgccgtcccactcccacccacgccgccgccaccgccgccgccgccgccgcttcactcgccggagcgccatctctagccgccgccgccgtcctccccctgagaaagcgtcgattccgtccgggggtgggcagcggtgggactcgtatccggacggccgcagattcgttgagcgacccgcgctgctggttagtccaaaacctttttacctgagcccctaggtttgatggttcttgatctggagaagtttaggggagaaatatggctgcgatcaaggattgcagcctccgcatttgctctcgcaagaaggtggggagtagtagggcggattttaggggcgattttgcaacacgtgtgagattgatttttttcccctgttaccgacggaactgtgactgtttcatttgaagttattgcattatctcgagtgaaaattcttgttccagtgcaggaatttagatgaactgcacaagctggccacgttagccatgtgatggtgatattggtttgatctttgtggacttgcttagtccaatcaggatctgactgtgttcataaatgtagtgttggtgaattgtattctccattatgtctggaggcgaattacttagtctgtacatgcaactggcaggaattgattcgttaatagttaccaaaaacctggatagattggatgggcattggttaccagagctcataatgaccaaattggcttcctcagataactttgtacgaacactgcccgtacctgttcctgatggcatttcattatcaataaattccatccttcttgtatgttgaccaaaaagatgtaaggccgctatcttgatttgtgtagtcatggttttttcagttgggcggtcatcccgaccgattaaattgttccaaattagtagctggttgtttctttgatttgtaagccatgttggttctttctgaattaatagttggttttcccgcaaaaaaaaagaattaatagttggttatttctttgatttgtaatccaggtttgttctttatttagaaagcgttaaacctctattaggagagtgtagtatatgcaaggcatataaaattctttacgtttctattgccgtttctggaaatgttacggtagctctattccgcatatgcttcctaaccattggtcatactattgtgtgctacagtattttgtttgccacatgttgggtgttgcccttgtatttatatgacatccatattgcccttgctttgattgaattgacagatggtagctactaccctgctttccctcgaggaactaatccaccgagagtcgtgtgttcccgtgattccgtaatattttagaatattgtggaattagagaaaataatgttaattgttattaaatcataataactggcagttagtgtaaaagtttgtactgtttatgccatatcattactcttgcatgtttttttatatgttgacgaatatgctaaaaatatgcagtttttcattctgcaggttttagtcttgttggcatccttctgttaaggaaaatggcaagcaaagcaggtggtgacggcaaagaagccatcaatgagcaaataattgcaaacacttatgggaacatgcggtctgaaatgactcaactttacaccaagattacagaattagagatggaagtcagtgaacactctcttgtgattggcgcaatcgagccactggatcactcaaggcgctgctacagaatggttggtggcgtcctggttgaaaggaccatcagggaagtcttgcctgcggtgcatcgcaacaaggagggccttgaagaggtaatcgctcgcatgcatgaagcactggagaagaaaaagaaggagatcaccgagtttgagctgaagtacaagatcaggatccggaaggcggacagcaacgctgatgaggaagaaggcagcaagaaggaagggtctgctcagggtgttcttgttggtcctgctggccagtgaagcaaaatgtcaagcttgcatactggtttttcctagagattatgaaagttaggttgctctttgctagatgtcaactgatttcggtctctctttctatctgtgtgtgaagtatactactattcttctgtggaaccgtggaatccgttccatgtacaattgaatgctatctggctatgctagttgataacttcggtcataactgcaggttttgtgcaggtattctaggtgagaactttggtaagattttgtgcaggttgcaacatgatttgttcatctttggatgcccatctgttctggtgtttgccatatgctccacacttttctgcttcaccatggcatgtttttgaaatttaacttaatccaattgcattttgtaagcaattcttttgtacatcctccatgcaaagctatccatataggaggttgcaaatcctctagcacgaaactcatgggagaacggaagttcacaagaaaacagtacaaggccaggctgctatatgttgaccaattactgataatacgtccaattatacgtcaaatggcgtattagcgacaaaaatataatttatggttaaaattttacatgtgttttttcatgacttgaacgccatgttaaaaaagaaactattacaaagaaaaaaaaatcaaaaaccaactctaaaattaagttttaagattcaaattttggtatctgtatataagttgtagggcaaaaagatgtagcagcaaaatccctttgaaattgaaattcatgcttcccaaacatgggcctaaattcgttcacaatctgatccaatcggcctctgtctcgtcggcctcccctcccctcccctctccccccaaaaccccacctcgccggaaaccctagagaaacccacgagatggcctccggcgagggcaagccgaaccccggcggcggcggcggcgtggtggccaaggggaggaagcggaagtacctcccccacgggaagccggtgaggaagggggcgtacccgctgcgccccggggtgcagggcttcttcctcacctgcgacggcggccgcgagcgccaggccacccgcgaggccctctccctgctcgactccgtaagctgctgatacgctggttcacttcccttcctccgccatctgcggctatggtgctctacactgctggtccgcgcgggttcgccggctcagtgtttgctcgtggtggtagctagaactcatcacttcggcgtttcgctagtcctattgtttcaaaaatctcgtgctggagcttgtggtgacttggatgttttgaaaattcaattagcagggacaggatttggagatgttaaatgttagcgttgtgttgtgttcattgggttcctctgttgtgatgatgtagttcatatgcttgtttaatttaccgcttaatgctgcaccctttgaacacattaagtaatgactgaaatgagaaattgatagtcgccgcgctggatgttggcttgtttgctagtcatatgtttgggattttctggctgtagagcttgcatgggcttatgctcttcttttttttttttcgagaaaatatacctcatgtgtgatactcaaattgttggatctgcagttctatgaagatctggtggatgggaaaggatcagatgggaagcccaaaagcatccctgataaaccattgaacaaaaaaattacgtttgcggattccgattcttcggatgatgaggaagaagatcattcaggggaggtgactgatgacacaaacaatgcagacaaaggtgaaaccacaccttctgagcagcagaaagaggtgtctgacacccctgtagttcccagcaaggacaatgaggaacaaacagataatgctgatgaatcaaaactaaagaagcagcgcgtacaagatcctccgatatctgaacagacagaaccaaaagagcctactgataagccaacagagtccactgataaaccaaaagggtccaatgataaacccattgatgatttgattgatgaggatttgaaggagcttggggataggaaaaaggtttgtttgaagttacttgctttctgcacaccctttttccccttatcactgaaatgtttgtttttgttttaaatattggcaaagcttagaatgttgtgattaactactctcttgatcaataattgaaattcttgctcagatactaaatttggaagttcacttgtagtagataaagggttttcaacaactaacatcttcaaaagtcaaacatgtatttagctattcattcattgatacttggttttattttggtcatgtgatgacattattgtgaacctatctggagctgtttaagtacattaaaggaatttttagtaacaaatttttttattaggagtccaatttgatgagtgacatgtattacatttcactatggtcaacaattagtgtgaatttggaggtgatgctgtattgagattattacctagcatgccaattgttcctcccaaacaatcccttaatacatgaaaacgatataaaatgatcaattccaagatatcctttttcccacaatggtttatgtactaacttatatgatgaaaacgattgtatgtcaaacagaggctcttcgcaacccttgattcaggctgcaacggttgcatcttcattcaaatgcacaaaagagatggagaccctggtccagttgagatcgtacagaatatgatgtcatcagctgcttcaactcgtaaacatatgtccaggttcagatttggttatgttgcaatctttgcatagatatactaggcagttattttcttgttttcagactttcctttttaatgcatgctagatttattctgaggtttttgcccactgaggtgacatgttatgcatcagaagaggaaataacaaaagcaattagtccacttgttgaaaagtactttccaaaggaatcttcttcggtatataaggtaactttctggcctaatttctatgttgatgttttcaatgtaatcttttagggacttagattcttagggaaactaagatctattataaaactgtaagagaagataggcatgttgccaggtcattttgtctatggtagctttattcatatttcgtgttgtccaattagaagacgtttctaaacttcattggagaggaattgttgttacttcaatgtgaattcaaccatcttaagtaaaaccagtcatgttgttacttcaatgtgaattcaactatcttaggtaaaaccagtcatcatgtataattgtgtgttaagtgttaacaccaggtgtcctttccatttaataaatggaacaatttagcacatggtaataaggctatgtacttatatatttgtatgatcatgtcagctgtaataagtcaatcgaatagcagtattactttttgttgattggataataatttgtaaatgatgagtcattagtttatcaccatttcccagttatccttcatagaagggatccaacaatattttatgatatttattccccttctccacccaatataaagtatatctgacattcaccacaccttgtggccatgttgcaatagctgatagtagtaataagaaaatataaatcaaattacctctattttgttttgctatacaaaattacatttctttacttggaggtttttaatctttgcagtttgctgtgttatatgaagcaaggtcgaacacaggtattgataggatgaaaattatcaacgcggtagcaaaatctgtacctcaacctcacaaggttgatctcagcagtccagacaggactattattgtccagatagctaaggtaaatgattttatcctgaatgcacttatgacgttattgtccgtaatgcatatgaactgttctgttagaaaaccatgcttatatcctatgattttcaccgaaaatccattgaatcagttgcttattcaaatgaaaactacatggatggctaaaactctgtaacatatcaggttaatgctgtaagaaccaattttgttaagcttttgaatcagttgctctgtcacacttcatgtagttgtagtgaaagcttttttgggtccaagggtgcaaatgggcaggcccgggaacccacttatagtacaaataccgctgggttacccgcttatttgtactataagtgggttcgtgggcctgtccacttgcacccttatttgggccccacagattttgaacaaaaatacctatcttgattgcatttaactagtaatatgcccgtgctaacgctacgtgacatctcacaacaacatcacaatgatactttgacaggaaaaaaattctgtacaaaaatcatgcttgatttcattgttatattttcttttgtataacagaacaccatattaatatgcattcaagcaattaacataaaagcccgagtacggtctgatataggttaacatgtaatactttacgaacaggaaattaaacatacacagtttgaaattcgaaacagtagtgatgtatatgtcttgactttttagattatacacagaatttgtgtagtattttatacaattattggttagatattgctttgaagaaaaacacgcatattttaatgataaataaattgaatagaccatgcaattcttattcaatagaacatatgcatcatgggttaatcccatctctgtagagcaggtcatcaaggcatacaaatacaaaaatatgaattaatattcattgacaaacgtaactaaaatctgattactgtgtctgcttggtgcctatgctttcttgcgctgcgatatcatcatgtccctcttctctaccttgaggataacaaaatccatttgttcctccttgaaaaataataaacaaggtcatgataaaaaagaacatgatcacaactgccagtaaacagatgaacaaaaataaaaaagatcatgcaaaacttacatctccaactgtatagctgtatcacctatgaagcacttaatgtctttattaacagcacgaataagatggattccagtgtaacattggatatgctgtacaattcttctatgaatcaatgatagttgcaacctggctgtgtgtgttagtatcagatctatgcaattagtctacaagaattacattattaggtggcaggacaagaagcactgttatatgtcgattgtcaaggacattcacattcatttgaagagtttccattaacctaaaacaggaaatgaaaccattgtatcgtatacccagccataccttttacctcttccaagccccacagcgttgatggagctgttcgattaaccagccagcacaagtacatcttattgatatgtttttcttcgactccaaattttatcttccttgttttccgttagcacacaattcaaactactaaacggtgagttttttgtaaaaaaatatagaagatatttgaaaaatcaaataaatccattttcaagtttataatggttaatacttaattaattatgtgctaatgagctttcttgctttacgcgcgtgaaaaatctttcttcaaactcaacaaaagaacgcaaccttatctcaagggatccaactgaacctatatggtctgattcactgtgcacccaaattaagaaatataaaccgagtacgtggtcaatatatatccacgaaaacactgaacatcttgaactaaacagatacttgaatagaaaatgcaacggccagctttgacttgaatctctcctctgaatgggatacttgaatagaggcaatgaccagcggttcattatttcctgaaacatataacaactgggttagaaattgttcctcatacccaataacctgaggacctcaaagacataacctgcaacattctcttctatcagattgaaatggaagatcaattaaaatgtccctgtttgtactatatattagtagatagcaaagatcctttgacaacatcagcaaatagaactacaagagaagcatttagtggagcataatcttctgcttcagtagaaatgattgaactcatatcactaagcaatgaaaatgtcaaatgccccttctttgctaaataaagcaaggactaaggagcactgctgcggtataacaacaagcatcattatgcatcctatcaagtatagagaaagttagtgacaatttagttttcaacattgatgagctgtttcataattatatcaaaaataaatgaaaaattattagtacagataatatggatatattatgacttactataagaaaatctaccagtaaaaatattttaagatacttgatcaacctttcaaaatattttcctccctcaacgagcacttgaactactgaaagccgagagctgtcctaagcatccatgccaattttagaactctaaagatttgtacacatccaactaaagaaattgtgcagttgtatataactttactttagtgagctatctgttagttctctcagaccacaaccttttcaaaccatgaagggcattcaacaggtggtgtggtcaaggcagcatactatatctaacactccaatactccatcctccactataactgacctcactcggtgattaaactttcgttttccagcaaaatttcagaatttcggtggccaccaaaatttccaaaaattcaggattttggtactttttgttcgaaattatttaaaaaattgacaaattttgaatgaatttgaataaattttgaccaaattaacaaaaaaaaatatcaggcaatatatgtgcttgccagtggggagccactgggtagctaaattaccaaaattgcaatccctgacctcaccaacacccatgtcctcacacagtaccatgtcaaatgcacagattttcggagagaatcaacagggagtgtgttttggtaggtgtatagcgtggggtgcttgagaaaggagccagaggagaggacgcaaacaagaagcaaacctgaaggcgtggatgaagttttgagtcaagagcataatgtttaatgtaatgaacataatgtttactgcaatgggatttcaattgtctgaacataatctttctagctatcagtctcagtccggaagtgtgcaagaacagcagcatatgcatagagaaagtggataaattctggtaccaagaccaacatccattatataccacttctgttcatggaccacagccactcagcaagaaccaatttatctacccccaaaaattagcttcaaaggaaccagtagcttgtgcaagtttgaaaatcaagtgtggcattactatcagcatggcatgatatggatagtgtaaagacatgaaaatggaacagttaaacaagagatgttatttggtgttatgcatgagaatagaccacttatacctactggagaagctatagggaaaaaaatactaacatattttagacccaaagatagtgcacggtgtatcttgaaacatgtgaaagccaatgaaacatctttcaatagaacatagaaaactggtgaatgatccaagtaaatgaaacatctttgcaatttgcagtatctagtgattcagacgatcgcacccaaactttaatttcagaagcatgtacatatcaaatataaagaatagaaaactggttaatgctccaagtaaatgaaacatctttgtaatttgcagtatcaagtgattcggacgatagcacccaaactcatgtacatatcagatgtaaagaaccacaagcatctgccatagtttagtttccgcagtatgcaattgaaacttaaagaaggaaactacttcggagtttctaagattgtgtcatcttcaaagctacattatggctatcagccaccatcgcatatcaaaactcaacataagtaaaataattagctccaaacagatttacctattctcctcagagtgagggagcaccgaaaggaacttcgctggaacagcaagacctgcccacatgcataaggccaaccccaggagcaattgcatcatcacctgcataatcaaaagcataaattatgcaacgcaaagacaccccaaggcctaatttatcgaatttggagcgaagttggttgatgccaagtagccagtaaaacaagcagctagatcagagaacaaccagcatcaaatttggaaccgggtcgcatgtaattatgtaaacatacagtgcaactcatacacaatgaaccgcaatttcaacctatgactggccaaggccaatttggcgggaatagattgcttaaagcacattcagtgatagtatcaaacaattttctcctgtcaaacaacctaaatcactcttttctttttgtttttgtcatctgtaaactttagtttacacaattcatggccatcatctaccctaccccaaatctcactttcaaatcaagcaacccaaatactacatgttttgatcacagctttacgcaacagaaaatcaaccattcataccccgaaaaaaaaagaaagtatcacgaagggataaggggaaacacttacatccataggcggactcaagaactccta

SEQ ID NO: 75449 - DNA, 897 bp, Oryza sativa
aaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcattacggaaaactgtgcgatgcgagcggttgctgcggcggggttgctcaacctctgcgttgcgggaaacagtacggtgcgaacggttgctgtggtgagactgctcattagctgattcatgattttcttctggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacgactgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacac

SEQ ID NO: 75450 - DNA, 6218 bp, Oryza sativa
agacgttggttggcacttggcaggaactggtatgaagcaacactatctgtggctcatttcttctgtttctccacccaaattcaacggaccttgttccaaattccaatgagatgaagaaaattagtagtatatttctttgtttccctcgtgtgttttgtcattttccagtaaggtgatgtgtgatactatctggatattcctaccctcatggtaaaactgattttgcattgccatctcaaggtttgattcttcttgtttcggtcaatcctacatcacatttatcacactgaaccttgcttagacagcctgtaagtaagcaatcatccactggatctatgattatgcatgcatctagctatctttaggccaactcccttagttgtttgagtttgaccattcacattatctcttcggttctataattctccaccttttggacaaggttaagatcaaacttttgtaactttaactattaacaactttaaagctatttagtttagaggcattagaataatatatgtagatttatcttataaaatactacaatgaaagtgaaatttatcaattcattgtatatattataatagaaaaacatagtcaaagatatattttaaacaccgtgttattattcaaaacgttaagaattatgaaagaagagcgagtagctgcaagaggcactagctaagctataaaccaaacagtgcacgcttccattgccatctgaaaacggcatgcttttgactaatcgtggagcgaagacaacaacaattgttcagaagcggtgggtgtgttcttttggagggttgcctgccatccgcacgaaaaacggtgcgatagattaacacgtgattaattaagtattagctataaaaaaattaaaaatgaattaatatgattttaaaataacttttctatataaactttttgtaaaacatgcaccgttcatcagtttaaaaagcgtgcacacggaaaacgggagatgggttgggaacccattggaaagaagacagcctgtggcatcttcctcttcttgttgtcatcttttatcaatgcaggaagatacaatctagaactgataacggcatgcacaacagtccaggcatcaataacatcaagtacaactatgtaatgacgtacttgtacctaagtagaaacgatgatcccaatctcgtgtacttcccatgacagttccctaacatcggtatctaagcaagattagctcatctctccagctgtactattttttttaaagatctaccctctaggatgtaatgagtgatgactcaaaagtgctagtctggttgatgactcaaccagcgtccttttatttcgagctgtagtcagtgtccttcacgaaaggagaaacgaagcagaggacacaaagtttagttcagatttcttggtcgtggcttattttccccccattttttccttctttttcttaagaagaaaaactaactctgcagtgagaacgcaaatatgctcgtgggccccattcagagaagcagtgacgatcgagatgacgaaattaacgaaaacgaaaggatacgagagaccgtttcgcgtgcgggcttgtggcactggcacctagtacgcgcgcaacgatggtcacagccttacatttacatctccgggcattttcacgggagggtcgcgccatcgcggcccctatcgatcgatcgcccccccggcgcttgcgtggcgtagtggtgcgagcgtccgcgagaaactatctgcgcggtgtcgcggagaaaaacgccagcgtcaaccactgccatccggcgactgttggcgaaccgtgcatgtgtgtgcagttgtcccggccgttgatggcggacggggagtcctcaacaagcggtgaggtaggacgcgacgcaggacgtgaggaaacgcgcaggagatgtgctgtttcgtgatcacgcctgctgagctgacgacgcggggggaaaggggcggcacacggtggcgtgcaaaagcggcacggcgaggacagcatgctccaactaccactgccggtaccagatcgagcgtggaggtgcaagtacggatgagggttgtacgggttcgtacaaggtacagcggccgttgatgttcctagttttcccaccttccagggggaaggtctcacaatggcacacgcctccaagcatccccagtccacggtgtaggcagtctggtgagtggtgagtaccaggcgtggcagaaaattgaactgcgtgactgactgctgatgagtcatgacaaatttccaagcaaacgacgggtgtcatagctcacaggtcgactgcaggggatttgggggccattttttttctctcttttgagaacaggaaatttgggtgtagtccagtagtgaaagttgaacgtcagattcattgtttctgatgttttgttctagcgcgagagttctttggtgattagttgctctccagctagattcatctgggagaaaatgggaaattcatcaacaccatgatcgatccgtccaagttggatttgtaaacaacatcggaactaaaaagctaaaaaaagacaactgttactccgttaatgattccaagatgatcccggcacgcacatgtcgagaaaaaaattagcctctaaatgactagctaaatccatggagaaacagagaaccgaacaagagaacaaaatcagcccattctgatggaacgcatatttacaccatccccatccgccgcctgatgctaccacctgccgaacgccttcttcccggcggccgccacggcggcggcgcgctcgaaccgcgacgcggcgcaggggatggtgatgccgccggggtgctggaagccgaactcctcctcggcctccctcagaagctccccgaacatggggtggttgaagtacaccaccggcaccacgtacctcagcgactcgccggggttgccgccgccgacgtacaccgccacctgccccttgggcgtcgacacgggctcgtccagaatccgccgccgcccgccgtccttccgcccgaggctcagccgccgcaccagcgaccgcccccaccgcagcaccggggccagcctcttggcttcttcgctcccctccttgcaagcgccgccgcacccacccgacgtcgtctgcaggcgcaggtagccccgccggcgccggcgccggcagcagagcgcccatcgccaggcactgagcagcttccgccccagccggaaccctccatgcgaccgctttagcatatccaaaccccaagaaaccgcttccaccttcctacgtgggtgagttgaatggactttgggaggagtggcgagccagaacgggaggaagtgggagcgcggtgaggctagagaaacgagtgttttatagggcacgggcgcggaccgcggagcgcacaactgagcgtgtgatctcgattaaaaatttttaaaaagcattaaaaaattaaaaaaaaaaagctgatgccatttgcgttccgcttgttttttggcgtttggccacaggctaagattcgtgcgaggattttggctaggatttaccggggtttctggtggttcaggcggcgtttgttcggtaatggctggtgtggctgcgcgcgggcggtggtccatgattccttgggctaagctggacagtgagagctcgcccgcccgacccgttcggctacgctgctttcttcgctttccgcgactactggcgtgatagactcacgtacttaaaaattgagttggataaatgccttcaacttgtatatctccttgcaatctagcaagagtttggcacccagcacaaaagcgtctttgagatttcagcatacgtagctcctggtcgacgtcagtccccaacaggaaggggtttagaagcagtctttgctgtgaagttcccacaatatcgggtttgtttcggaacaacagagaaatgcttccaggttaggtctaggaatgtcgcgatactgccgtgcagtttagattgtagtagctgctactggctgtacgtggcacactgttatgcattgatacgaaactattctggcatattgttaggggctctcaagaacacgcttcacaattcacgaatttagtggcaatatttgttacttctcagatccaacaggaccgagccgccgccgccaacgcctccagatgccaattcccgaattgttctagtgttgttcgtttgatttattacaaccaacccactctctctctccggcgccagctcacaagcgagctgataccttacgccacccactctggaccgtggaccttcggattgggccttctctcacggactggacgccgagttgcaacccaggcttgattgtcacctgaagtctggatcacctcctccttatcttctctgctaccagcttcatcagcaacttcaggacggcttccttcttcttcttctggttcttctgcagttgagccttgcgagatatctcctggatgatcttgagagtccctgacaagcccctctccttgagaattggcttgcccccaagccaatgctgcgggaaaccttgagcgaagatcgtccagatcttcccaagtagcgtcctctggaacagatgcagaccactgaataagaacttgagcaacagcagaattacctcgttttgttaacctcctgtccaagatacgcaatggaacttgtaaaggagcagtggatgccggcaattgatgttgaaccgggcctgtaaaaccaattgcggatttcaattgagatacatgaaaaactggatgtatagaagtagaagaaggcaattgcaactgataagccacagtgccaatcttggctgtaacttggtagggtccaaagtacttaaaagccaacttatgatttgctcgcacagccacagaagtttgcacataaggctgtaacttaagatatacccagtcgcctacttcaaaggaacgaaaactccgcttcttatctgcaaagtgcttcatctgctgctgtgctcggtggagatgttgctgaaccaaattctgcatcaatcttctttctttcaaccactgagctagatcaggaatggcacaatcttgcgacccaataccaaagtggctaggagaatggccatataagacttcaaaaggagtagcttgcactgaagaatggaaagaagtgttataccaatactcagcaagatgcagccaagcagcccatttagtgggaaccgaatgaacaaaacatcgaagataaatttccaggcactggttgacacgttcggtctgaccatcagactgaggatggtaagctgagctaaagtgtaatttagtaccagccccttcaaagagatgctcccataactgacttgtgaaaaccttatccctatccgaaatgattaccaaaggaaggccatgcaacttaaaaatgtgcttcataaacaacttagcaacactcagtgcagtaaatggatgggataagggcaggaaatgagcatacttagaaaatttgtctaccacaacgagaatacagttagaatgatcagaccttggcaacccttcaataaagtcgagtgaaataacttgccaagcaccctcaggtacaggtagaggctgcaaaagccctgggtatcttgccctgtcaggcttggcttgtaagcatatctgacattgctgcacaaaggtcttagtcattttcttcatcttgggccatgcaaatagctgcttcagttttctgtatgtaactgggaacccagagtgaccaccaattggactggaatgtaattcagttaaaagcttggactgtagtgtaggattatcaccaatccagactctgcccttaaatctgattagaccagaattgagtgtaaaatgtttcctgccggtggcattaacagctaattcagtaagcaattgagtggaaaaagggtcttgtttataaccatcagtaacttcctgaatccaagtgagagtacaggctgaaatatgacagagttcatcttcagtatcttggaatttccttgacagagcatcagcaggcccattacatgtacccttccgataacaaattctataagagagacccaagagtttagtgaaggccttgtgctgccatggagtatgcaatctctgatctgagaggtgcataagactgtggtggtctgttagaataatgaattcacccatttgtagatacgatctccaatgatcaattgccatgagcattgccatacactccttttcataagtggataaacccttggttcggggaccaagtgtagcgcccgttccgtcgtggcg

SEQ ID NO: 75451 - DNA, 18135 bp, Oryza sativa
ctcaccacctcccctccctttcccctctctttcccatccccggagtcgccgcctctttggaagctgccgccgccgttgagttgacgcgccccgccgccgcgctgtgccttgtcgccgcaccgtgccccgccgtcgaccccaccaccggtccggtgagcctcagcctccccctcccccaccgcttgtcgtcgcgccgcgctgtccgccggttccagccgagccacgagagagaggaagcagagaggtagcagagagagagaagagaatagagaagagaggttagagtgggccccacgtgattagtaaatagtaatccgctttttaatctttattagttaagtatattacataggtccaggtggttagaaatctgattatggaaggtttatagtttcgagtctatgacatgtgggccccacttgtcattagctcatcctatttccctttagaaaattaattcggtggaaaataaagtaaaggtttgaccccacgtgtcagcagctgttagtgttaagaacaaacttcggattaaaaataaatcatttatgaacagtagcttttcacaatttctcggattaattcaaatttgaatctttacactagcataacttattcattttaactcggatttgagtgaaacttgaacctaaattcatctaaattcataagctttccaatgatatataattcactatttaataaaatatatttataattataaattaattaatatcaaatgattagataattgttaacctaaatagtgtgccaataaataaaaatggatattgtacagtagcataattatctttaatatgtcttgtcactgtagcaaccacataaattagttataatcaatccttcaaattaatgggtgtataggaaaatattagtgccatttactagtctatgtccaaatataactaaatccatgacttataaattatttacaaaaagtttagcctcatattttgtaactaaaatataaacacacatagatgaatatttaacttgtttaggagagtaatcacagagctagttgtatttggaccacttaaaaattagtcgatacaatgtcatgtgaagtagaatatatatatatagtcggttgatatccattagttaaccaaacagagccatcttaaaatcaacatgtattgtatagcttacagtaaaaagcaactactcaaatatatgatccaataataagatattgttgcttacacatatactatacatcccattatagttgtacggtatagtattaatttgcgtgttgcatatattaaattagagggagtatatgacaaacatgtatattagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataataaatccatctaacaacagaacctctggtatgtaaccgtgctatttagatagatgcatatatagtcataatccttccatagccatttgatagactaaaccaccgattagccaaatatatatgtataccataaatgccatgttggttaactcctaaatagaccacgatgacaatagaaagattaagaaactttagcccttagcatgattggaatccattagcaaacacgaatagtatattttgttgcgcatatttgattgttgtttgaatattggtttttctcgcgtattatagaccttgtgtatcggttagtcgtgaggcaacgtctgcaatttccaggaggtgaaggttgatcaagattatatcaataataaggattattctgagcaggcaagtcatcactattccttgaacatgttgatcccaattgcgaaattatttttatttacaaataagattgcatgcaatgatgaacatcctatttttgaatatgccatgccttgattattgtttacccttattcccttgtaaccatgattacgtatgagtccctagtcaactatgacaaatgcttagaaatgctactctagaatcatgcatactcatatttatcaaatgctatatgcttgggcaattacctttgggaaggtattgagatgcggcatgtggagacatgagcgccacattgccatgatgttgatgatatgatttgtgaaaggagaaataaaattaaacaattgttttcgactggggcagacggaggatttgggtggtatccggaaaaggctagtaccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcatccattggtagaaccgcgaggcgggtatctacagtggtgtcgccatcggtaggactgccatgtgagaatttaaacataattataacttaatgcatgtatgagtctttccttcccgggtgcgccagaactcctctcactgctagaaaccgtgtacgcctatagtgcatgaggatataaagttcatggagcgggtactgccaatgcgaggttatcgaaaagctttgccgtaatgcgtctcatgtgtagggacgaggctcatgtgttgggcagtcgcggagcgcgggtaaagtgtacatccactgcagtgtgagtaaaccaaatctattcgaatagccgtgctcgcggttattgagcaccgggacgtgtattacacttggctagactcaaaattcttaacttgtgtgggatgggataatgcatgatgatttttatgctgttggacccacttcctgagaggcgggaaggtggacgtcctcagaaaaccatgactactcaatggcgggaagctatccttgggatcacaatggatggtggacagaaccgtcgttgtttaatgtgaacactggtattaaaatttgatcagtctatgctaggtcttagacttgtgaaaagatttgcaaaacttgctttgcgcaaaggaacctgaagccattccttgacataccctctatcatatgcatcgttactgtggtggcttgctgagtacggttggtactcacccttgctatttatatatcttttaggcgagtgttgaagagaagcccttgtcgatacgcttgcgtatccaacaagatgatcggagtgcggtcttgttctaggtctcgttccccagtcgactgcctgtggcatgttaaccgggcccttatattattttgtcttccgcagttgttctctgatagttgttggcctacctagccctaatgtaagtatttaactcttttagcttgaattcattcatgatatgttgtgattcaactatgtatgtgtgtaccaactactgatccagggattggtacgaataaacacagatgatttccgatttccaaaatcgggggtctacagttagattgtaaataggaaagcatgctcatcacctttcttcaaaataataaagatatctttgcgtggaaaccatctaatattttcacgcccagaaattcacgaaccagaatttctaagctgaatgtgtattagacccctatccaggactagccagggtacacaaacgacaattgttgacatacagatccacgtcttacaaaaatagaaaagattacaaatgctgcagaaaagataaaagcgagctaagcctaaagacttgactcctgcagcgagcgattccattccacaggcatccttgacagcagcgacgaaaccaacttcttcgagacatctccaactgagaaggacttcaactctggtgttgggggaaaagagagcaagactgagtactacccactgtactcagcaagtcatactggaagagaaggtatgatgcagggtataaccaaaggaggctagaggttcatttgcacaaagcaggcatttaaaagcagtagttaaaagcagtaaaacaattgtagtaatagatcaatattaaccaatcactgtccaacgctacaccacgttgcaacaggcccaaccaaccacctgaactacaccagttcaatagctaactaggggtgagactaatcacggtgaatctggtcgaccgcccataaccgcgggcacggctattcgaatagttttactctgatcagaggtgtacaactgtacccacaagacacagccccatgacacgtttccgtgcaccgacatgccaccacaacataccggaaagaggccgtgacaggacccttcgcataaccccctctaaccgatcgcaccacacctcagggttcgcccccgttcccagcaggcaacgggcagcccctctctcgtgccgcggtgaatccggaagccgatcaaccggacaccccggccgacccaactccatcacacccaccctcgcctgggtacgtcggccacaggaaagctacactacaagcccagccgttgcccacgctggcttgtggtaagtacgataagttcttccagggcattccgcgaaccggtccttaatcgccatgggcatgactagcaaaaccatgcacccacagtccactaggtagtgtattttaattaactaacaccattgcggtggcactaatctaaagctatgccaataatcaatgtctatgctttaatgtgatcccgctttgtggtctagtagaactaagcatggctaagcatttcctaaaccatctagtcattttaatacccaagttaaacaatatatggctgagtagtaggacccatcaaacatgatattgtaaaagaatgcaacatttaatagaaatgcgggacatttgtaaattgggtacaatatgatcaattgtaatgcatgacttgccttgctcttgcactagtgagaccacaacgacgtcttcgagaaaccgcggatcgacggaacggtcgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattatctgtgtttctactattaaagaaaagtcttattgatttattgcgcaataaagcatcccaggctgacgtcacccaaggggggggtggcgccgacatgcgggacccacgggtcagtgacacaagaggaggaggaggtgacctggcgggtgggtcccaccaggcagcggtccaagggaggggaggtggcgcctggctcggctcggctcggctccaaaccggcaggccatggaggggcggcggcgcgcgcagagctggcggcggcatgcggttgccggcgacggcgaccgtcggcgggaggcagcggcggccggcacgaaggcggcggcgcggcaaagagagagagagagggagggaaagggagggagaccgatcctcaccgaggggctcggccggcgcgggggaggagcgacggtgaacgatgacgatgagtgacgggaggacgacgacgatgggcggacgtgcttcgggaccacctaggggacaaaatgggagggattagagggagaagggtggtctacggcgagcggattcgcccggcgaaggcggcggccatggtggtgctcaccggcacgcgaggagaacggagctatggcgacgatttgcgtcaaccgagtgttggacggggtagccctcgcaacggcgaagctagtggcggtggttgcgcggcgtggcgacaatgctagcggtggcggcgcgcggccggagagtggcggcagcggcggcgctaggggagagcggcgcggcggcgatagaggcctcgggagagagcggcgacaaaaggaaaaagatagaggggggtgcggaggacctttataggggctcggtaggagcggacgtggccggggggcacccgattttcgccggcaacgtgggaggcggagagagagagagagtagggggattcaaaccgaatctcgccctttttgggtgcacggcgcgggcgggaaggcgaggccgtgggcggcgacgtggcgtggggtggggcgcggggtggagcgccagaggagcggcgaaagcggcgatgtgggcggcggttttggcggcggttgccgccgggctggaggtaggggaaaggactgacaggtgagccccacctgtcagagcccgggggagtgaggggaggcggcctggactttgggagggagcggtagagataggccggcggcccatgatgaaaggagagggagggaaaaaaaaggagaaaaagaaggggaaaaggaaaaaggggattttctggggattctttaatgcttgtgctcctttttaattggttaaaattatttcttgggctctgaaaattccactaaagatcctgttagcatattctgacatgtagaatccaagaaaaattcaacaagccaattccgattattatttgcatttattaatttagggattcaactctaggttaaattaaacaatttcttcggacgatttattttatgaactttaaagcaaggaggagaatttcagagcgtgacagatatgcctggcattcctagagaggtgattgaacactctttacatgttaaggaagatgctaaacctatcaagcaatgactccaccattttgcacaagataggaaggacgcgatcaaggaggaattgaccaagctgttagcagcaggcttcatcaaggaagtccttcatcttgactggctggccaacccagtcctagttcggaagaagacgggacaatggcgcatgtgtgttgattacaccgacctcaacaaatcttgtcccaaggatcccttcgggttacctcgtattgaccaggtagttgactcaacggccggctgcgagctactcagttttttggattgctactcaggatatcatcagatccgactaaaggagtccgactgcttaaagacttcatttattacacccttcggggcctattgctacatcaccatcccttttggattaaagaatgcaggggcaacttatcaacacatgatccagagatgcttttcaacttagataggtcgtaacgttgaagcttatgttgatgatgtagtcgtcaagaccaagcagaaggatgatttgattacggatctagaagagacctttgcgagcatccgcgccttcaggatgaaattaaaccctgaaaagtgcactttcggagtaccgtcagggaagttgcttggctttatggtatcccatatgggcatgcaagccaacccggagaaaatcaacgccatcctcaacatgaaaccgccgagctcccagaaagacgttcaaaagttaactggttgcatggcggcgctcagccagttcgtctcacgactcggcgagcgggggttgccctttttcaagctgctaaagaaaaccgacaatttccagtggggacccgaagcacaaaaagcctttgaagacttcaagaaacttctcaccactccaccggtcttagcttcgccacattcgcaagagccgctgttgttatacgtgtcggcaacttcccaggttgtgagcacggttctggttgttgagcgtgaggaggaaggccacgttcaaaaagtccaacgaccaatttatttcgttagcgaagttttggccgactccaagacaagatatcctcaggttcaaaagctgttgtatggcgttttgattactgttaggaaattatctcagtattttcaaggtcactcggttacggtggttacatcgtttccactcagggatatacttcacaatcgcaaagcaaatgggtggatcgcaaagtgggccttagagttgatgtctttagatctatccttcaagccgcgaactttgatcaagtcccaagctttagcagacttcgtcgccgagtggaccgagtgccaagaagacatgcctgtggagaagatggagtattggactatgcattttgacgggtcaaagaggctttcaggcaccagagcgggggttgttctaatttccctgactggagaaaggctgagctacgtattgtggatacatttttctacgtctcacaacgtggcagaatatgagacgcttcttcacggattaaggattgcgatctccttgggaattcggcgtctgatagttcgtggagattcttagttggttgttaatcaagtcatgaaagagtggtcctgccttgatgataacatgaccgcctatcggcagtaggtacgcaagttagaagataaattcgatggccttgagctaacccacgttcttcgacataataatgaggtagccgacagactggctaattttggttcaaaacgagaggcaactccttccgacatgttcgttgaacatctttatgagccaaccgtaccaaggaaaaaaataatcgaggccacggacactcaagaagtaagcatgattgaagccgactggagagagcccctcatgagatttttgaccaaacaagaactccctcaagataaaaacgaagtcgagcggatctccaggcgcagcaaactttatgtcatacatgagaccgagctgtacaagaaaaatccatcagggatcctgcaacgctatgtgtctttggaggaaggaagacaattgctaagggatatatattcaggcatatgtggcaatcatgctatcgcacgaaccattgttgacaaggcctatcggcagggttttttctggcccacagctgtatccgatgctgacaaaatcgtgcgaacatgtgagggttgccaatttttcgcccgacagactcatctaccagctcaagagttgcaaaccatcccgttatcttggccgttcacggtttgggggctcgacatggtcggcccgtttaaaaaggctatcagtggttatactcatgtctttgtagctgttgacaaattttccaagtggatcgaagccaaaccggtcgtcacaatcacgacagacaaggctagagattttttcatcaacattgtgcaccggtttggggtacccaatcggatcatcactgataacggcactcaattcactggcggagtatttaaagatttttgtgaagacttcggcatcaaaatttgttatgcccccgtagcgcatcccatgagtaatggacaagttgaacgcgccaatggtatggtacttcaaggaataaaagcacgagtttttgaccgattgcgtccctatgctggcaaatgggtagaacaattgccatctgtcctttggtccctgcgcaccacacccagtcgggctacgggacagtcaccgttctttctagtctatggtgcagaagcaatgctgccaagtgaagtagaattcgaatctttgcgatttcgtaacttcagcgaggagcgctatggagaagaccgagtagatgatctcaaccgactggaagaagcccgtgaagcaaccttaattcagtcggctcggtatttacaagggatgcgccgttatcacaatcgcaatgttcgatcacgagctttcttagtcggcgacctggttctgaggaaaattcaaactacacgagatcggcacaagttatctcccttgtgggaaggactgttcatagtttctgaagttactcggccaggttcttattgactcaaacgtgaagacggtactcatatcgacaactcttggaatatcgaacatcttcgtcgtttttatgcttaggcattattttttgtatcttcttctttgactgttaacatcaagttcttacttgagttatcagtcgggggctactataataataatggagtgtgatttttatcaattcaatttgcttacttgatttatcattgccttgtttgattttttggcttagttaatgaggactgaaagtttttaacagcttttgcgggttctaggctcagtaaggtttgacaaaaacttttaagaaatcaggagctgagtttaaatcatcaagcacaacataaattcatcagtattgtacaaattgtgcctccatcatcatcatcattgtcagaatacaatatcaatcagtttcagtcttttcatcgtcagagttattagatctagtcggccagaggtcgttgtcctggaatctctcaacaacatcagcagctatcttgtcggcagctttctgcgtgtcattgatgaggtcaagagtggcttcttcgcttgtcccgtctgcaaagccatcaatggcatcaatatcaatcttcgggtacaaggacttggtcattgccaacgccaggcctgctcccatacttccagcttccttgatattcttaaaatatgtatccggagcaattctcagcttgtcgaagatttcggcagcaacaaatgagctcggaccattgttgttataaaaaacatggcttggacgagtggtgtagcggcgttggcgacctcatctctagctccctcaagcctcttgattttgttaagcaagacgtcgaactgagcttgggatttgattttgcgatctgcacaagtagattcacatcaacgagtgggcatgaagataagagtggttttttgatgttccagctacaagtatcttcgacatcttttagagctgagtccctctgcttcgttagttcgcccttatttttttctagagccttgattcgcctttccagctcggatatcttggcagcttgcactgtattgcttctcattggttagttgcacatggatagcggtacgaaacaagtcagataaggatgagatttaccttttaatgaaccgctcagctcaaagttggagtcttgaagctcggcagtccgatctctgaggtcatgctcagtcttcctggcaagctctttggcttcacgcagctggtctctggttgcttcaagggttccaaggtggggaactaatttttcgagggttgcggtcttcgcctcattcctaagatggattctctgcaccgcaaatttatctttgttcaagtaaagtggccgacaggatgattgaggctgcgtatagggagagttacatttacaagatgagtagattggccgagtgtctttttcagcagacatacttcctcgtcttccttttgtttatttatcacgattccctgtggttgcatttcatcatcccaccacttgactaatatgggtgggcgagaatcttcacctgatcgtatctggaggacctcttcttcattaccgatcattggcccttatatattcatgaataatggtgaagcaattgaagaaagtttgtcggatcaagacagatttggaggacttgtttacccattataatttccggtcggggacgagcaggtccttgcaccctaacaggagagttagttccagggtcagcagcagcgtccgtcttgggagggctgttggcttgagcttccacttctgggatatctctattttgttctgtacccaactggtttccagtcgggggctcttgatcagcaccgacttcagcttcggctgactggtttccagtcgggggctcgttgctagtatctatattgccggttgccggttgattattacctgggcggtcttcagcagttggcccagtttctgctgaaggactagtctctgtgccagtcggcatggggtcttttccagagggatctatgtcagatggtttcctacaaatttgagacatgctatcagctttgcttcaatagtgagtgactagcgaaacaggggaaattgctagatgacacatacctggatgacttccttatttttggcatgggacgactggacgttttcttcttcggattggcttgctttggctgtttcccaatcacccctttgttgtccgtcttttccgcgtcatcaccttcatcgtcacttgaaaccaacttcctcttacgagaatctgactggttagttgacctcgaggtgttgggttggacgtccgactggatcttcggccctccactggcttggccagtgtgccggcgaggtgagcggcgttgagcaattggagtatcggatttcatcaaagcgaattcctgtgcatggtattccaagttttcagtcgaccttacagaagataaaagcatgctttgagaaaggctaaggtgtataatacataccggtggaggagggttgaacgtattgtatggcacgactagcaataagtgtgaatagctgaccacaatggcattcgagaagattttgtacattctctcctacataattttgaactcaagagactctgggttctctcggttggggtcatgcttgccatcaaactcaaaagctgtgcgggatctctccttgattggcgccagccggctcttgataaagtgccgggtgatttgctctccttgcagaccctgttctttaagcttcagcatgcgatccaataagtcaagcgcttgggcagcctcttctcccatagaaagtgagttccaggtatcgcgatatactggaggcagacaggagtatccgggaagcgctggcttggggttttgcacatagaaccagttcgcgtgccaacctttgttcgaggtcttgaagggcatggagaagtatttttggctcaaggtccccctcagttgaaatccggctcccccaactacgcacggtttgctcttatttggctggggcttgaggaagaagatgcggcgaaatagagcaaaatgtggcctaatccccagaaaagcctcgcaagcgtggatgaaattggcgatgtggactatggagttggggtttaggtgatgcaaactgatcccatagaaatccaaaatcgcccgaaagaaacttgaggttggaacagaaaacccgccgtagaagaaatgggagaacagcaccacctcgtgtgtgtcgggggtcggaaatgtttcaccgcatgctggacgccacccgatgatctcctttgccggaagaacgccgtgcgccaccatctccttcaggttttcctccgttacatcggagggcgcccactgactctcaaagctttctctctcttccgccatggatgcgaactggatgatgtgatttggttcgaaatgtggctgggaatggatgggagattgatgcggtggttgcgtgggagattcttgtggagttttggaggatggattggagcgaatctgtgaaccctagcttcgcgggcgcggtttcacaccgtagcagagaattgggaaagtggcaagagtttcggcggggaagacgaaccgacgctttgctttcggtgttatttcattagggtatcgggagtactaatgggcctaggcctaaacagtacttcagcccaattttgctatctcgtcgtgtctaagttgtgatccttagggacttaggcattttgcttcggcaacacttgctcacaacagtatagcccaatgctgttaaaatcctttttgacgtagttagataattctttggaattactacgatgcaaataaaaaggtgcccaacggaaaagtgttatactaattttgtaagcctttttaggctgcaaaagctgttcgggttttgttgagatgactggtttttgaatggtcattctcttggcatgttatatgcttattttgatatggtgtgagtcatagcttaggcaatttagattcacctattgtcatgatttataccacatttgatggatctttttcgagagtttttactaggattcttatcatatgtgttgatttataaacctttagagtgtttctcactcgggactttttatatctccttttctggtgtatcaaagctaaagcagtcggctggatgttttattaaacgtcgcatatgcttggctgtgtgataccatggatgatccggttgtaaaaccactcggttggatgttatttgcaccttggctatatgcttagtttttaactaatcacatagtcggaggctacacctaattaggtgcatctaattgatgcacctgattgtttctatttctagcccttcacagtctttgatcttagtactcgggaggccaaagcagaagaagttggagcactcgcattatccttttggattacgagagaagactatttcatcgactgtaaaggtctcaggggctactatggagattatggataccccatacctacacggcatgtatagtccgactaggtatggggtgccatgtgtagatagaatatctttaaagggactcgggttaaattccaaacttgtacgtcaaggaaatgcgcgtgatcctagtcggttacgattgtatcttatctgtaactacctattccgttagggatatggattgtgttttgtaatacggaccacttcccctatataaggaggggtccgggtgcctctaggggcacgattttctcccagatcatacgatcaataatatactcggcggatcaatccccggacaggagtagggtattacttcttgattaagaaggcctgaacctgtataaaattccttgtctttcaacccatcaacttttctagcttgatagccacccccttttagtattgctgaaatcttgtttcgacaccgtcgttgccgtgccggaagatccagccacccgaatgagaggtatgctagccgtcaccgccctcttcttccctttcatctccatgtggccaccgcttccctctcctttacgctctccattccgctcggtgaggtgcggcgatggtctaggcctccccaccgatggatccgactgccctcgctctgggctccagcgtcgaggatgtcctgcctagcacgcgttcgtgcccacgctccctcggcttctccatacacccgttgatctcgtgcctaccctaacgactagatgacgagttggcatctccttggtcttcattgcgtcccttgcatgcgattctgcagccaaacggtgggctcgacactagcaaggtcgtgctcgtgccgtcacttcctctggtacctccaatctctcctctagctcttacctcctctcttatgccaaaggcttcctcccgattgacaacccttctttcgcagaggcaacaaggatgccccgtatggttctttgctcgcagttggggctttcgttcattatatcaagcttaggatacctttgaaatgtatgcaatgattctctttggttgctaaggtaaagttctttttgggctgattcagttcatattatgtacacaagaaacataatagtgctgatctagctcaaagccttttagaccatactataaatgtcctactgttcgttgtttatttatcagtgcttattaagcttctctaaatgcaagtatccctcccagtgcatatgaagtggaacatgtctatgtaagttctgttttgcctcgatacgaatcaattacgttgtttgaacatcatatgaagtcattgtaacctatttagaactggaattttaacaaagattgtcatatgaggtgcatgataaagtctttgtcccctaatttggttcctcttcttagctagaggtatactaagaaatactagctaggttctctctttacgagcactaatgcatttttgggaagtatgatatctcatctgaggtgtgtgaattcaggcaataaagaaaaacatatactactgttatagtttttgtttacaattgaaatagttattgataacagaaatatgcttaacatgctacaagcatagtcatattgctaaaatgtgacatttcatattgaagactatggccctgtttagatcccaccccaaaatttttcaccctgtcacatcgaacgtttaaacacctgtatgaagcattaaatataggctaaaaaaataactaattgcacagattgcgactaatttgcgagacgaatcttttaagcttgattgctccattatttgacaatgtggtgctaaagtaaacatttgctaatgacgcattaattaggcttaatatatttgtttcgtggtttgctgacggattctgtaattagtttttttgctagtgcccgaacaccccatgcgacaccctatataatacgcaatgtgatatgccaaaactttacacccctggatctaaacactccctatatattatttgagcaactacctgtgttccaaaactatcaaatatttcatttcaaatggtcaggtaggctttcagttatttacagctagttgggatagtaggatattggatgaggtagttcttataatgtaggaactacaatccattgataatgtttggaacttactgacaatgatagtggacatactgatatttgaatagtgtcccatgtgttttattgctaatttttgtttacacaaatcattcataatagttgggaaatactgctagcccaatgcgttatggggaacaaaagcaattgttgctttctcatgaaaatgatgtaattatttggaaccaatgtggaatatttattctccttcaagttttgtctgaatatacaacagatggatataaagttgaaaccactttctatgcatgaaacacttatttttcttctttttaggcaagtttatggaggaagctacactttgtcgtgaagatcagagtttagtttatttgcttatttccactgcgtttgtaagaattatttattatttttgtatgatgtggatctctgtatcaatttgtcgtttgtgtactctggctggtcctggacagagattttaatacacattctgcttgaaattcgggttagcgaatttctaggcgtgacactgaccgggcccaccagggttcggccgaactaggacagcgcccaatcgcccccaaaatttgaacactcgatctgcctactctgtcaacagtagaaactgaatcattcgtgcggtagctcgttggatcgacccagttcattaaaatctctctcttgttcatctccctgtccactccaccttatccattcaagccactactctctttagctcgaatccataagtccagtccatacccaagatcttcaatggctgggaaatccttgattccgtatggtgctacatgctgaaacgcatttgatctcaatggagagccctctccggcgaatcaattggtttcgggagaaaactgggcgatggaagaggcaaatgcgatcttcatagaccccctggacaccatcgcggtggactccatgagtatgcggccgatcggcgctgctcctagtttagccgaacctaggtcggccgaaccctggtcggcctcgatcaaccccctgtttggccgctcgcccagtctcgccacgctacaaaactccgactaaagtacggggtgtttcccaagcgcagaggccgacgacaggagaattgggtctactaaagcgagcacgatgactttttgaagacaaggagaaggccacatctcccgccagcgagcattatgtgggatctcttgatgtgactgtcacaccccgaagttctcctcccaagccaaaaatttaatttataagcgaccctaagaaaaaaaccggtgcaaagcaagagtaaacccttttaaatcaatgcaaataataatcgaatctgacatgtggaattttttcttgagttctacatgtcgaaattcactaacaggatttttagtggaattttcagagccctagaaataattttaaccaattaaaattgggcaagcaatattctaattccaggaaaatccttttctcctttttctttttctttgtccctccctttttcggatgggccgccggcccattctctccttttctctccctcctccctactgggccgaccgcaggccgagacccagccaagccgcccctccctctctccccgggacgccgacaggtgggccccacctgtcggacccgtccccttcctccagccgcgcccgcaaccgccgcaaacgcctccgccttctccgggccacgtcagccacgtccgcgcgtgcgccgcatctcccacgcccactcccctttctctcccgcccgcgcccgcgcccgagatggccgggattcgattttcgaatcccgcctctctctccttcctcactccccacgttggccggcgaaatcccgcctctcccggccacgtccggcccttccctcccctatttaaccttccccgtcactccctcttgctttttccccatttagccgaactttcccgagctccccatcgctcctgcgccgtgcaaccacc

SEQ ID NO: 75452 - DNA, 1266 bp, Oryza sativa
atgaacaacatatatctgtaagattcagtggcaaaattaacaaaacggagaagaaaataagcatgtttatgtcaaggagcaggcggtacctggcgatgttccattgactgaagatggggagcaaaactctgacgaagttgaagatcgtcaagctggagctgtgcagtcaaagggaggcaatctgcgtcgtactacaaggcctgttaagcaaaaccccaagtactgtgggcctaactgggccatgtaatagaagtccatattgtaataggctagcgtgaacaaggggaaagaagagagagataggatatatatatcagatcagcgagctcgagggaaacttgaatggcaaccacggtggcgtaggcggcggcggctccattcctgttggaatcggagaagactactatattgagttgccataattcctcttgctctaattctctcatcgttgcaattctctctgtaatttgggtgtgagttgtgggttgttgacaaaatttagtatcagagccactccgctccgcagatctccttggcttggttgtaaaatcccagggtaggattggaactgttcttcggaactgattctgcgaaaaggcaacttgccttctcctggttagccgagttcgggaagcgagcgagtgattctagtaccaaactgttccgtggagtcgagtatgtcgcaggaaagtaagttagatcttcttctgaaggtggtcgaggagaacgagaggaagagagtggcggcgaaggaaaggactcgagcagatttcgccgatctgaagaagatggtggaggcccgactgccggtggtggaaaagaaggtggagacactcagcgtttcggttcaaagcttgagccagaaggtggagctgatggaagggagcatgctcaaatctgaaccaccaacggaagggatcgggaacaacgcatcttggcttgctagtaagcgtgatccaaatctttaaacccctgttcattttgctggtaaggccgagtctgaattgccatcaccaacttctgcatccactggtaccaatcatgatttgagtgcttgtatccccccaatgatctgcccaaaatttgatggatctaacccccagatgtggaaaagtaattgcaagcagtactttgatgtctatggaatatatcctatgtattgggttaaggtggctactcttaattttgttggtaatgttgccttttggctccagtccattagatctcagattgttgacattacctgggtcactttatgtgaattag

SEQ ID NO: 75453 - DNA, 2411 bp, Oryza sativa
acttgaactgtttttctcaggcaggctggctgacggaacaatcaaaactagagggcatttccggacgtgtgattgcgatgagacgtgttgcaatatccagaccagtggctagacgtgttaattttaacttgatgaaacgtaagaaggctggatccaaactttaattcttttccatcacatcaacctgttatacacacaatttgttatacacacacaatttttcagtccaaaatttacgctgaactaaaaacagccgaagtttgagttggaaaaaaacttttttggatttgttgtgatatgcccattaaacaacttaccaagcgattaaagactgtgctatacgtgtgatccagttgtatgatttatgtataattagagatatacaatcatataattagagacaccgtccatttttgtccatgtgtcataagcataccaattttcggtgattaatcgctaatcgacaaggcgatcacatcaaatatttagacacatgcacggagtattaaatatagaaaaaaaataattatatagattgcgtgtaaattgtgagacaaatcttttaagcctaattgcgccatgatttgataatatgatgctacagtaaacacttgctagtgacggattaattaggcttaatattttatctcgtagtttgcaggcggaatatgtaatttattttgttattagactacgtttaatactttaaatgtgtgtccgtatatctgacggagcacacacaaacttttcacctgaactaaacagtgcctaatttatcggactaatcggccgttttattgcgtccatgaaacaaaaaccgttctgaactgcctcgactcccgtctcctcgccggaaagccgccgccgccgccgcccttctacttccgccgcctcctccttcttctcgagaaggctctgcaccacagacgagagctgagccgcggagcacaatgtcggcggactcggcggcggcggggagggacgctctcctggacgagctgcgcgcgctcatggcggcccactccccgtcgctccacgcgctcgtcgtcccgtccgaggacgcccaccaggtccgtccgcgcccgctgccacctcccgcggagtcgatcagatcagatcgggcttggatttttgttgttgttgttgttggattttccgttttgcgcgatctcttcttcctctcgatgatggttgaggatttgggtgtggttttgtgggtgattgattgattgattgcagagcgagtatgtgtcggagcgggacaagcggcggcagttcgtctccggcttcaccgggagcgctggtatgttgcttcctcaattcatcccttctcgtttcccaggcgatgaacgctgtgtattgtcctagaccaccagccatgagtctgttgcgatgagttcattatacaatagtgcattttgttttatgcactgtttgtacagggtgccaatttttcccttttgtgttaacacaaaaagtggttttttttttgttcgcccgaacttgattcagaaagcggttgcctagtaatagaggctaatggttgaatttttaggagcagttatgttttatgacactgttatgtttttggaaatttaggtgattaacagacatttttggactggattgttttatacattgcttcggccaaacaaatcgtaataaaattattgatagcttcgctaccatttatagttatggtttaatctagctggactaaagtatggaatgataaccacctttgtactgggaggagcttaattgattcctattttgtagtaggatggagttgaatatcataaaatgtggatgtaacatattgaacttgttgatttcttttgttttcccccagttgtcgtaatcagagagttgcattaatttctcagaccgagctatattgcgttgctacacaggtttggcgcttatcactatgaaggaggcgctactttggacggatgggcgttacttcttgcaggcagagcagcaactcactaatcgctggaaattgatgcgcatgggagaagatcccccagttgaagtttggatagctgatgtaagtgttgacatctcttcttgatcatgttcatgagtttaatttcccaagtcttacataataaaaatattggttcacaaaacttgtccatggaaatgaatttatttggttataccctctcatttttttttgaacagccagatcaaaggtttatccttgctttttgaattctgccacagtttttgtgttgtgaaatcccaaaagtggttttattcttgttaattttagctagttttatctcccaaatatggtccttttcattttgttaaccatattcagttgttttgttaataccccaagcctactatctttcttcctgtctgctgtagattcaaggaactgcatgatagttggtttg

SEQ ID NO: 75454 - DNA, 36080 bp, Oryza sativa
tttcatcgaacaccattcgcgcatcgctctccccgagcgaaccgcattcgttacgttacgttacgtgcgagatgaatcaacttgtcaggtacaaacacaaccggagaatttgcttttgtttatactggagttatacgatgtgatcctgatccaggctcagttcgacctagcccctgcttatctttgcttgtgggtcgttgtcgccgtctttggttacgctaggagaagcatctctctttcttgcgtaggtaatcaactatcttaatttttcttttgtgtcttgattatgtgcaacaccgagtgatgcgaatgggatgtgttcctttcgatgttttttctatataagctctgaaacttggacttttgcaacaaatggttcgggtgcagatgagctgtttgacgaaatgcccaggagattcctgcgtgcgttgcatgcccagcggcggtttgactctatttttcctttagtatggtgtctgctctctggtgatctaatgtaccattttctcttaaccttgttttacccaatcttaatgcaaagatgcataaagagaactctgcatattcctgttttctcttaaccttgtttcagagaaccttgttttctctgaactctgcaaaagattttctgcatattcctgaaaaaaggagaactctgctccggtgcttttaactagacttataaaggctttggcataggattcctgtattggttgatgcaaaatctgctggtaacagtcagctaaattcgcttaaaaagtacacttctttgggtcttcttgctagtgcaggtagagaagcaccatggccttcctggtttcttaggtggtaaacaggcaaagaaagtaaagcaccaagtggcgccattgctgcaatgaaatcaaattattattagcaagtggatgaaaggaaaagaatacacagcctggaagagctttcaacttgaatccccttgcaattgtgtaacactacttgtccttttcacattgcatcatcgttgaaacatttggattttaatacaaaaatcattgtgggtagattttgcctcaaaaagtgctttcatactgttttaattttgtcaggtttttcagacgttttgcaatagagaatgtcaatgtccattgtgacaaaggcagttggtggcaagaaagggaggagaatctataacagctctcttctgcaatctgcattgccctctctgttctcatcaggttttagccacactgcttcaatatctctttccatcttccgtatttaagtgatcggcactcagcagctctgtgagatatctcttctgggatctgcagtttcaagcatctcccataggagagatccagtgggaatccgtaggttctagcactatgggcacagttttggatgctctcgcttggaaattcttggaaaagctgggtcaacttattgaggatgaggttatcatgacattaagtgtgaaaaggggtattgagagcctgaagaaaaatctggaattcttcaacgctgttcatgaggatgctgaggctctggccatggaggatccagggatagattcatggtggaagaacatgagagatgttatgtttgatgtcgatgacatcgtagatcttttcatggttcattcacagaagtttttgctgccaccaaggccggtatgttgcaatcagcccttgttctctagctttgcaaagttttcatttgatcacaggattgccaaaagaatcgataatataaatgaaaagtttgaagaaattaaaatgaacaaagagatgtttggcttcgagagaaccaaccggcaacaagtccagataacaattgttgacagaagtcagacatctcctgtagatgaacttgaggttgttggagaagatatcagaagggctgttgatgacatggtcaaaatgattgttagtaactacaatgacaacaggtcaactgtttttgggatccaggggatgggaggcatcggtaagacaacattagctcaaaagatatacaatgaacagaggataagggagaaattccaagttcatatatggttgtgtatttctcagaattacacagagaccagtttgttaaaacaggcaataagaatggctggaggaatttgtgatcagctggagactaagactgagcttctaccgcttctagtggacactattagagggaagagtgtttttcttgtgctggatgatgtttggaaatctgatgtatggattgatcttcttcgatcgccttccgagagaggcttgaattctcgtatccttgtgacctcaagaaacctggatgttttggtcgaaatgcatgcaacttatacccacagggtaaacaaaatgaatgattacgatggcctagaactgctgatgaagatgtcattagggccatacgagcaaagaagagaattcagtggtgttgggtatcaaattgtcaaaaagtgtgatggccttcctcttgccatcaaagttgttgcaggtgtcctatctagtaagaaaacaaaggcagaatgggagagcatccgagatagcaaatggtctattcatggacttcccaaagaactaggaggtcctctgtacttaagctacagcaacttacctcctgaacttaagcaattctttctctggtgtgctttgttaccatcaaattttgggatccatcgtgatgctgtcgcttactggtgggtcgctgaaggctttgtgacgaaaatgcatgggtactcaatacatgaagccgcagaagaatactaccatgagctaattagaatgaatcttctgcagccaaaaccagagtttgttgacaaatggatgtcaacgatgcatgatcttttgaggtcacttggacaatttttgacaaaggatcattccttattcatgaatatggaaaatagcaaaaccttactgaatctacgtcacttagtaataagcaatgatgtaaaagaaatacctgctatagaagagctgaagtgcttgaggagcctcctaatttttaataacaagaactttaagacaattaataaggacattttcagagagctcaagcatattcgtgtcttagttctcagtggaacaagcatccaagtcataccagagtcggtgggaaacttgttgctactgaggttgctagatctaagctatacaaaaatcaaaaaactccctgaatccataggaaatcttaccagccttgaatacctttctttgcactgttgcagacatttggatagcctgccagctagtttgatgagactgtccaacataagtttccttgagctagaacaaactggaatcgaccatgttccaaaagggatcgcgaagtttcagaaactctacaaccttaaaggagttttcgagagtgcatctggattcaggctagatgaactgcaatgtctccccaacatccaacgtctccggattgtaaagctagaaaaagcaacgccagggggtgcatttgtactcaggaacagtcttcgtcttcgagaactgtggtttcgctgcacaatgggagctaatactcatgatattacccactaccagatgaacgagattgagagaattcaacaagtctatgagatgctaagtccatcatcaagcctaatttatttattttttgaggggtttcctggtgtaaggttcccagattggttgtgctcagaaccagagtataagatgccaaatttgggacatatgtacctcaacgagtgcatttcatgctctgagcttccaccagcaggtcagatgccagaactactaattcttcagatcagatgtgcagatgcagtagtgaatattggttcagagctcctaggaaaaggcgtcagcagtgccacgcatataactattttcccaaagctcaaattgcttcacatcattgatatgagcaatttggaaagttggtctcttaacacagggaatttgcgtggtagatctgaacagctcgttctgatgccttgccttaagcgtctgtttcttaatggctgcccaaaactaagggctctccctgaagacttgcataggattgctaacttaagaagaatccacattgaaggtgctcacacgctgcatgaaattgacaaccttccttcagtgttatggctcaaggtcaagaataacaggtgtttgaggagaatttccaatctctgtattctgcaggacttgtttgcacaggactgtccagcgctggatcaggcagagaatctaatctcactaaagagactccacatggttgattgccagaatgcaaagcaattcagaatgtgcctcctagaagaccaacaacttgcagtcgatgttgttacagttggtgcagatggcagggatatctttccagatgaaactctctataattaggcaggtgagaaaaactacatttgttagtctcaatggtttcctttccgggatctgtttgtactatggtttgttatccgtggtacatgttttgaaactctggctatagtgatgatttttcactactcccaatcaaaatatccttcatattgttgctcttcttgcagtggtagagtcaagagtggcgcgcgccaaggaaacggtggtactagtgtacctgaaatgttacaggaaacaattgaatttctgtggtaacaagtggtactcaaagtgcagtccagtggtaaatgcagcttggtgcagacctaacagcaggaagcaacaccgtttaccgaaattatagcttgaattcatcagcttgatctaaatgcaaaaattgagaacttggtcagcactgccgaaaactagatatcccttcaagtgaagttgccttactcaaggttaagactaacatcaatttgccactgctggagctgagaacggtgggtgcaagtgctgcctcaattgcagccatagtgtgatgctatctccaagattgtttcaggctgagcagtctctgagaacttgtgcagatttcaaatccaacgagtctctgaacatgcccttgtccagtaggctcctccgtgtaaatatcttgagctgtggatgcccaaactataagcagctagcatgaccaatagacattcccagtactcaatacaaatattttgcacatatattcgattagtcttgaaagtgatccgatgcaatatgtgaaattagttttgaaagtgagctgtccccatgcaatataaggcttcattgatttaaataccgattaacatcgtttgataaaaagggaagaaaccagttcacaacccccaaatccacgatgggccaaggcgcacaactcccacgtcacggcaggtcccccgatgcgcgccacgtgtacggcggatggcctccctccctctgtataagtagcaaccctctcggcctctcggccccccttcctgtgtgtggttcaggtgcccaaggtgatattcagattttctgagtgctcgtgtgttgtgcgatcagtgcccactgcccagttcgatcgatccgtgttgatctttgaaagaaagatgtcgtgctgcggaggaaactgcggctgcggatccggctgccagtgcggcagcggctgcggagggtaagatccgatcaccatcttctgaatttctgttcttgatctgccatgtatatcaactgtctagtcttggtgttggttagatgaaaattcgttggatctcggaagggatattgttcgtttgctagggttttttgtgtgctgtgatctgtagaggatttctgtttgtccatgttgttgatcttggtatgtattcatgacatgcatgttgtatgtgtcatatgtgtgcctctccttggatttgttttggataatagaacatgttatggactcaatagtctgtgaacaaatctttttttagatggtggccaaatctgatgatgatctttcttgagaggaaaaagttcatgatagaaaaatctttttttagatgatggccatgcatgacatggtctttgttgagagaaaaaaaagattcatgataggagattttgatttagctcccttccaccgttataaaacgaggagcatgcatgcagatgactgatgaggatctgatttcattttttatcccatcttcttataacagacaagaaataggctctgaatttctgattgattattttttgtcgggacggccaaagtaggctggccaatttcattaagattgggggaaacaaagttttaattacaacaatttcattaagattgggggaaacaaagttttaattacaacgacatgaaggatgtcgcgccggtctcaagcaaactcaagcccggaaagaaaaggaaaaaatggggcaaatcgggattactcgctagcctgggaaaaaatccctgctaccctccaaattgcgatttcctcgttgatgtcattcgctagccggtcaaccaacttggcgatgtgttgaaagatccttgtatttcgctctttccagataagccaacaaattagcatgaacagactatcgaaatccgtcctgtatgtgttctgaaaacgccgtcttgtcgcgatccaccaatctgcaagcggcctgacatcttccgcagtgattgcaatgttaatgttgcaccaacgtctcagcttgcgccaaagccgccgtataatcacaggacacaagcaaatgatggcagtcttcgttctcgcgttggcatagggagcaaatggcgtcatgcggccagtttctcttcgccaggttgtccgccgtgagacagcggcccttcagtgcaatccacatgaagaagcgaacacgcgacgacaccctggagtgccacagcgtgtccccgtaggaacagtcctctgtcgctatgaaaaatagatcatacgccgaggccactgagaaattaccatcagcagtcaacttccatttgatcgtgtcagccatctgctgcagtgacacgtcgcgaacttcatcccaaagttggaagaattcacccagagcttcattggacagggcaccttgtaatcggcgaatccatctgttagcaatcagggcatcagctactgtcagcttggcacggctcacatgggaaaacaacaccggccacctccaggcgaagcaacctttccctgtccaattgtctgtccaaaactgtgtgtccaccccatcaccaatgatgtgctcagcgacggatcgaaagatctcttccacatcgcttccaggacggaaagctgctaaggtccagggtctatccttctgctccaaggatttcgcaagccatttcaaccggagagcttgaccgaacaaattaagatctttgacaccaagtccccctttctcgatgggtgatcaaacctttcgccacgagactaggcaatgcccgccgctgatctcttcctgtccttttccaaagaaacccgcggcacttccgctcgatgtccttaatcgcccatcgcggtagctgcaggactgtcatgtaatgcaccggcaacgccattaggaccgacttgatcaagcacagtcgcccatcaatagacagcattttcggcttccaaccggctaccttctttgccagcctatcaaggatcggctggatctcggccttcgtcggtttcctagtggagagagggagtccgagataagtgattgggaacttttccactcggcaggagagaatggattcaacttgcacatactgctgctcgtcacattggattggagtgattgcgcttttggagaaattggttttgagacctgtggcagccccgaacaactccaggatacccttgatgactcgagcttcttcagctgtagggcggaaaaacagaaccgcatcgtcggtataaactgaaattggtggcaaattctgtcgtacgttgaggggcgagagcagtcttgccatccttgcctgggaaactgattgattatttgtacatgcagatgcaagatgtacccggggatggctgaggaggtgaccaccacccagactgtcatcatgggtgttgcaccttccaaggggtatgtgcactaatcctttccttcttcatatcctgtacttgttgttcatgggcaaaatccatgtgttatattactgaatttgttgaatagtataaggagagggaaatattgtgattattgacaccgttgtattgagtctcagggatcactatatatagaagtacatggtgtagagataagaaagaattacggatatggaagaagtccacgtaaatcaatcttatcctactctaactaccatatatatactttaatagaacagaattgagtacctccatctttctagctaccaacctcttttgtcaattatcatatgtttcctgccttttttccccttctgaatcacagagaacaaaagtacaaaacattttgttgagaggctcactgccttccattttacgtgtacgtatgacaaaattgcagcgctagctacagccaatgaaaaacgactaaaaacttcatgcacgttatgacaaaaactctctcctttatctgaagaaaacgattatgccttttactctgaaaactgcgtagcaacaatccaagatcgtttcatgtttcgctgagttctactcccttcgtttctaaatgtttgacaccattaattttttaacacatgttagattatttgtcttatttaaaaaattttgtggaatatgtaaaactatatgaatacattaaagtatatttaataataaatcaaatgataggaaaataattaataatttcttaatttttttaataagacgaatggtcaaatatatttagaaaagttaacggcgtcaaatatttagaaacggagggagtaattaattactgatctatggttggttaattctctgatggatgcagtcatgccgaagggttggaggccggcgccgccgccggagcaggagcagagaacgggtgcaagtgcggcgacaactgcacctgcaacccctgcaactgcggcaagttgaagcaagcaacctcctgatcaggaaaccaaggagatggaaggacctagtactgctaatctagtagtatgatccagttacgagtgatgagttgttgtcactgtaactttgtgtttcctctgtgagtttgtgatctaagacctgagactgaagaaatgcatcctagttaataagtgctaagaataaagatgttttgagacatctatggcgtctgtacgatgatagtccttcctctccagtcttgtggtgtgtacgtaattaagaatgcaatgctgtgtgtcatgtatgctttctatctagtgaaactgaactagtgagttggtatactaattttgcttttttgcttgaatgttgctttaatgtgacttgtgtcactggatgtttatcttgcttgcttggatgttgctggctacacgaacttcatctgaagttcatgctggtaaagaatctagctttgagcctgcttggactaatacactacaaaatgggctgagcccatggatttgtgtaccacatgtctacaactctacatcgtgtttaacctcagtgggctggataattccttcatgtttctcgaaggaagaagtacatcgaaggtccctcgtcttatacctgatatttgctatcctcatcttataggcggttttagttttggttttattcaacgtgacagctggctgcgggggagcatctgggcgcaggcggcggggggagaagctgcgcgcgggcgagcaggcccctctaccccaccgtcgccacgctgctcacgctctccgacgccgtctgccaccacggagacccgggaaatcgcgcagctccttcccgtccttgccaactccgacggatgaaggacgacggcgtcgagcctgatctcgtcacctaccgccaccatctgaccatcaccgcctcgttgctggcgtcctgtcccttgcggactccgtctccatcttcatcacctattgccaccatcttcttgttgccgccttccgcgccgctctaacgggaagagccccgcagccacggcggtggttggtcgcggcggctgcgcctgtcacccccgcccaaattattcaggggatcgccataattctcgtcaccagcaagggatgtgcgtcgccggggctatgcctataaacaactacagggaccagctctacagctatggcgattcaaagagttcgtgtaagcttttctgcagcaaagaatgccaaatgcaaatactactttgattgtgcatgcaggacacggatgtctgctgatctatgaacatacacatccacatgaacaaaacgagctcggccacgagtgcttcgccgacatcgccagaggattcatcctgctcatcggctttgcgtggccatgtccaccctggcgacggagaagctctaccgcatgctcggcatgtacgaggtgctcaccgacatcaagtcggacctcgaatccctcttcacaggatacgcgcgcaacttcttctccttcgaggtcaccagcatcgtggcccagctgggcaacaccatccgccatttatcgatgcagttttggataagaataagggaaggggaggggaggaggcagcgtcgggaggagggcttcgtcgggacgctgctccggtgctcccgtgtcaccgccgtcgtcgcgtcgccacgccatcagaggctgttgctagtgctcctcaccccgccgcccgagcctagctgctcccctgccggccgccgcccgtggccagctgctcccccgccgccgcccgtggagagggaaggagagaggtggagaggggagggaaagaagaggctgatgggtaggatccgtgtgggtcccatgctgagtcagatgtcgcgttgggtaaaaccagagtcaaaacccccgaggactcaaagtgattcggttttataagatgagggatggcaaatacggagtatctggttttgtggttggaggatgattttgtaatccgatgacaaaatgaggggcatttgatgtactttttccatcctcgaaatacaatccaaatcgacttgtttggcattcgaggaaggggattgggagtttacacgagggaattgatggtgagattaagaggggaatttgatttttaatcccaatatcttgtttggtagaggtaatggaaattgatagggagtttagttggagattaagtcattaatgaaaacggatggctgagatttgtttaggcaaagtaaaggaggaatccctcccaattaccacctcctacccaggtattgaaaaggagagagtttcttcgtcaattctctatctccattccactaaaatttttatgtctcccaaccaaacaaaatagttaatagcctatccctctgaacttctaattcctcctaaaaacttcctccaaccaaacaggccgaatgttcctcgaaatgcaatccatatgttcagagcttggaaaaagttcacttcttgtccctcaattatggatcgaatttcctttacatcacttagctgtaaatcaccactcttacggaactaaattttctgacctccacgtcgccctctctcgcgagcggcacggagggcgaaccctagccctcgccaccccctccctttctctcccacccctcgccgccgccggagcgcgccgccggagttccgtgcggccagccgtgagggcggtggcgaggcctttcctccggcgatgacgcgacggctctgcgcgaggacgacgacgcggcgtgcgatgggcgggcgacggcgacggcgacggcgcagagcgaagcttcggatccggcacccccgtggctggatccggcgccctaccgccggagacgagcgtcactgccgttcacggcggtgtgacggggcgcggaggaggcggagcggcggcgcttgtgctggcggccagcaaggtagaggccgaagtgggtgcgacggtgctggccctcccgcggcctgtctggaaaggggcggcggggagcgctggacccggtggcggctggcggcgcaggctgcagcggcagcaggcaggcacgacctcgtcggcgccacacctcccccccaccccccactcgtcggtgcgcgcggcgcggatagcaacctcttctccttcccctccccctagtatcctcgtttgtgtgccctctcccccctagttccaaacatcgctggtgatcttgcccttcaacttcttctcaatctggcgtgcttgtttggaaattgtgctcctgtagccgcttggattacagtggttctatgccctcctccaaagttgtcgttgatgttcttcctctgtgagaatccccttggccatttccccttctattagcccctgctcgtcttcaccctcttcctccagatgtccaggaccgcaaggatcagtgtttctccctcctttgaggcttccttcccttgaagggcgttggagagagttgatctaacaagcaacttgataaagcctgattgaagaagacttaatgtgggtggcctcgagccgcaacctttagtggcccaccctcctttggggcttacttccccaaaagggcgttggcgagctctgatacaaacagcaacaagatcaagtcagcttcttgatggcttcatgcgggtggccttggacttcaacaacattcccttggcctctcttttcttccgacatgcttgtggctgtgtgaggaattggatgttgatttgttggggtttagcagtaggttttggattttggcaagatgattttgtaggtgtcattcatcaattgtaatcttttaggaggttttctttctctgttctctcctcgttgtattctccgtgtattctgttctcctatcctccagggcccttgcgcttgcgtaggtaaagcttgccattcaggtggggattctcaccccccccggtgatttagtcaaaaaaaaaacttagctgtaaaacagctattgaaaccagcggaaatacagtccttctcgagcacgtggcggtgacacctggtagggaaatttaactgtttgccacttttaggtttggcaattatccaaataccatttttaggtttgcagttatttttttcccttcttaagaggtggtctcttaactatttgttacttttgtccacgtggcatgccaacttgacaacctatattgaagaacggtgtgagacccactcgtcagtctctccttcccccttcatctctctctctccccccacgtccatggtcccccatcgacgccggtaccgccccgccgtcgaccaccgatggcacagcctcacagacaagtagaggtgggagtggaggacgacgagggagatgaaaaggaggagcgtcgtcaccacgggcggatgcactagaacgacccagggtgcgcggcgaagacgcgagacgacgtctgtaacatcgcgccagaggatttggggtgaccaccgctgtcgtggggaggaggtcggcgtcgtcaaggacgagcggcgtggagattgctagcatggggacagcacaacggtgtggcgccgtccttgatagggaggatttggggtagccgccgctgtcgatggggagaaggtcggcgtctttgaggacgagcggcgtggaggttgtcagcacggggatagcacagcggtgcggcgtcgtcctccttctcgtcatccccatcgtcgaaggcccaagcagcgtctggtagggttccaatggtgggaggcagcaaggggcctcacagcgtcggctgcgagcggtgccatcagtggtcggttgcagggcgacgttggcgtggtggggcagcggagcagtgttggcgtcgatggcggcacagcggggagtggaggtctgcgcctctgcagcttggaccgggcagatgaggcggcgcctcggcggcaacagtgttggcttccatgggggctgtggacgcgtgggggagagatgaagggggaaggagagactgacaagtgggtcccacaccgtttttcaatctaggttgccatgttggcataccacgtaggtaaaagtggcaaataattaagagaccatctcttaagaaggaaaaaaaaataactgcacacctaataagggtatttggataattgtcaaatctaaaagtggtaaatagttaaattccccccccccccctccggtgtgacggcgaagtggctccctgttcagtcaaatctccttctagatgtgcacagcaagaatggtcggcagagtccagagtcccaacagccaacaccaaaagagtaggggtggaaatgagccgagcttggctcgtcttagcttgtagtgactcgcaacaagctaggcttggcttggctcgtttcctggctcgagccagcttgagctagcttgcaagccttcatgttgaaacacctcttcatatatattttataattattaaaaaacaagaacaaatcatcaacctataaaatttaaataagtttatatattcaattatttaaaatcttaatgataaattttaagttgacaaataataacttcttaaaaaataatcgatataaacacatgatggcctaggcttgtgagctagctcggactcgactcatttcagcaacgagctaaataagaggcttgggcttgacttgtttaacttacgagccgagccaagctcaccaagctcgagccaagctcacgagcccaagcttatttttccactcctacatacgagtccagagtccagagtcccaacaccagacgagctcgagctcgccggctctgggaggtcacagcgtgacaggaggtgctagcttcgtttttcttttttaaaaaagtgatattaatcaatttttcaaatttaaaatgattaattaatcatatattaatactcggctcgttttaagtcttaatccccttaacacaccttcttaatcatttagcattccagtcaatgtcaattttcctttcgtcgccacggacacactagtttgtccggcatgtatatgctcacggcatgtcggcatataagtgccacttttccagaaaactcaaatcatttcttaaatggatatcttcttatttttacatgtcacttaaaagtcatcaaggaattttcagagggatgctgatcacttggggaacctgttggcagactttgtgtttgacaagcttctgacagaggccctgcttacttcccaaaacaaaaattttctacctatcacattgaatattaggacatatgcatggagtattaaatataggaaaaaaaaccaattacatagattaagactaatttgagagacgaatcttttgagcctaattatttcatgatttgtcaatgtggcgctacagtaaacatttgctaatgacatattaattaggcttaatatattcgtctcacagttttctggcggaatctataatttgttttgttattagactatgtttaatacttcgaatgtgtgtccgtatatccgatgtgacaaccaaacctaaaagttttccccaactaaacaaggccagatttcactcttcaggttggaaattttgagtctaactagtttgtaaagtacacgagcggtccttaaacttgtagggatgtatcatttaggtccctaaactcttaaatgcttaaccagagtaaagtgcattggcggtccttaaacttatagggttgtgtcatataggtccataaactctcaaaatgcatatccaagtctcagaacttgtcaaagtatatcatctaggtcccaaattgacacatcccctctaggatcttatgtggcgctgatgtggcaatgccacatggacatgacgtgctcttttctcttttttttcttcttttctttttcgttttcttctcattcttatttttttctttcttttgcacgggtcacagaaaggagaagaaagggaaaaaagagaagaaaaaaataatgtcgcgttatgtccgtgtggcatgccacatcaacgcctcgtaggatcataaaggggttgtggcgatttgggacctagatgacacactatgacaagttccggtacttggatttgtattttgagagtttcggggcctagatcctatgcactttactctctctcttttttattttgccccctaattttgttggtctagctgtttctacagtggaaggctatgttatcctcatgtatatattaacattctatttgttatctccttgaagagatcaaggtttggaggggtggttgttacttgttacttgttagggcttaggaattcaattcatgtgctgaaaggttttgaaatttatatactgggtgaggttgaaggagcaattgtttttaaccagtttttggatacataatctcgtagaagtaatgttgaagaaatttatgagtcaacaaatggtgaggagcaggaattcatatatattctgaaagttccctaaactcttatctactcaaactgctgctgattctgcctaaaattccaagaaaaatttgtaatatttataggtgcaaaatgcttcttactagcgctcatgagctcgtaagctcccaaccatgtgaaaactaaaggaataaatccactttgactccctcaaatataggtcaaatcaaatccgtatcccttaaccgtaataccagatatcttgacccccctcccactattaaatccagtgcaaaatgactctctcggtggttttgaggatagtttccactaatgtggctcgttcacctagtccaaccagctgagtcagcatgtgggggcccataagtcacccactctgccaccgtcgagagacatggggccatacaactccctcgagctccttagccaccattgcgctactgtcgaccgctgccttctcctcaatctcccactgcccgagcgccgcgctacccactgttggtgtcgccaaagccgaaatatatagggtgagggagagaaaggggtggagaaggaaatagtgggagatgacatgtgggccttcgactggttggactaggtcaacgagccacgttggtgaaaatcaccctcaaaatcaccaagagagtcattttgcatattaaacttgtaactaggtgtaatcggtgtcatgcatgcagcaaaccgacagggacatattaaacttggacccctattcgggtctccgcggggagcggggacaaggaaaggaccatctccgcccccgcgaaaattgacgggggcatgtcttctcctatttatgtccccgtgaaaaaccaattgtaaccatccttgcttcctaataggtgaattcaccacgagaaaacggtgaacatctctaggcatgccccgccacacccagtgaacaacactcgacatgaggaagatgccgcgcgccaaacattggtgaacagaaagactaacggagaactgtgttttgtcggttttgggcctatttagttcgcgaaaagaaaatttttggatgtcacatcggatgtttgataggatatcggaaggagtttttggacatgaataaaaaactaatttcataactcgtctgtaaaccgcgagacgattgagcctaattaatccgttattagcacatgtgagttactgtagcatttatggctaattatacactaattaggctcaaaaaattcatctcacgatttctcccctaaccgtgcaattagtttttttaatctatattgcattattgcatgtgtttaaagatttgatacgatgtttttgatagaaaaaattggggaaaccaggcctttgtttaccggcgcagggagtcactattcactagcactgaaaatatgtcatcacctcagggagcaaaaaaaaaaagatttaagaaaaaggagatttttagagcacggttggcacaagagaattttattaagataatatggagttcaaacgtaataaagtcattaaacggttagcaagattaaaaaggttgatatagcttgacttaaaaacaatactgatttgaatttcattactaataattaaagataagaaaattacatgcatattcacttgcagtatgtaagtagagaaattacaatttaaaattacaaagaactaccctgatcacttttcttagtaataaatttttagagcacattactctcatggaacatatgcaaatttcaaaatctgtctgttacggtaaaagaagcaactggatctgaatggaccatgaacttaggcacttagcccatgatagcacggaagttaacacacatccatcagtacaaaatctgattgttttctcttaaaaaaatgtcaacacaaatctagcaaatcccccaaagaaaaatgctacgagaagtggacacaggctgaccgtactttagcggtctagctaaatttccaccatttgcctgttgccttattaatccgcatccatagtttgatttttgaaatatactacctccgttttttaatagatgacaccgttgactttttcttatttgtttgaccattcgtcttatttaaaaaatttatgtaaatggataagatataaatcacacttaaagtactatgagtgataaaacaactcataacaaagtaaattataattacgtaaattttttgaataagacgaatggtcaaacatgtgagaaaaagtcaacggcatcatctattaaaaaacagaggtagtatatagttaattttaaggttttctgattgtagtttattttctaaaaccatcgctaagaacaaatataaagtttaaccaaatttattttgttgttctgttagtttttccacggcttatgagatgtaaagaaaacgatgaggtctaggttctacacggtgcgaattcaacctcggggtgactgaacaaaatgtatattttgtcaaatagtcagctacaaaaaaaaaaggaacaaatccaccttgcacctcatatcattgggatacaacttttccgcagcaaaacgcagagcttttatctagtttcatcgcaattcgtccatttcaaacagaacccgtggcttcaccaacgaatataagcatatttataaggatccataacgattccattgctagccacaaattaccataaacaagacaacagacaccggagaagttgtctagttcaagcagatgcataaccaaaaccaagtcaaatttcgcatgaaacaccaaatctaaaattatagctgctaaattactgctgctttcaccaaacttacattcatcatagtggacagtttcagtccaaatacagcctagtcttgccactgttcgttcaaaccttcacatggtcattctgcttccctgcatcaggcaaaataaggattcagacataactcagaacacaagttattcccagcaaacaataaaataaaataagtaccatcataggtctcatgacaatgaattaaaataaatggtcaaatggttaagaaattccaatcgtcacaagagatcgggtgaaattgctttatgaaccaccgaatttacatactgcagttcggtaacatcgtaccatgaaaagaacatataaggatttcttgttccagaccgtgaagctacctgagtccagtgcatacttttgtaaaatataagtattgtgttgcgccgtttaaccaagcacagacttgttgacagtttaactcaacagaataatcaccggatatcaatctaagctaaccatgaggcagaccggtaacatcataccatgaaaagagcatatgaggatttccaattccagaccatgaagctaccctagtccggtgcatactttttttgtgttgcgcaattttaaccaagcacgtacttattgacggtttaactcaatagcataatcactggatatcaatctatgctaaccatggggcggacgtcccatatgaacaggtagatatttgggttacattagcaatggaaacaaccttaatcacagcttttgatgatttgatcaagcgtgccaaataaaagagccacagccagatctgaatctaatctagagcataaatgcaggatcgcagttgtatacaacaattgttggcttgttaaacatagttccagattaaaactgtattcgctagttgcctacctaaaataaaaaaaactcaaatgtttaagcaaatataatagataacctaagaggatgattactactccgtagttaactagtacttacttttgtgggcatgtgtactttaatggtgtataccagattaataagggttgggtgagcacaggggatggagcacagtccctaaggaacaatacatcgaagcagatatctacactatcttaacgacagagtcaagtggtacaaaacaattcagtgaaggctagaaagcaacttaatgatcagttataacctttacagagtaaccccccccccccccaacacacacgcacacaaaaaaagagaaggaaatccatgcagaccataaatgaccttcatccaggttgcctaatactaaactgattagtcagctaatcaaattctcaaatgcagcttcctgacaatttgtcatgtcataacttgggtggaaaactatactgcattagtcagcaaatcgaaatctcaaatgaggcttcctaacgatttctcatgtcacaacttgggtggaaaaaaggaagactgcattagtaagcaaatcgaaatctcaaatgcagcttcctaaagattttctcatgtcatgggacctgattgagcagcaacgtaagggtgtaaagaatggaaagtgtttgaagcttacatagttaaagcagcaacaaccggcgaaggatgagccaaatgacgagtccgatcaataagtttgtaaatctgtctgtgctgtttggttatgacagtataattattgtcctcagtgtcatcccctccaacctgagagtaggtgcgatgaacgatacgcgctttatgcagcttggcgtctggaccaggagtagcagcagatcgaacgtcgatggaagagaagatgcccttccccaaggagcagaaaagctgccctggaacaatgcccttggacaccacggggatgttgaggatggacaactccgtcttgtgtgaccctgaacttgttggctgtaaggggaagaccctgatgtcgtacactgcagcagcaccgccattggctatggagcgggcaatgaagaggtggccaccaaggggaacagccttgccgatgaaaggcaagttgttggcgtccaccatatcccactggttggtgtccatgtcgaaagcgcaggtgcccttgtcttgctgcacggagagcagtatgtgggagccgaccacggcgtaggaggcgacgcggacctccggcgggtcacggtactcgagcgggttgaggcggacagggaagatgggcggcggcggcaagtggtgccatcccatggttctcgcgtcgtgaggggcgaccaagacgtagttgaggtcgaggtacacgaaccagggcaggaagtcgaggccgggcacgacggaaggggttcgggagagcgcatacagcttgctgccccgcgggatgaggacgggccggagcttaggctcgacgaggaaggggccggggatctccatcgaggtcttggggtcgtacaccgtggtgaacaacttgccgccgacgcctacgatccggggcccgtagcgcgactccacggtggcgaaggacatcccgcggacgttgtgaagcacaaggtgggcttcgccgccgccgccgccgccgccgagctcgacgatggagtgcgcgggcacctcctggtcatcgtcgtgctccaccgcaaggtacaccggcttcccggcggcctcgcgaggagaagcacgacccaggcgattaagcctcagtcccaccggcgccaccgcgccgtccttccccttactcctcctcttcttctggctaggcgtcgacattgtttggtctgggacttgggatggggaacggcagcggcggcgagtgcgagtagacagagaaagaggaaggaaaccctacataggccgggtcctcctcctcattggcccgagtgaaacggcccatgctccgccatggcttttgaatcggaagtaagtccactttgactccctcaaatatagctgcaccgcatatccaacagcctctccaagtgactttccaagccaaattttagccattattataaaaaaaaaagggggttaattggatccatgctattgcaacttttctaaattaaaaaaataccactactattcgtcatatcagctacatatgccactcgaaatgtctaaaattagaattatgtcactctagtcactttttccgtcctgctctctcacgccgtctttgttcccgtccttatccccctccctccttcccgtcctcccgctcccaggtcaccactgctggggacaacaccaccaccgtcgtcgtagcctacgcaagggtcggcggcggcggtgcaagaagacgaggctggcttgtggttcctgttcgctctcaccgactcactggagaaggacatcatctcggacctcttctacgaggcgctcatcgcagcggtggtggcggctgcggctgctggcccaggcgccgacagcgacggcgacgggcataaacctacatccacgaccaaacctatggagtaatccacacttgaacacctcgagacccctacaccttctccaccacccggaagcttcctcgccctcgccacgcacggtcgctgactgagacggcggcggtggcggtgtcgccgcatacggagacggcgtgcctccccatgaagccgcccttgtcagtcgtcggcctcatgtaggaactggtcgccgccttcctcgtcgtccccttccgtctacggtgcccatcacccgctcgtccgccaccaccaccgttgcggcacccactctccctcacgagcaccctctccaactcccgcgtgatccactccacctcatatatgtccaacagcatcatccccttccccggcgaccgcgccggtagtggcggctgcggcggcgaaggaaagccttgcaaggacgacgcggcaatggtggaggaggagcatggcgggccaggcgcagcgtccgaggcgccacacgacctgatgccgccggccaagtcgacgcacgcgtcttgctcaaggcagcaaatgatgagcctggcggatggcgacgacaatgccggggacctgtcggtgctcgtccgggcgaggacgtccagtggcgcggcgcagcagaaggcggaggctggcggcgccacgtcgtcatcgatgctaagtgcgatcgggtcgagcatatgtggatttgttcggattcgcccttgtcgtcgtcgatctgactcactcggacctccttgcctagttcgtcgtcgacgtttccctcgccgggaggtccaccgcggtggtcgggatgaggacgggaacggagacggcgtgagagaggaggacggagaaagtgactggagtggcatggttacaattttagaattttccagtggcatgtagctgatataacaaatagtagtggcattttttcaatttggcaaagttgcagaggcatggatccaattaacccaaaaaaaagcatcttccaacagcgtctccaaatggccaaaaccttccctccactagccaaacatggccagccaaagtcactagtcaaaggtgcgccccacattcattcctcctcccatctacacattcttttcttcgctggtgctcgttgctgttagtcggctagcgttgacgacggcatggagcagagaggcgccggagctgcctccctccgcccgcataccccctgttgtcgtcccaatcttccctggagacaggatgcctccgccgcccctgccgccgacgatggcatggagcaaagatgcaccggagctaccttcctgtgacatcctggcccaatttggattaggtttgttatgcccatgtgagttgtgtgcgcatatttagtaccaccttactagcttagtatgagtggaaccaacttataaagcctattcccttcaactatatcactctcgggttaacccttttacacgaagcgaggacgaaagtgtaagtggggtggtatgtgtaagtgggcctgcccgtcggatgggctggctacgcggttctggagggacgactgttacaaatggtaccagagatgacccttgcggttgcacgtaccggtcagtgtgcaggcatatggcgcatagcgatgtgggatctgtgtgatgcattgcctgtgtggaaccaacttataaggcatatttggatgtgtgcgcatgtttactaccaccttgctagtttagcatgagtgaaaccaacttataaggcatattccctccaaccatgaggcatattccctccaaccatgagtggaactaacttataaggcatatttctccaaccatgagtggaaccaactaaggcatatttagatgtgtgcgcatgtttactaccaccttgatagtttagcatgagtggaaccaacttataaggcatgttccctccaaccatgagtggaaccaacttataaggcatattccctgcctccctccaaccatgagtgggaccaacttataaggcatattccctccaaccgtgcctccaacccgttacaaatggtaccagagacgacccttgcggttgcgcgtacgggtcagtgtgcaggcatatggcgcatagcgatgtaggatctgtgttgatgcattacctgtgtggaaccaacttataaggcatattccctcggttgcgtgtacgggtcagtgtgcaggcatatggcgcatagcaatgtaggatctatgttgatgcattgcctatgtggaaccaacttataaggcatattccctctaatcatatcaacttataaggcatattccagccatatcatattccctccaatcatatcaacttatatggccgttacaaatggtaccagagacgacccttgcgattgcgggtcagtgtacaggcatatgacgcatagcgatgtaggatctgtgttgatgcattgcctgtgtggaaccaacttataaggcatattccctccaatcatatcaacttataaggcatattccaaccatatcatattccctccaatcatatcaacttatatggcgcatagcgatgtaggatctgtgttgatgcattgcctgtgtggaaccaaccatatcaacttagctgtgtgcatttgccatgtgagctgtgtgcgcatgtttactatgtttagctgtgcgcatgtttactatgtttagttgtgtgcgcatgtttatgttaacagtgaaatttggtaagccccaaagtcaccatcagcttggagtcaatgtcggcttcaaagttctagaatcagccgatgagagtcaagtcgccacgatgtcgtgttctcgatggagtcggatcaaagagttcgagttcaagaaggatgcggcatggcagtttatctattaattaggaatagtttgttagtttccttttgtctttaggaaagtgtgtttagtgtccgataaggactttatgttttccttttatctttaggatagtttctttcttgtccagcaaggacttgtattaacccatgggtataaatatgtgcacccggggtctatgtaatctatcaatctatcgatcaataacactctcggtgcatcgccaccctcttccctgaggtttttacttctcttctggcggaatttgggcacctgacgcggggctgcattggcttttgatctccagcgaaggggtaagtcctacattccgtcgggccctagtgaatctgtcatctacatcggcgtcgttcaaggctgcattgttatgatctcttggatcactctggtttggttgatatatttgcctaccaaatatctcaattatatctctaattgtattgtgtttagagacgaatcggtttagctgggattatctcggttaggtctgatctcctgtattagccgatatatctctacaatcataatgttgttctaaactgatttgttacatccatcacattagacagatctatcggctcatcgagtattagattatcatatacaatctcgtgctgcatcggttaggttcgacctactagattgttgttgataatataagtcttattaagccgataggttcatgctaatgttttatcggggtgctagccgataagttatctggacgttgcatcgacttataaggattgcatatacatataagttggatttagccgatggcaacaaaggtttcactgtttaatctaatcttgtggattttatgacattggacctccagccgatgcatgctttaaccttcgggtcaatacttgttctactatatcatattgttagccgattggtttctattggattatattgctatattatattatcatcagccgattgcatttatatcattatctacattagacatatagccgattgtttaaaccctatcgctatcggctggtatcgacatcgactattatcggctatcggctggaactactccatcggtttgtcagcagatcggctgtttgatctattatttgtatatcttgtcagttacaggatcaaactgactggcacgcccgcatctcatcaatctttggacctgcacaggagttaagcagatctcccaggccggtgtgttcgattttttcgtcaatagtttactaccaccttgctagtttagcatgagtggaacctgtgtgcgcatgtttactaccaccttgctatgccgtgtgcgcatgtttactaccaccttgctagtttagcatgagtggaaccaacttataaggcatattccctccaaccatatcactccttgcatgtttactaccaccttgctagtttagcatccaaccatatcactccttgcatgtttactaccaccttgctagtttagcatgagtggaaccaacttataaggcatattccctcactccttgcatgtttactaacaccttgctagtttagcatgagtggaaccaacttataatgcatattccctccaaccatatcactcctttgttcggtcacttctcttctctttgttcggtcaattctcttctcgtttaaccgaaaaaaccgaattatcaaaaaagtctaaatgcaacctacaatccactacgttcaattaggactaagctctaattttcacatccttacttattataggcatgcaacctaataagagtatttactcataagtgcttacgaatttttttgtaacttttgtgttgaaaatttccattttctttgcatatatgaaaatgttgttgaatttcggtcaggaccgagaccgaatttgtctgtcctgacattttttgcattgaaattcggtcttcaattttcaaagaccgaaagaccgaagaccgagaccgaaattttcggttagaccgaatgcccacccctagttgtgtgcgcatgtttagtttagcatgagtggaagggtgtatgtgacatcctggcccaatttggattaggcctgtgtggctcatgtgagctgtgtgcgcatgtttagtaccaccctgctcagggtgtatgtgacatcctggcccaatttggattaggcctatgtggcccatgtgagctgtgtgtgtgggccatgtgagttgtgtgcgcttgtttagtaccaccttgctagtttagcatgagtggattcaacttataaggcatattcccaccttgctagtttagcatgagtggaaccaacttataagtaaggcatattcctttttacacgaagcgagaacgaaagtgtaagcggggtggtatgtgtaagtgggcccacccgtcgaataggctggctatgcggttctggagggacggctgttacactcccttcgtctgccggctctgctgcaagccgaggtagctccaggccctcgctgttggctaaagagggacggagttgacgccgctcattgcctcctcctctctcatctctcgcatgccatcaaggagcagatccacgacgttgccgccacctcacatgcccttcgtcgccgtcacctcacacgcccttcatcatcgtctgtcgtcgcctcctgtgcacgagcccgcctcatgcgagcacggatccgccgtgcgtcattgccttgtgcgcccgtcaccatcgatgttcgtcgtcgcctcacaccacagtaaagggagagtaacatcgacgcctcacaccacagtaaagggagagggcgctgaaaggagcttggggtagttgtagaggaggaagagtaacatcgacacaccacagtaaagggagagggcgctgaaaggagcttgggggtagttgtagatgaggaagagtaacatcgacgcctcacacctaaagggagagggcgctgaaatgagcttggggtagttgtagaggaggaagaataaagagtaaacatggctaggaaaaaggggagaaagaggaggaggaagaagaagaggcagtagaggctgacatatgagtcccacctgtcactgactcataatagagagtgtagatggagagtatgttgaagtaaagtgtttgaagaggctgatttgggtattatgttggagatgctcttaaaaccagtgtaatttgattccctcagcggttttagaggatggtttcactgacgtgacacgtagacctgatctatactgtggagtcatcctgtggagcccacacaccattctcccattcctttccttcttcctcttcctcttcctctctccttcctcttcctcattcggcttctccacagtgggctgtgggatgattactccgctgcccgtgaggagatggcacagccctagtcatttcttttttaataatagaatataataccggcatttgcttaacaagttataaccaattattacacaaatttgctcaaaagagtaccacaaatgcacacaaaaaatcttgtcatcttgggcaccaccgcaccagcaaattatgaatacatatcgaggaggctttcgattatttggccgaactcacctatcattttcttgtttctggaatcaaacacaacccggcgaccttgaacactttatgctcttaaaacacaactgttccattgcaatcatacaaatcgcattattactgtaaaagtgataacaaatcacgagatgttcttgaccatcatcagtgagatctgatgtatatcactactctacacaacagctaaagatcaataacaacaaagtggtattttagctggagtttgagaaaagagagtggcccttcatgcacttctcaagctctcatagctgttctggtcctgaactccgccgtattacttctgatcatctctgtcatttgggcatacattacaattttgaaactgcactttagtatcccatcaaaactgaaaaaaaaaagatgatctaagagctgcaaatatgtatgtttagaacaatgaagaataaactgattttacattttctgattgctttactcggccatcacatggatcttgggctcagcaatatttatgaataatgatgttgtggtaggtgtatcatccaagaacatgaacatatcacttgtttctatatcatgctgctgcagtgtccctattagaaatctaatcaagcatctctgaattccatcaaattacaactacaattgtgacataagatagtgccgatgatagatcacattttattcaacgccatgtcaaataaatacaaagtcaacgtgtcacattagccgaaaccaccatccaaaatcatcttgagactatagttgcactcgttttggaaaatgagggatgtgttggtactggttttaggtttgagtgacgcgatccaaactcgagcattacatgagtgacttaaattgaactttttccgcgtgagaactagcaagtgggctgggccgtgtccaccgtgccgctagcgggccggtccgcagaagacaaaacaccgggccatgtcgacacggcctactttgtcagttccatcagacacaaagccacaacaaaagtctaaacctctagctacccaaaccaaaccctaatttctcttctcaaaaaaaaaaaaaaaatccagcggcggcggcggcgcacatggatcagatggcggagcggcagcacaagaagcggaagccggagaagatggccggcgcgcgcaccagcggccatgataaggaggaggagaagaaggtgaaggctccttctgtgtacctggtggtaggccatgaggtgagctgggcaacctactccgtgttcaaggtggatccctacgcggcggcgaagagaggcggcggcggcggcgacgaggaggatcccgctccggtgcctatccctcgccggctcgcccgcatcagcgccaagttctgcatgtctttcgcccccgtgcccgtgcgctcatggatcgtcggcgtcgggggcgattcagcggatgaggactacgccccggagaccatcgtcttcgacaccgagactcgcgccgtgatccgggggcccaacctcctgtcgaccaagctccacccggttgtgctcaccatcggccacaagatctacgccctggcacggtatccctccgtcacggggcaactcgacttcgttccatggttcgaggtgcttgatctctcccaagcgcgcgtggtcgatggccatctagagagctgcgagtggaagcccctgccacggcctcccttcttcccatgggacctcaccccattgcagtacctttctccgccaatggttactgtcgagtcctacgttgcactggcctcctgcattctggtgtcattatctcagcaggagggcacgcacatgtttgatgtcgacaaggagcaatggtcgaaactggatgacaacagcctgccattcgtcagaggcgccgttccacacggacccatcttccttggcttatcgagagccaagaaaatcatcaccgcatacaatatcacagtggtctgccaaccaaggtcaggcggcacagcgccgtccttatcaattgttgagttccctgtggtgtctgacatggaagaggagatcttaagcacaccaatatttctttctctcggtagccctggcttctgttctttgaaaagttggagcgaccacccaacgacggatgatccatgtactcgtgcacgtatcaaattgatggcataccatacagaggaacccatatcacaagagtacatcgagtcttctcatggcttattgataccgaaccagtggaaacaggtgtacgagatatgtgattcgtccagggaattgatttggcaatgcctgatcactgcaatgtccttatgagtaagcccctttgtcacatctagtccctggagtcaatggattgtggatttcatttgatttcttgcactgcctgtttatttacaactgcaaccataaagcatctataagatgacattactgctaatcatggattaacaccttagcacggtactgctacaatgtatgtcaggattgttggttcggggtgtgtatgtttgacattgctatgcctgttattgatttgcgatagtgaccacatagaccttgtcttcataatactgaagataaatatcaatactggctttagtttatataagacgacataaattgcccagagctgtctttttttttttttgatttttagtttttttaggaagcttctcatatgttagttctgtaaaggtactcgatttaagatttgtatctacaaaaagcaacaatctacaacagcaacagtatatttgtttgctgttaattagtttgagaaatatattaacattgctcaatcctgagctcaaaaggtaaaagcctactaatcctccctaatcttgccgctctttatacatgttaaccattggcgtctttattcttatatctcgtgttgtttcatggctttgagcttgggcccattaatgtgaatggtgaggcagcagagttatcattgaccatccttcatttctaggtcataaccttttctagactacataagcgacaatttttgttgtaaacttgtgatggcttttcatggttttgatttacacatcagctgtttactactagagtgattttagttgcactcttaaaatatttcagatggaaaaagaaaacagatattatagaagaagctgggggtgatctatcactctgcaagattgtatgttgctagctgtatgtagatatatgttgttttcaattttctttgcacgatgatggtggttatagattgatctctttactcgtgtacatgattgttagatcagaggacgaatatctctttttccatttttaacttaatcttgtagcttacttagtaagcacccatctcctggagccggtgcaacactataaaattcaaccacataccacaaacaattgctatatgtctacaaatatttttcctggattgggagaacactgcaaataatataactagaattcggcaaaaggatcattggtgctgaagctcctattttgttctatggttgctacaaccatgcattgattttttatctctttctttggagattataaggcatgtgtagaaagctttggttgcatgcttttattaccagctttgtgtggctactgggctagtggctatattcataaataggaaagcacattagctccaggatgtgatgactgatgagagcacatatggtgattggggaatgcagtaaggtcgtaaattctggcaataaacttgttatgacttaccttgcttcctatggtggatattagctccagcagtaatatgcctttaagttgaaaatagcattcgttttagtttgatgttgtcacatgcatacctgcttttttgtactgtatcataaaactgaaaaaaagtattccagtaagcccataattcaatcagtcaataatatatttacctcatgaaatgtactgtttgtattgaagctgcttgtattagctgtagtatgttatacatgttgcctatttatgcagttaatcgtttggaacccactcattaagtatgccgtcttttttggaagtactttgttcaatgtgcagggaaaatgttgtgagagctttgttgattgaacaactgtcattattatgctatttcgtctatagaaacatgttttttgggcatttcactattagttcatcggttaaaaaaactcatacaacattattgggcaagcatatgcttcctataatctttatcagattgccaatatcattgtttgttctgttgtggccttccctgaatctggtatgttgggtaattacaggtgtataatcttacgaacactacaaagtaatgtgagtttgtttgtgttaatcacattccacatgtatactgccttaatctagctcattttttgggtttaaccgtttattggtagcagttttaatatttactctattttacatataattctcaatattttatggttccacaggtatattccatgatgttggagccaccagaagtttattgtagaggctggcttaagaaaacggtttacttgtagcaccctacaattccagtaaattcttcagagtacaacagctttgcatggcttcgaacttagggagtagtgctgcagggcatcttttgcttgtgtattaagtggatttagaatatgatatttgaggagaaatgatcccctgtagtatctatgctggactgatctaattgaacctgtctaaaagagtttcatgtatgaaacagctgtacgtatatgtgatgtgacgtttaatcattcgtttaactaaaaaaattatataaatattatttactagcaaaatatgcccgtgcgttgcacgggtgaatatcaaacaaatatggtccttgtgtacttataacacgtgcaaaaagatattgaatttgtacatattcaaattttatacaagaaaatatcaaaacatctcatactgtatacacattcagattcaggttgtatctcaaattttatagtacatgcatgagatattctaagttttctacacattcagaacatactccaactttcacaaatgttcacaagagggtgtagttacagctctgacttcaccatcctctacaaaaggaaaaaggtaaaatgcatctgcaataggaaagaaacatgcactttgtagtatcataataaattcactcaaaaaactttagtggaatatgttcggattatagaaataatttaatatttaagaaagtaataattatcttgacataaaaccatattaacgcttatcaaatacaatataacataattaataatttctagataattttttagtttggttcatttatctaaaaataatttactgagtgatcaaataatcgatcataatttcgtagcaattttaaatggcttaaaatagtgccaaacaaatttctgtaaatctaaaaataattaaatcaattccttagaaaaatactggattttcgcttaaaaggctcgaaccggcctagcactgtgcggcgcgtgctagtgcacagcgacccagccgataggcgcgatcgcggcccagcgagcagcgcaggcgggccgttaatttctgtggcccaaagcgggagagaggatggccgtccgatccaatggacgtccaagattgcagccgctccagtgaaattgccgtcggatgagaggggaaaccctagccctcgttcttctcgttttctcaatcccctattcccctttctcccatgagcgagcgagagagagaggcaacgacgatggtggtccagcaagtgagaagaggagtatagggtattaagtagacttttgcatatgcgggctgaagaaaaaaaataggctgaaaaaggcccatagagaaaaaataatttttatttaaataaatgctgaaatgatatttgtattatcaaaattaccaattaagctatgtaaattctaaaaaaattgcaaagagtgtaattaatatagaaaatttaataaaaactaaatccaaccataatattttatttctcacacttactttacttgaaaattaatttaattatatacctacctccttaaaaataccctaatattctagaaaatgtgtatttcatttaattagaatttaactagcaaaatgcccgtgcttcgctacgggtataataaaaggttaaatgctatacatacaccattaacatgtatataataatgttccaacatagataaattattcagtgggttaatgataatcaggactgataagaaacactattgcatattgatatactcatattttcataacatgcactctctctcaactcttgcatggcaagcgcctaatataattatttctaaaatcgaacatggacttgcgtggagatgaatcattttcacggctcatgcgtggacgatagatggtgcggactctaatatgtcgtgttttgcagatgacgaaaagaaaaaaaatatgtttaattttcaaattaaaaaatggttcattataagatttcagaatcactaaatatctgttgaagaaagaggtgcaaaaacttctgattttttagccatcggattcatggcaagcgcttgatataatttctaaaatcgaacacggacttgcgtggacacgaatcattttcatggctcatgcgtggacgatagatagtgcggactctaatatgtcgtgttttgtagatgatgaaaagaaaaaaaataattatgtttaattttcaaattaaaatctggttcattataagatttatcactatctgttgaagaaagaggtgcaaatagatggcgcggactctagtatgtcatgttttgcagatgatgaaaagaaaaatataattatgtttaattttcaaatttaaaagtgggagggaaagtagacttattctgagtaggatttgagctgtgggaggcaaagtagacttattccgagcaatgatttgagatatgggaggcatagtagacttattccgagcaatacaacctaggaaaggtgaagtaatgagatgtgggaggcaaagtagacttattccgagcaatgatttgagatatgggaggcacagtagacttattccgagcaatatagccgtatataaaaaggatggatgatgggaatcgaaccctggtgggcaggttgaaaattttctccaccaaccaggtgggcaagctactacttgtgattgatggttacattactgatacatatcatatattaagcaaggttttggagtagattagaaaacttccgaccgactattaagcggattaaaacgtattttggcaagagggagacggacgaaaagaagaaccggaagtcttacgtatttttttattattaggtatatatatatatatgttttaattcaattttctctttttattttcttttcattgcaacgcattgtcacttttgctaaaattttaaaatgtataattaatattgtagaaattttgtatttcattaaattagaatttaatatgttttaatttaattttctcgttttttttctttgcgttgcaacgcacatacaattttgctaatttatataacgttacctgaaaaaaaaaa

SEQ ID NO: 75455 - DNA, 3001 bp, Oryza sativa
aaaagtaacaatgtccaatattttttaaaaaagaggtacttcatattataagtagtctaagtttaaccaaatttatagaaaacttagcaacatttccgacacaaaagaaaaatattatcaatatacataaatgttagttttagtgaaaccaatttggtgttgtagatgttactaatttttctataaacttaatcaaatttaagtttggatataagaaaagtgaaaacgacgtaataataatataaaatgaaggaagtatgattaaaaaaaaagaaatcgaaacgatttataatctgaaacgaaggaagtcacttgcctgccatggttgatgcactgggacttgcactgctgggtgagcttgaaggcctcggggcagtaccaggtgatgtagtgcggggtgaagagggcgtagccacctctctccatgatctgggcgtggccgcggaagccgcggacgaactccatctgctcgtcgcaccgggcgccgcactcgtcgttgctgttggtccacagctcgtactccacccgctcgtcggggtggggcatcgactcgcgccagtccagcttcaccaccacctccaccgccgcctctgacgacggcgacggcgacgacatcctcttgagggactcgccgaacgcgcggttgaccagcgcggacgggatgctgatccggtcgatgtactccgtctccggcgactcctccggcgtgtccatcgtcagcagctgctcgtccacgttgtccgcgatcagcaccgccgccgcgcccgcctgctgcgcgttccacgccttcagcgcgaagtagcactctgaatatcaacaaacggaacagtttgtcaggctcacatacatacagggggcgtaagtggctaacccggcgtaagcccacttataggtcaaaataaacgggctcgtggtttattttgatttactacagtggatttcgcgggttggtcacttacatcccacatagtcatagtatgtaaggttatcaccgacaaaagaaattaaaccataatgtttattagcgattaaaaataatttattggtaaattttttatatacatgttcttagcgatttaaaagttaatgctgaaaaataaattacggtaaaaaataaccaaaatatacttaaaataaagatttaaaattcaaatagttgactgataagttaaagaataaaaattcaaacgatgaagctgattatctgcattaaaaatattaaaattgcttcttctttattgcaactaaaatgcactgaattgagtgagaatttcagtatattagtacagaataagtgggtcaatttgcaattcctatttcataatctgatggtaaaagtgtcctggtgcagagttcagaatctgatggagagtggcttggaaacgaaggatgaacaggttgttcagtgctgcctttggcttgaaggaattgagagacacctgctgattggtagtggaggagttgtgatcaagtgcgttgcagtggttggatcaaataccgaatcaggtatgagattcaaaattcaaagttgcaatggataaatgtacggcatatgtatcaagaacctattctcgctttccttggttcagagttatctgaaactctgacggaaagaaaggaacaaactcgtcgaaatgcttaaagttgagccgaatcccgaaagtaattaaactaagtgtgtgtttgaatcttataagtagtgaataagaagtggttaacatgtcttcaataatggctctgaactaagattccgtcctagttattggtattatgttaggtagtattctgcaatattggacttgtttttccaggcgaaacaaacaaaacaatttgattcagagtaagtgatctcagttctcaaacaatttcaaaaataaattaaaaagttttggtctaccatcgttcaactctgctttcagaactgaattataaattcccttccctcgccacaataaaaaaaatatatatgaatgcaatctttcagacttctaaagttggacaacaatccacatcaaagaattaaaatactatacaacttaaccatcatgcctaccttgatactctcttgctaaccatttcttttgttgtttttttaatcagtggactagctaaccattggattgacacaacccattaacagaacaaaaattggcatgacttagaacattggaatcaaatcatcaccaaaccaaactctcaaaatccaaataatcatcaaaaactaatactacttctcaagtttgttcagttcagacttgcagactttggaacacaaatttcttgaaaaatacttatgcaaatcaaaacaagcacaaactaattgaatcaatcattggaagtttgaaatcaatctcctacctccacggtcgagcaggaggatgaccgggcggcgagacttggacttgaacttggcgtcgaactcggcgcagccggtggccttcttgtcggggtagacgacgacgccggtgagcgtgccgccgtagtccggcacgccgaagttgccgatggcggcgtcgtggtgcccccggatgtgctccggcgagagcaccctcacgctgctcttctccaccacgaacctccccatcgccggcacggcggcgcccaccaccgccaccacgacgacgatcaagaacggcacggccccaatcccggcgagccatggcgccctcctcgccattgctgcaactcgatcacctctctctctctctctctctctctctctctctctctttccaagaggcgacgagaggaggagggaagaagacgacttcaaagaagaagaagatgatgaagcttatgcttggtgggcaccaagattaggtggctctcgctcgcaagtagtataaattaaatagaaatttaaggaaaaaaatgttcttgctgttaattaacaactgtgagacgagctcaaccgtgcaaaggggaatggatggatggatgaaaaaaaacaaaggatatcacgagaagaagatgaaaaaattgtgatcttttgagaggaaaa

SEQ ID NO: 75456 - DNA, 2935 bp, Oryza sativa
  unsure (1)..(2935): unsure at all n locations
attcctgcagcccgcccatcaatcacttgatagtccagtagtaattgtatgccaatatgtcagtttcagaagttatttttcttcagagaagtttcagaaatatgtttaccttcacatttgtggccatctccttggaaacccggggggcatcggcatccagtcaatgcagtgtcctatgaaattgtgcagagagtgattagcaaagatcataacaaacaacgagaggtttttctgcaagtgaaggctagagagttacagagcaagcagagaacgtctgatgacccctagtctctgaccagcagcctccgttgtccaccgtacacctgcctggcccaacagctgaaacaaaaagaacaaacatgcaattacattaaaattcaaaacatggtgagcctgaaatcgaggttcctttggaatgcatgaattttacagaattttcatggcctatcgaccaactatacctttgcaaccgatgtacccgtcgccctcgtactggacgccattcaccactgggcactcgcacaccctacccctgaacgtgtcctgcgtattgttgtgaacacgacgccagaaaaaatcagattaaaaaagctttatcgatatcagacaattacatcgagatgatacaattaatctataaaaccatgtagtaccttgcaagccgtaacgttggttttctcgtctctccagcaaccgccgttcctgtgcaggcactcgttcgtctcgatatctacagttgaagaaatgaaaacagagatttcattagaatttcattccaatttttcagaattccacgaaacaaaacaatatgtttctctgcgttttctacgcaccattgctcaagcagacgcgaggttcagtgccctccttgaagccggcacagacagctttcagcacggccgtcctctccagtttcccttcatttttcacaaccatttttgtttttttaataatggaatgtaacatctatgtctttactcaaagagctacagttaattattacagaaagctatttttattgttgttaggaatctctaatcagcttcagtgtttgcaagtaactaatttgttcttaattatcattcttggcgaaagagatgtgccaaccaacctctgtactggacgttgttgatgacgagagtaggcaagatggtcacatcccctcgcgatccacggccaatctgatcaaaggcaccaaaaccaccgacgttaatggcttaacacatcatgtaatgcaagagacctgcgagattgtgactggccaacatctctgacacctgaagattaaaacgctaaaaaaaattcttctcctaatgacaccatgaacagtatagtttcagtcactttgcatatatacctgatcttcctgctctttggccaagacggcgttgtcggtgtcggcctctggatcgcccatacattccagcaccttgtcaagcgacagacctaaggaaagaaaaaggtcaagaacaaaagaacatttgctattataaaagcaccaaattcaaattatagtgtctacagataatacgcatgtgcggatatgtttttaatacggagttaggaaagtggatcttttttaaaagttacatatgaacaattgcacatatgtttttaatatggagttaggaaagcggatcttttggaaaagttacatatgcagtatgtttttaatatggagttaggaaagtggatcttttctaaaagttacatatgcacatactacatccgttctaaaatatagtaaccgacgcatcctagtattcatatttatccagatttatagtagtaagatgtgttcaattcagctttagtttgatacacgaaacgatttaactattttttgataaaaaatatgacgtcataaatataaaccactcccattagtgaatttaagtactttttgctggcctctatatctttgtagacatactcaaggtacatgcgtgtgatatgcataatactccctcctttttaaattgatcatcatataaagaaatctaaattttcttaaattgatcatcatataattgcatggacatgaatttcatcggaatacaattaatatagcatgggagaatctgtacatactagggtgtaattgatatggtgttttaatcgatacatacattgtgagagaatgtgtatatgatgtcttgattgatgcaatttaaattatccttgatcttgatgcataagcatatatgatgatcattttgggatggagggagtataatactcaaggtgcgtctttcgtgtaatggcaaattagagcaagtaacgaagaacgatgaactgatcgatgagcatatgcacactgaatgtatggtaccatggatctcattctcacctagggccttgacgacgtcctcggcgcagcccttgctgtacttcttctccttcatggagcacctgatcttgtagtccatgacgtagtcccaccacgcccatggccgcccggtctcgttgccacccggtgcacgcacagctgcctcaggttctccaccaccacgtccttcccctcgtacccctccccgaaatcctgctccgggtccggcgcacaatacctgcacgcacccatcctcaccggagctcgatcaaccactccatcgattcatggcgcatgatggtgtccccaccggagacgaagaagaggatactatgatactctttccgtttttcagtttttcagtgtatgacgtcgttaacttttttttatatgtgtttgatcatacaccttattgaaaaaaaaatgtaatcaccatttatttcattgtaaccttaatttgtcgtcaaatgttttgtaattaagcatgtcttaatttttttaggcaaaattggttatatagcatcgaaaggncacatttttggttttatagcaccgaaagttaccggtcactttaatagcatccaaagttcaccatgttcctatttt

SEQ ID NO: 75457 - DNA, 7598 bp, Oryza sativa
ttggaagtacgtctacgcagtttctagattttttttatgatattgttatttggtatgcacgatgtatacacgtaaagatttgtgtgcacatgatatgttcccatcattacacactttatccataccattttacgtgtgtaaagctcgaatccaaaattttaaaactcgtgttcacattataaaaacgtttcaaattgggttgaattcgtagaaatgatttattgtatatagaagcactttttgcaagttttagaccatttctatatagagcccacatataaattacctatacccattggataattttcatacccaataggtatgggaaagctaattataaaatagatatgggttacccataccctccccagtgacatctaaaactccaatttaaactcgatgaaaagatgaggaatgtaaagtagacttattccgttgaaaaatggccgcttgaagctgatgcggcccgtgtcacaggcggcagcagatgccgatcgagaccgagcaggagaagcccatctgtcccgtttgtttcgtgctgaacgctcgcgtcgcgtagcgtgcgatgaggccgtggaagtggaactgggcttgaatcaaggacaccaccgttgcaggcctcgctgatatgggtttagttcgcaggcccacataaaataggcaaaacctctttctttttcccagacaacaaaatgctcttttgcactaataaataacggaagcatgaaattacatttcaaattgctagttttaattaaaaaaacaaaaacccttcaaattgcgcttgcaaagccaccgatataaaacgtgtttgaagaaaaggtttgggaaccctttacgtgaacaaaaaaaaaactcattagagcatgtttaattaagtattagctaaaaactttaaaaattaattaatatgaatttttctgaagcaacatttttatagatttaaaaaaagacgcaccatttagctgtttgggaagcttgcacgtgaaaaaagataagttaaaaaaaaggagagaaatgaactcaccccaagtcttgcttatttgcaatcttaatgctaaagacagtctacattgcctatgcgctgatagtatctctaacagaatatacaaattagactatccaaacacctatacagctatatctccaattgatttggtaagccaaaatcgttgctcacgccaacagcttcttcatctaccctctccactccaacccatatgacactgcaacccatatgtcagcctctaacatctcttcttcttcctcctatttctccattcttcctttgcttccgctggggccaccctgagctactctccatccctctccctccgtgcggcgacgatgtttgtgtgatggcggatggcgacagcggatccgtgagcgcgctaggcggggtggctgacgcggatgaaaggaaggccgtcaacaaagcgcgatacccatgctatagtggcgcttgagctcactgacgtcccgtacactccccaaccctgtcgttgccgtgggcttcctccatgccagcggaggcaaaggctgtaaaaatcgccgttgagaggagacaacgagagctgagggcccccgagtccatgcagggacggaggctgtgaaggtcgtgtggggttgaagacggcaacgacagagtagaggccacggtggcgaggaggtatgtgtaggctgcgacggtggagtagagggggaggtgcgggatgtggcggtgacgatggcggtggcaaacgatgaagacaatgattgtctcgttagggggattgcgagcgggaaaccatggtggcgaggaggtgcgcagcggcaaagttccacttgatctgcatcgcaagtgggaggaaagataataggaggtagttagacccacatatggcaagtgtagttggctcaccaagtttggtaagtaagggaaggagtttgtccagtcggatagcttgaagagtgggatgaagagaatgcaatttttatccactgttgctaaactttggtttgaagagtaaaatagaaaggctgttgaagatgttcttacgctgttacacgtccatgcccatttttctctctgtcaagattcactggtatgcttacatcaatacactttttcttgttatatgtttgttaccttattagctatagccaatatttatttttttaatttaattttgagttttttttaccataatttattttcttctttggcttttaaatcaacaaagaaacatatacataaaattgctataaatcattttaatttcttttcactttgttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtggcaatttgacccgggaaaataataaaccccgtgggacccacatgtcaatttcacacacaaaaaaattaataataatggtggaacccacgctgccccacatgtcagtctaactcacccctcctcttctgcttcctctctctctttctctcctcttttcatctctctcttgtgctaggggatgcggccggcgatgacgatggcggcggaaatggagaagagtgactgccaggggcataggtgtgacgtcgctgggggcgctttgaggcggaagtagactcttacgacgtggccgtcggaggtgagcgaggtcgtcatggactcacgggattggcggtgtcgtcggcagcggtggagcaggagttgtagttggagtccttgtcgtcgacctcgagttcgtcaatgtgctcgagcatcacccaccattagtagtcgccggcggcggaaggtagcgccgccatctcctgttgggtttccatgggccgcggcgagcggatcgatatgggttcctcgtcagtccggccggaacagtgttttcttgcctaaaacaatgatcattcattcattcatcaaccccgtcataacacaagcaaatgatgatgacgaagcaaaatatactctagtcagctagtactagtcgctattgcttctacctttgtatgattaggcacataaacgcggagcggaggtcgtcggctttggtgccccagccgaggccgtggacgaagagcttcctgctcacgggatcggcctccgccgtgcgccgcacggtcgtcatcatcactggggtcgtcttcgcagtcggccgcctctcccctctcccgccggcgaggtggccccctcacccgcccacgtggacggccgccttcgaggatgcgcgcgtgtgtcggccggtcggcgggacacgttcatcccgccgccgaggatgccgaggtcgacgtcaacatcgtccgcagccacggccgcggcggcgctgcctccgccgccgggctggttcctttctctccgctagtttccctcccaccggccgccgcgccgcgccccttctcccagccggacaccgtcctctccccggcgcccgtgaaccggagagaagagaaagaggagaggggagagagatgaagacagagaagatggtgaagaggagaatcagaatgacccagcgcaagagagagacgaagagaggggaggaggagagagaggaagcagaagaggaggggttaattagactgacatgtggggtccgcgtgggtcccaccattattattattattatttttattgtgtgtgaaactgacatgtgggtcccacggggtttattattttccggatcgaattgccacgtaagggccacatcagtgccacgtcagatcaaaaccgagtcaaaattagccacgtaggtgccacgtcagccaaaaccgccattgaaaccgccgagggacctaatatgcaccggttttgatagttgagggaccaattgtatctggttttgtggttgaaggacgaaaatcggattcgttgacaagttaaggaaccttagatgaacttattcccaagaacaatcggtacgatccaacggcccagaaaccaccgcatcgcaccggaccagcccaaccatttcgtcgagcacctcacgcacgcgctcccctccaagccctaaacccattccccaccaccatgcgagccatcggcccgccgccgccgccgcgaggcggcacgcgcacctccccacctcctactccgccgccttctcctccttctccggcatcggcggcggcgccgggcgcgggcgtgggcgcggcctcccgccctccgcgacgccgccgcgcgcccccggtagccccgtcccggacgacgacgacggcggcggcgcggatcccttctcctccccggcccccatcggccgcggccgcggggaggccgtgatcccgtcggtctcgtcgccgccgcttcccggcgccggccgcggccgtggatcgccgccgcccctcggtgaggtcgcccccaagcaaccggtccccgccaagctgttcgacgcgccggccgccgaggcctcgtcttccgagccaccgccaccgccgccgccgcgcacgctcccttccgctggcgctggccgcggcgtgccgcggatgcagcagccgccagtggagatgccgcaggaggagaaccgattcatccgacgccgcgaggagaagaagaaggccgcgtcggcggcgcgtcccgctcccagcgggcagccgaagctgtcgcccgaggacgccgtgaagcgcgccatggagctcctgggcggtggcggcgacgacgatggcgggcgtggcggcaggggtcgtggtgcccgtggtagggagcgcgggcgcggcaggggacgtgatggcggccgcggccgccgctctgctgatatggaggagaagcatgggatctacttgggggacaatgccgatggcgacagactccagaagcggctcggcgaggacaagatgaagatttttaacgaagcgtttgatgaggccgcagataacgcgctgccagacccgaagcaggatgcatatctggaggcttgtcacaccaataacatggtctgtgcagcaatgcggttgaatccgcaaaattgttagagttgttagatctggccgttcatgcaaggttcctgaattatttgtttcctgtgggtttatgtatgcagatcgagtttgagccagagtatcatgtgaatttcaataatccagatatcgaagagaagccacctatgtcattggaggatatgctacagaaggtgaagccattcatagttgcgtatgagggcatccagaaccaggaggaatgggaggtgatttctttgatggaccttgtactatattatttttctccacagaaatgtttgtgcgagtagatgttttggtacatatgttctcttgcagcattgaggaaccagattgcattagaaaatgccggagaaagcctgcataaatagtgtaaatgatactttgtttttccagcaataggattatagcatgctcaacgggtgcaacgctgcaagtctatagttggatggcattagaatcctagctgcattatcaagttttcataaataaactgatgaactcgagcatgttaatagacttgttccctgtttggaataatcattcagcctgattgaggcttcagaaataattctaatgagtttgcagatgcatattgctgtggtacgtaagtatgttcacagccagattggcctagctttgcactgatatacctagatcgggctgaaaatgatattagtagattttgtgttgtttcacctttcagaacatgttatttggtaagctgatttatgcattacaaatggagcggatataaggtttatacaaaggatttattatctttgttgcatgaacgctgtccagctgattacttagtaattgtgcctgctcctttctgatgaggttaaactgtaatctccagataagtttcaacttgttctaaaatccaagtaaagagggactgttggctacgttagattagagattttaacaggattgggtcattctagcttttatgtatttcctgcagtcctggacttattgaactaaaagaatatctattattccgcttccatgtttctgctaatcagctttaagtccctgtttggaaattcctgtatgacaccacattagacacttgtctcataggcttctactattacatgaaccagtacatgcttgaacttgcagctgtattcgccttgctgctaaaatgagtttttttttttttggtgatgtatacaactgacccagtataatgtaccgtatcactaataggaagctgtgaaagatgtaatggcaagggcaccccatatgaaggagctgatagatatgtacagtggccctgatgttgtaactgcaaagcaacaagaagaagagctgcaaagagtggccaacactctcccaggaaatataccctcttcagtaaagcggtttactgataaaactctactgtctcttaaggtttgttttcttgttataattgatgctctgaacagtatacacatttttatagagaacattattcataatattaatggtctgatatttgaatgttgtcatctttataattcaacttctgatttctgaatctccagtggtgatagaataacacaattcctgtctaattttctaacttgatagacatgtgaaattatagtatcaccctttctaagcttgctttcaaaaatagagctgtattcaattagcatttgaaatttgaattctagctacacaaatgatcaatttagctttttttaatgcaatgtatctacaatttaatggttcgttccaaccatcaaggcataaagtccctctgtagtctgacatgccctgtggtctggtcttactaagctagttctataacatgtctgtgtttatcatcacttgccatctgagatgatatatttgatagtttcttatcctattgctctcaaagatggcgaagtgcacatgctttaagttggctagttcacctgactgaagtactctacatgttggagattctgttatcatcacatgtgcaaaatttaccatactggttgtcatcatcttgtttgataaaatattttcatagccattagaactttttacctgtattcatattacaaaaagaagtctggagaccctgttcagtgtgtttatgtattcctatttgtttcaccttcctttgaagaaacacaaggtgctgcttattgagatgaattcgttcttgtttctccttatatcttttgcagaacaatccaggctggggttttgacaagaaatgccaattcatggacaagttt

SEQ ID NO: 75458 - DNA, 9246 bp, Oryza sativa
ggcatggccgccttcgggcgcaccgagtggctgccgcgtggggcccagccgtcagccgcccgcgccctcgggtgcggctgacgtgtggggcccacggcgtcggcaggtgtgagcccgggtgcacctggtccaccgtggaccgtgaggctgccgcgtgggtcccactcccatggacccggtccgcgcgcccctccccctcggctgatgcaataaaccctttttaaattaaaatttaaatgaagaaattcgcaaatattcatttaaagagcatataaacttcaaatggccataacttggccatttgaactcggaattggaccgttcaagtctctaattattccttaagaagtcaagaacccatttttgtgctttgttcctgcttgttatatggagtttattagagtaaaagccttttcttttccgttggtcatgtagacgctgcagcttcggaagatccgctcttcgtggaggttgaagccgacgttttggaaagcgagcaaggcaagtcacatcatccttgaacatattgaatcccaatttataaaattattttgatttaaattattgcattatcgctttatttaaattcccgtgttatcactgttttatttagccatgcctatttacctttgttatgaccttattattattgctattgttattattaccttgttcaccctagaataaacaaaaccccaactagtggacactctactcatggtaccactagtatgaatttaggtagatgtttcgccgcttaattaggcaacattaggtggttttacaactctagactttgggaatattcatatcacctggacattatggaatggttggattattgtggaattggattcacacctccccctctattcaaaaccctcaaaatggttttaggctgggctcggggtgcatggttttgatagtagcacctcggccatataaggaccggtcttcgggcctctgttgcaaagcactaccatacttccacatttctagtgggtaaggcttagtttgtggctcagtctggttataaacaaaagtacacgagtggagatggacgaagtcgggggtcgatggacatctctagggcaaatgaaggctacacgagctgcggcccggtagtcgagatgtcatggcacagggccgatgtcctgctgctaggggctcagtcctgcctacctgtcccggaggttccggccgtaggtggggttgggtcggtactcttgtgtatggctaggatgggttggaaactatgtcacgtcttccatccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacaagctgggacccagggtcgggttgccagttcggtctgaatcatcgtaggccttgggttaaggcaggttcgtgtgggttcacggccttgattaataatattgtatagctctagggtcgtatttacaaaatagctttgagcaactaagtgtcttttaatgctgtttactgcaaaccctaacccctatattatggctcccttgtactcccttgcatttattctgcacttatgggtgtgtcttattgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttcttttgtcttcttgtgtgctaggcctttgccgcccatgtaataaattaactatttacgcttccgcttgataaactctgaaatgtatcaacttttggtgtaccttgcctcctgggacaaggaataatacacgcacgtaaggaactcccgttgggttatttccggtcgtgacaagttggtatcagagcctccttgaccctaggatgagctttagatcccaagtcttagcaatattttcgaaataaaaatccttccttatttgttaaaatcctctagtctctctctgtcctgctgcttcatttatcgtcaaaatctgatctgtaaaatgttgcttttctcttttgtttttgtttgtagatggccggtagcatcaaccgtcgtggcctggacctgactggcttcgttttggagctgcggggcatgtgcgttgtcctggggtatccgcatggagtggactaccaaggcaagcagctcccggagcaggagggtgacgatgcagagccccacgctgcttgggaggtcactgcagtgatcctcactggctcacccgagaggacttcgttggcagtcaccgcgggtggagattctttctccgctgcttgccagaacgccgcactcctcgccattggcactcttcaccagtgctacccggacgagttgcagcactcgccctaccgctaccaccctcgtcgcggaggagcccgtgactacgccaccttcagggatgctagctcggaggatgacgctaccatcatgcacttggcgcgcatggtggaggcgtacgacgcagcccgtatcgacttccatcatatggtgcgccgtgggttggtcgagaacaacatgaagatcctggagctgcgtcaggagaatctgcagctgaagaaggacttggacacggtggaggcgcagctgtgtcagctcaagatcgcccagggagaggtctgtcgccccaagcgccgccgcgtctgccgcagtatgaagatcaccgcccgcaagagtacctccaggcccgagcttgttcgtcagtccttggcatggacctgcttcgtcgagacccctcgcgccgagcccgcaccctcggttcctcaggaggagggagcctctggcgttggcagcacggaggatgcgctgctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggagaagtgctgctaccggtgaaggcagtcaccccgaaggcagcaaccacaacaagcatggcagcccacctccacctccttccccgccaccaccaccaccaccagacaccaactccatcctcacccaaatcctcgcccagcaggccaacatgatggctgctttcctccatcacatccaaaatccgccacagcataatgctccacctccaccaccacccccgcaacattctaaactcgctgagttcctccgcatccgtccgcctaccttctctagttccaataaccccgtggatgccttggattggttgcatgccgtggggaaaaagttggataccgtgcagtgcaacgatgaggagaaagtcatctttgctgctcaccaactgcagggacccgcatctctatggtgggaccacttccaggctacgcagccaaaaggacagcctattacttgggcccgcttcaccgccgctttccggaggacccatgtgcccgccggagtcatggcccttaagaaaagggaattccgggagttgaagcaaggcaaccgttccgtgatggagtatttgcatgagtttaacaacttggcccggtacaccccggaggatgttcgggaagatgaggaaaagcaggagaagttcttggcaggaatggaccctgagctgtccgtgcgtctggtctccggggattatcctgatttccagcgtctggtggacaagagcatccgcttggaagccaagcacaaggaactggagtcgcacaagcgtcgcttggcgaatttccgcaatcaacagggggctaaccaaagggtccgctacaccaatccctacccagggggatcctcctcgtagcagcagcagcagcaacctcgctccgcgccccgacctcaattcgtggtgcgcgtcccacagccgcagcaatagcagagtcagcaagggacccgtgcgccccgtcctcctacgcccgttgtgcagcctagtcaaggccgcaaagacgctcaaggtcagcagcgtctgtgcttcaattgcttcgagcccgggcactttgtggataaatgcccgaagccgcggcgccagcaaggccaagcgcctccccgccccaacaacggtggtaaggatgtcattcggggtcgtgtgaaccacgtgactgccgaggatgtgctgacgactccggacgtcatcgttggtacgttcctcattcattctattcctgctaccattttgttcgactctggagcttcccactcatttatatctgtgcccttcatggggagaaatcagttgggggtagaaaggcttaggaaccctctgctcatcaccacccctggaggggttatgacagcaaagtattatagccctgccgttcctatagaaatccagggaatcccttttcccttggatttgattcttctggacaccaataacttggatgtgatccttgggatgaattggttggctcaattccaaggagtagtggattgcgcaaggcgcactgtcactctgtatcgggggccggaacaaccggttgttttctttgcaccctcaacctctgtcggcagttcagaacttcatcagataggactgtcagaaatacccatcgtcagagagttcggagatgtgtttccggaagaactacccggtatgctgcccaagcgagagattgagttccggatagatcttgctccaggaaccactcctctatacaagcggccctaccgtatggccgcgaatgaactggccgaagtcaagaagtagttggaagagctgaaggaaaaggggtacatacggccgagcacttccccctagggtgctctcgtgatttttgtgggaaagaaggacaagacaaagaggatgtgtgttgactacagagctctcaatgaagttactataaaaaacaagtaccctcttccccggatcgatgatctgttcgatcagcttaaagctgccactatcttttctaaaatcaatcttcgctccggatatcaccaattgcgtattcgtgaagaagatatcccgaagaccgcattcaccacgcgttatgggctgtatgaattcacggtgatgtcgttcggtctgaccaatgctcctaccttggataagtttgttgtggttttcatcgacgacattctggtgtactcacaatcagaggaagaccatcagcagcatctccgtctagtgttgggaaagctgcgggaacatcaactttatgccaagtttagcaagtgtgagttctggttgtccgaagtcaagttcttagggcacgtgatatctgctaaaggagttgctgtggaccccgaaacagtgaccgccgtcactgattggaagcaacccaagacagtcactcaagtccgcagctttttgggtttggccgggtactatcggaggttcatcgagaacttctccaaaatcgctcgacccatgacacagttgctgaagaaagaagaaaaatttgtgtggagcccgcaatgcgagaaggcattccaaactctcaaggaaaagctggtttcctagccagttttaatcttaccagatactcacaaggacttcctggtgtactgtgacgcttcgcgccaaggattggggtgcgtgctcatgcaggaaggtcatgtggtagcctatgcctcacgccagctacggtcccatgaaggcaactaccctacccatgatttggagttggccgctgtagttcatgctctaaagatctggcggcactatctcattgggaatcgctgtgaaatatatactgatcataagagtttgaaatacatcttcactcagtcggatctgaatcttcagcagaggagatagttagaactcatcaaggattatgatgtgggaattcactatcatcctggtaaggccaacgtggtcgccgacgctctaagtcgaaaaagccgttgcaacactctcggcgtctgtggcattccaccggaacttaatcaacagatggaagccctgaacctaagcatagttggtcgtggattcttggctacgctggaagccaagcctaccttactcgatcaaatccgcgaggctcagaagaatgatccagatatgcatggactcctcaagaatatgaaacagggtaaagccgctggtttcacagaggatgaacacggaatcctatggaacggaaatcgggtatgcgttccagacgacagggaacttaaacagttgatacttcaggaagctcacgaaagtccttattccatccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcggggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggaccaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccaatggagcaaccacgctgaggaagaagctacttgggaacgtgaagacgagctgaaggcagcccatcccgatctcttcgccagttcttccgaatctcggggtcgagattccgtttaaggggggtaggtttgtcacgtcccaaaacgaccctaaaatatatcctttaaattatgcctagaataattaaaatccgtgtgaaagcctccaaaaattaaaatgtgcaaagtaaaagttaaacaaggcttagaggatttttgtatatttcctaaaagcctaaaatgtgtaaataaattttagtggaattttcggagcacaaaaaaaataattaagaagaaataaacaaagttaaaaaggttttataaaaaagaaaaaccctaaaagtcccccttccctcctttgggccggctcggcccatctccctctcccccctctctctctcctctcccacgcggcccattcggcctccctccccacgcgcgcgccgcttactggcgggcccgaccgccaccctcgctgacgggtggggcccacccgtcatccccgtcctcccgccgctcccgccggcccgcccgcgccaagcgccgcctctcgtcgaccgcgccggcatggccgccctcgggcgcaccgagtggctgccgcgtggggcccagccgtcagccgcccgcgccctcgggtgcggctgacgtgtggggcccacggcgtcggcaggtgtgagcccgggtgcacctggtccaccgtggaccgtgaggctgccgcgtgggtcccactcccatggacccggtccgcgcgcccctccccctcggctgatgcaataaaccctttttaaattaaaatttaaatgaagaaattggcaaatattcatttaaagagcatataaacttcaaatggccataacttggccatttaaactcggaattggaccgttcaagtctctaatttttccttaagaagtcaagaatccatttttgtgctttgttcctgcttgttatatggagtttattagagtaaaagccttttcttttccgttggtcatgtagatccgctcttcgtggaggttgaagccgacgtttgggaaagcgagcaaggcaagtcacatcatccttgaacatattgaatcccaatttataaaattattttgatttaaattattgcattattgctttatttaaattcccgcgttatcactgttttatttagccatgcctatttacctttgttatgaccttattattattgctattgttattattaccttgttcaccctagaataaacaaaaccccaactagtggacactctactcatggtaccactagtatgaatttaggtagatgcttcgccgcttaattaggcaacattaggtggttttacagctctagactttgggaatattcatatcacctggacattatggaatggttggattattgtggaattggattcacacctccccctgtattcaaaaccctcaaaatggttttaggctgggctcggggtgcatggttttgatagtagcacctcggcaatataaggaccggtcttcgggcctatgttgcaaagcactacggtacttccacatgtctagtggttaagccttagtttgt

SEQ ID NO: 75459 - DNA, 7939 bp, Oryza sativa
attcctgcagcccaaattatggtgaatttatacattttttaattaaaaaatggtgaaattttgctacctgcctgttcatgcattcgtgcatgcacgaattcctagtgaattactggactagtacatgtttgatttgcaattaggacagaacatgcgatcaataaaaggatttagggagtaatggaattttgttgagatcatggtggtgttcttttctcctgaagatgaagattaatttttttacgtaaaacgaggtggtattaacgtatgattaattaatttttaattattataaatttgaaaaatagattgatatgatattttagagcaactttcatataaaaagttttcgcaccaaacataccgtttacctgtttgaaaaacataccacgaaaattcaaaatttcacccaactttcatatgttgctgttttacacatttgtctagtcaattaaggatttctttaagcaaatccagattgatgtctcactgtctcagaatccaagaataaaatgggctgcaagaactatgtaaatacaaaataaaacaaagtactattcctaccaactactgtaagtggctctttcgaggttgtacagtacgtcatgaccaattaagaaacacttacatgaagatgttaaactcagaagtcaacatccaacatgatcaaacgtgctaattaaactaaccacataaaagtattagattagtgcactgtaatataatactatccttttgctagtgtacaccaaattgcagtattcctgaatgcattgcaatattctacctttataattcttcttttttggaagaacaaaaactatagagcatatttatcaagcacatcgattcaatcaaaaatccaaacccttgattggtcgcactgtttgggctacttgtgaacgcatgatttcataggattttcgcacgaattagttcaattcctccaaaaatccaacaaaaacggattatacaacataccatgataccactgttgttctaaaataagtttatttttcacccttcccatacatatatgatatatataccaatataaaaacaaaagattaaaatactgtcactttataaaatatccatgcaactgtcccatactatctctactacaattcatttgtcttttacttttacaaaccacatcaattcgtactgcttgggtactttggaaaacacgaatttagttcaatttctccaaaataaagtcctctaaaattagtttatttttttgctcatgcaccatctgatccaaacctctccccatggaaatattcaggaaacaaaaatctctgcggcccgccggtcggcgccccgtgccccgaagtgccaatcctcgcgtcaccttcgccatcgccgctgtcgtcgtcgtggtggtcgcctcgcagcttgaagatcctcatgatcatcgccctcgtggtggtcgtcgtcggcgcgctcctggcattcgccggcgcgttgacggcgatgctcgcccgacgccgcgaggccaccaccgaaacccagggcggcggcgtcggcggcgccgccgccaacgccgccgccgccaggatgaaggccacgcccaatccggccgtcaccgtcgcacacggcggcggcggcggtggcggcgagcagcagccgcacgtgacggtgtcggccgtgccggcgaagcgcggcgggcggcgggacgaccacgggcggctggtgttcatccaggaggggagggagaggttcgagctggaggacctgctccgggcgtcggcagaggtgctcggcagcggcagcttcggcgcgtcgtacaaggcgacgctggtggaaggccagtccatggtggtgaagcggttcaaggagatgaacggcgtcgggaggcaggacttcaacgagcacatgcggcggctcggccgcctcgtccaccccaacctcctccccgtcgtcgcctacctctacaagaaggacgagaagctgttcgtcaccgagtacatggtcaatggcagcttggctcacctcctccatggaggtaattaaccacacaatccttcccatcttgacacaacctgcattgcatttatttgatttatgttaatgtcgccggcgacgcgtgatcggtggcgtacgtgcagggtcgagcatggcggcgctggactggccgcggcggctcaagatcatcaagggcgtgacgcgcgggctggcgcacctgtacgacgagctgccgatgctcaccgtgccgcacggacacctcaagtcgtcgaacgtcctcctcgacgctgcgttcgagcccatcctcagcgactacgccctcgttcccgtcatgacgccgcgccacgccgcgcaggtgaggcgatcgaacgacggcggcggcgacgaacgcccgcgcgtataggccggcacgcattgactggggatggttcgtgtttgcaggtgatggtggcgtacaagtcgccggagtgcggggagacggggaggccgagcaagaagagcgacgtgtggagcctggggatcctgatactggaggtgctcaccggcaagttcccggcgaactaccaccggcaggggcggacggggacggacctggcggggtgggtgcactcggtggtgcgggaggagtggaccggcgaggtgttcgaccaggagatgcgcggcgctcgcggcggcgagggcgagatggtgaagctgctcaaggtcggcctcggctgctgcgagagcgacgtggacaagcgatgggacctcagggatgccctcgcccgcatcgaggagctccgggaacgcgacgccggcgccggcgccgacgacagcagcgccgcctcgtccgtggccagcggcggcggcggcggcgaggcgtcgcgctcccactcctcgtagcgaaacagcagcgatctcaccttgtgtacgcgcgcgtatgtttcacagctttttcggtgcatctgatcagccctacgattcgaaagggacggaggagatcttccgggtatgtgaacgtgtgagataatactgttcagtgcgtgtaaattaattttcttagatttattaaaggaagggaagggttgtggtgaagtttttttttttaccttttgcatacgtacattttcacaggtgatatacgaagattgttggtagaaagagagaatccattagagtttgtaacaggtatacaatttacttttgcatatgccattgacttttttcttaccttctacgatttttaccatcgccgtccggttagtctatgtgtactgtacaattttatctaaatgaccaaaatacccctgggacaaaaacttctaaagtttgataaaaaaattctgaattatcatattttaagtttttgacaaaaattggatgtttacaatcttatgtttataatattgatatttcgaaatttttgtccaaattttggatgtttttgttccaggagtattttgatcatttggataaaaaatgtataatactagggaaggttaaccagacggcgatggtaaattgtagaagttaagtaaaaaaaaagtgacatattgtaaaacgtgacaaaatcagtggtaaattgaagacatgtaacaaactcagtgacatataatggattttctctagaaatattgtgaaagtatagtggtgatatgagtgagcagatgaaaggccaagggcctttgcactcgatgaatttgcatatcatgattgcattgatgacgcagtagttacgacagggactcaaacaaaggcatgcagaaactgctgactttcgtatgcaatttaacacatcactccttacaccactgatctttgctcgggcgtcaaaatcagcaaatatccatgcaaaaaaggcaatattgcaaagaaaataaaacggtactccgtacttcattagtttggaactcggctagccactgccacttggctataattacggtgacaatactttctagacaggggttggtaagctgctgctatgtactgatcatagccttgcaagtactaaaatccaacggtggcaaacaatcttgatgacgtgatgcaccatataggatgaaatggaattaactacatttagtatggaccaactgtatagatttataagattagcaccggccccatcttgtcattgacgctaacctatatccccaatcgcagagctgtaacaggccagcacctaagcccctccattgccaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcagccaacgatctccatgctgcaccgtcagtccatgcctagttttcttgcccccctaccaccataaatacgcacctagctgtaagatggatcacaaaacacatcgatccatccctctaccagtacataaacaagaaagataacaccaaaaaattagctagctcgccaatggccttgttgtcctccttccggctcgccgtggcagtggcggcattgttggtcgtcggctcatgcgccactgaggtcaccttcaaggttggtgagggctctagcggaaaaagtctagagctcgtcaccaacatcgccatctctgaggtggagatcaaggagaagggcggcaaggactgggtggcgctcaaggagtcgtcgactaacacctggtcgctcaagagtgaggcgaccctcaagggccccttctccgtccgcttccttgtcaagaacggtggctaccgtgtcgtcgacgacgtcatccccgaaagctttacggccggcactgaatacaagagtggcatcaacatctaattcatagacatgcgtactcttgcattgggttgcatgggaatcattaacatctatataattttgtctaaaaagagatcgcgtcgcatgtgagcgagcaaacaattaatttcctatggttatttttttggtaataggccaatggcaaaataaggcataattgcgtggttccaaaatattgttgtggagctgtatgtgagcacgattttaaatatatgttgtttatagaagatgtatcgaaaaaaatatatttggtcagctttcattaagatgattgtgtggatttgatttcccaaagtttgagtacatatgtatgtccaaatcaacgtagtccatttctcctttttagcttgtcaaaaatgttgtttgcacttgttttttcattttgtggaaacaaattgttgaatcaatcatactgtgaccagactataagcataaagcatttttacatcatttagcttatttagaggtcagaaaactggaagtcacgttatcccatctctagcatgaatatcatatagaagcacacatgtattgaagcgaagccaactttgagaggagctaagcttcatatcatatagttggccaagaccccaagctatagtcaacaacaaagtttatatagtactacgagaatatcaatctattgcaaaggatctaaagtaaatacacaattggttccaaactttaaatagaagaaaaatctttacactgctagtgtgttagaaggaacaagaaaacataccattagttccaaactatatatatgtaaagaactaataaatccttaagacctaaaaaatgtagtggtggtttatggtcccttgtccaccgtaagcccatcctcactcccacgccctctcgagcgagtcccgcacgcatgatgtcccttctgctgcacgaatggaagaacaccctcgacccccaccacctgatcaaaatcaatcaaccatcattcctcggcgcttgcccatggacctcctttcacgtctagctctcaacttgcatggacgtaacagcatgtgcacttgccaataaaaaaaaaggaaaaagtacgaattacccccccccccccccgaactatcgaggtcgaacgaattacacccccgaactcgaaaactagacattctacacccttaactattgaaaccggacaaataacccccctactcattccggggtggttttgggtccacatggcagtccagtcagcatttttttaaaaaaaaaatcagtgggccccacctgtcagttctccacccctctctatctctctatactctatcccaatctctccctctctctctctcatctcaccagcacggcgccggccgtgcgagggcgggagcaggcggcgctgttggcggcggagggcgccgggcggctgagatggaggcggagcgggtggctggcagcgggaggcagagctcgcccgcgcaggttgccgtgcaggttgaggcggcggaggagcgctgtcgttgtgtgttgctgccttgtcgtcataaaacaagcttctcttccctcaccttttgcgtggccttgcctgcccttgttcacctcacctcagcttgtctctctgactttgatctcgccatcccgagttcgccggacacgcccacggccaccacggcggcgatggagggcgccgtgctctgcgccgccaaccacgcgccgctcacccccatcaccttcctcgaccgggccgccctcgtctaccccgaccgccccgccatcgtcgcctcctcctctggactcacgcgcacctagtaggagaagcgggaccgctgcctccgcctcgccgcctccctcgccgctctcgatgtccaccgccaccacgtggtaagattgaccttcgcggtggcgccaccaatcgctacaataattggatttttctcccgaatctcccccttcttcaatttttcatgcttaaaaaaaccaaatcgcttagaatttacttgttgaatcttctaatttggttccaaattagcagctgagtgattcgcattttcagaagaaatcgttgccttgttggttgtctctgtgtgcaagtcgcggtgttcacgcagaatattccggtgatgtgtgagctccacttcggcatcccgatggccggcgccgtcaactgcatgctcaactcccgcctcgacgcttcccgatgctctccgccgccggcagcaccgcctgctcccgccctcgcgcagccgccgccgtgctggtgagaagagagagagagagagagacattgggatagagtagagagatagaaagggatggagaactgacaggtttggcccactgatttttttttttaaaaaaatgctgactggactgccacgtggacccaaaaccaccccggattgagtcaggggggttatttgtccggtttcaatagttgagggtgtagaatgtctggtttcgagatcgagggtgtaattcggtcgacctcaatagttcgggggggggagtcattcgtactttttccataaaaaaatatcaattgaatttatagtgtactcttttttattgtacaatctacaccgagacctagaattgttggattattttcataaggccacgtgctcctccccacatacgcctcgtcgagttgtcatcttgtattcctatcaaatgtattgcatcaactgccgccaccgctcgatatccagctagctgcctagctgtgctctaccaatttacttagcaccaaccccatctcaccataaatgctaacctatgtcccctatcgagcagagccgcaacgggccagcacatgacccatctgtcaccgccatgattccatcaacatctagctgttgatggcccctctgtgacatatactatggatgctacacggtgcccctctatgtgcctggccatcactcctgaccgttagctctaccac

SEQ ID NO: 75460 - DNA, 1002 bp, Oryza sativa
tggggaggggtgcaggtcagggtggggagggaggtggggtgaatccggagcgttggatcggagcgaggtaatctgaacccttgagtgatgaataaaagaatgagtgaaagtatttgttgaactatagggtagatgagtaatatactcttgtagtattttcaatgcccagtacacagggaaaatatcatcctttaattgatgtcctttttctttctttactgttatcctaaccacttgcttgaacaagctgaggatgctctagtttgcaattcatgctctgtgttgttaactaatttagtaaaatatatgatgtgttcttttgcatactgctcctcggttaagttaaccaaatacaaaaacctgctacaaaggggaatgtggtcagtggagcagtttttagcttgtctgttaaatgtgccgtaatgattagttggcatttattgttcagaagtgaatgaacatatactgctccatgatctctatctgggcagcagccacactgcaaatttatccatgggatatcagattgtggcagatatacatgataaactgatcacataaggctatgagcatggttataaatttggagccatattttcagttgattccatttggcattctgatggcacccaatacattggatcattggtaataaaatggacttagaaaatatatgtttatgatgtttttgcttttcccccctttttgattaattgtactcaaccaagttcatgaatattgattggtatattgtgaatgagcacatgaactgttcatcatgatccaaactggcgttcttttattgttgttataaatgtcatgccaacctattcaagttcatgacttcaacttcctttgtttgtctttaatgtcatgtcaacctttccatggctcttgatgtatcaaccacaaaagctagctcctagtgaaactaggagcaatactcatggttcatgccagtagcctatcccttttagtttgctgttcatgccagtagcctct

SEQ ID NO: 75461 - DNA, 8957 bp, Oryza sativa
  unsure (1)..(8957): unsure at all n locations
cttcacataaccaagtagaaacctttggttttcatcacctaagaactatggctaataatactattactaaaagttcacttgttaggaatccttgttgttaatcattttcattttgattgttaaatctcgatattttgtcatttatgttaaacctatatacagtttgctgttttaggctgctctgattgcattttggaatagattggattgcagtgcaaaggtggagtgtgtggccaatctatttcatctgtgtagaattctgacaaatttatttcgaacagccccaacttgtgtattagctgcacattatatgaatgcaacgcgaaagctacttgcatagcagaataaggcacacatttccaaattaaatcattttaaatttctcaatggtgctgatatggactagatttgttccttctccattcttacacaattatctgtagagctggcagggattcctttttcttcttcagatatagaattctgtacagcatgaaagaatgatccttttttcctttaaaatgtttctggtttccctttccctaatccctaccaaacctgaaatgttctcagtgtgacttcattgtatgcaggaggaacttgaagagcttgataaaacggataaggtgtcagcagcattgcaagagtacgtgctagaagaaaacttcaccaattctaatattactttcagacattttatgctctcgtcttcctgcttaaaaagcatcttttgtggtggttttactgttagttactgattgcactgttaacatttaccaggcttatggtaacagcggagagcaaagcggatcctctacttccagtgtaacgacataaacatcctatttctaaatttatccaaatatctctgcctcagaactcttatgccgcttctttctgttaccgcaggactactgggcctgcttgccagtcttgggacagatggtttgaaggtccgcaagatctgcgcagatgcaaatgctggtttttgtgattcttggcaagcaacaccgagggcagacaatgattgctgcaaactgtaaattgtttttggtcttcccagcatgaatgtcattagtcattaaaggtgaggggggaaattcttttactgtactgagtatgggcatcagaaagtggagtagaatgagaagagaactgtggaatacataagtggcagcaatgagttagcttaatctttgttcgacaagtttcttcgtattgaaattttctgtgcatttagtttgattggctgcatttctgctgttgttaaagtatgggatctctcaactgcaacatttgactaaaaaaaatattccctgtgaggctgtgaggttagttctatctgacatttctttagatgtttctacccttgttcagttagttaccatgctgaatcttgtgaacaccatttctgaagaatgatggctgattctatcttgacaagaattctgaatcctgcattgatgtgaaagaaactggctctttcatggatcgcattaactttccactagctcttctggcccattcaagagaagcccagctcacagaggcccagcccaataagcagctggttctctctcttcaactctcataggccacaagtgaagggaccttatccaaaactacacagcaatggcgcgcgcttgctcgtctccctcctcgccgtcgccgtcgccggcgagcagccgtcctctcctcccctcgtcggcctccatctccgccttcctcgcatcccacccggccctcaccctcctgcacacgcaatgcgcctccatggcgcacctccgccagctccacgccgcgctcgtcaagtccggcctcgccagggaccccatcgccgccagccgcgccgtcgccttctgtgccggcgacggacgcgacgccgcctacgccgcccgcctcgtcaggcaccacccgaggcccaacgcgttcatgtggaacaccgccatacgcgcgctggccgacggcccggggcccggcgcggccgtggcgctgttcgtcgacatgctcgggtcgccgacgccgcccgagcggcgcacgttcccgtcgctgttcgcggcgtacgcgcgcctcggccgcgccggcgacggggccgggctccacggcatggtggtcaaactcggcctcggcggggacgcgtacgtgcgcaactccgtgatcgccatgtacgcgtcgcgcggcgccgcggacgaggcgatagcgctgctcgcgcggtgcgaggcgttcgacgccgtggcgtgcaacagcgcgatcgtggcgctggcgagggccgggcgcgtcgacgaggcgcgggcggtgttcgacggcatgccggcccggaccgtcgcgacgtggagcgccatggtgagcgcctactcccgcgactcgaggtgccacgacgccgtggagctcttctcggcgatgcaggcggagggcgtggagccgaacgccaacgtgctcgtcagcgtcctcggctgctgcgccagcctcggcgcgctggagcagggcgcgtgggtgcacgcctacatagacaagcacgacgtcgccatgaacgcgctcgtggtcaccgccctggtggacatgtactgcaagtgcggcgacatacgcaaggctcgcgaggtgttcgacgcgtcgagatcgcggggccaggccaagctctcgtcctggaactccatgatgcttgggcacgcagtgcacgggcaatggcgagaagcggccgccttgttctccgagctgaggcctcacggcctacgccccgacaacgtcaccttcatcgcgatcctgatggcgtacggccactccggcatggccgacgaggcgaaggcggtgctcgcgtcgatggcgagcgagcacggcgtcgtcccgggggtcgagcactacggctgcctcgtcgacgcgctcgccagggcggggaggctccgggaggccgagggcgcgatcgcggcgatgccggtggcgcccgacgcggccgtctggggcgcgctgctgtccgggtgccggctgcacggcgacgccgaggcggcggcgcgcgcggcgagggaggccgtgcggtgcgacccgcgcgacagcggcgcgtacgtgctcgcggcgagcgcgctggcgcgcggcggcgaggcgcggcgcggcgccgcggtgagggggaggatgagggaggaaggcgtgggcaaggtgcccggatgtagcatgatcgaggtggatggtgttgtgcacgaattcgtcagctaaaaatgttgcgacttaattatttcaggtcacagctaaaaagttaagatggcacataaaccaagattgtaaaatgtatagaagcatcgacctgtaaattttgcataattctacttaagagcgaatttctgaatactacagatgtttttgtctaatctattgcaaaattatagatttaataatattttgtactgaacaactacacatcttttttctcaaattattgtaaaactacatgttttattaggctacaccttcacatgcaccattacctgacaagtgggtcttccatgtaaaaacacttgaagtttgtgataaaacattataagggaaatgttgctataagatgctcaaagattgtgaactttacctagaacacgaaaacgtgatacggatgttggacatcaaaaaactagtaattctcgtgagtgcaagtaggactcgtttgtcattgtgggtgatttgtatatagtttaaaacatatagttttatgataacttaagctcaaaacctgaaattctacaatacaaactcttaaatatgtagtctaatgaaattctgacaaaatatgattttctcaaatctactctttatcacgtgataaaatcttggatgtattttttagataatacaaacttggatgtaatggatgggcaattgggcatctaccaacatttgtgaaaagtaatgatcaaacaagattagtgatgtccttgttacatgcctagataagtaatactattattactccctccaccaaaaaaaaaaatcaacttttagagtttgaattttgtccaaaaaaaccaacttctaccattctacctaccatcaacacgtaaaacgagaagtttatacctttaataccctttatttacccatcattcttactattttttcaatgattaagagcattttagtcattctcactttattaatccacctcgggatggaatggatttttcgtgggacgaatggagtacattagatgatgtattttcacatgcaacatagaacatgttacgaaatcagaaaaataatagctcgaattgggctctgcttcccgtgtgttctacacttctaccaacaaatcaagggacgaagagtatgagggccagcccatcacaggaaagttttgctggtccaaaacgtatgcacaattgcagctttatcaacttttcaagaggatgggatacatattattatcctagcccctgcattgtagaatggatatagccgtatcttgttacatacgagtagttacaatccttagctaccgcaaaaaatcgtgcaacattcgtctttaatttttttaatccaaaaattttaaaattcctcgaccatcacagtaatgcatggatggtaaccatacggtaagtggaggtaaccacggtatgttatttagagaaatgaaaattgcagaaaacaaagaaaaacaagtagaaaagattcaggaaattgtataattttagaaaaaataggaaaaatctagaaaaatgtaaaataatatagtaatcatgctaaaaattttgacatgacattttctacactgaaaaatgaaggaatcacattttcctctcaagtggacctaaatgggtttcatgaatagtgctctctttcggtgaagcgcatttgttaattatttttcttttttaagttccaatttacatttggctgcagaatatgatatcaactttgattttttttctcacctaattgtactataaactactcctttcattctgaaaatatagcaattttatattaattagggaataggggtagaaagacttaattatttaacttgggtagatataggcttgtactataataataaaactaaaggataggaggggtagtatgaaagtgatgaaagtcttttacatgtcctaagttgttatatttacgataaaatttaaacctacattttgagatggagagattttgggatagagggagtagatactatcgggagtttccactaccgaagcctcatggtaaacttggttaattaccatgtggtaggaaaaccctggctgccataccataaaactgcaaataatcaaatggagacaaaacttatctaaaataaacacgtaagcacattctaatgttaaaccttctcatatatatgctagcttgacaatatttcctccgaagttattctgaaaaggtgacactcgcttttacatggccgtgttcctccttttcagcaaagtttaaagtcgatgcattatcctgacctaattaggatgtgattctgtggcatatgagtgttgtgtgcatgtgattagcaccacaccttgaatagctagttgagcaagagtaaaacaaatttataaagccttctcccaccaaccatatactacttttaggttaactcttttacatgaaacgagcacgaaaatgtaagtggacctattcgtcgaatgtgttaggctcgactgtgtggttgcgcgtggcacttgacgtacgtccatatcctaagaggggagaggacatatttctggacatttgcctatatgtctatatacttggagcgtattattggacatttacctatgtggctatgcaggtatgtgtgtgtgatatcttgtctcaattaaaatgtgcttatcaatgttatgtacacttgcttttttactggattaacctttttacatgaaacgatgactaaagtgtaagtgtgatgctatgtgtaagtaggactacatgtcatattagatggaatgggatccgtagagcgtagttctgtagggcaagctgttacaaccgaaccaagtgagcaagcgccttagatgttgaagcgtccatcctttttgtttcaaagaaaatctctaaaagggtaaggatttctagagttaacccaatttacgagaaaacaatgtactaaaactttacaactgcacgattttttttagataatagaatataacatcccggcctttgctcaaaacgagctacaaccaattattataaagtagcactcaaagaaatagtatagttcaaattaaaaagaacacaccaaacaaaagcagaggaaacctagccaaaataaagagaacacatttattcaagtctatttgtgaacctccatccataattaggaaaaaaattgcataaccatcgactccaatttgcggcatgcaacctttagaaactccccatcatcatcacacctttgtagctgtgcacaaaaccggagccagtgtgttgccctgaaaattacctgcatataggaagtagatgatgatttgtcaaaaactataccatttctactcaaccatagagcccagcaaatggcagaagctccaacaagtatcaggttacaactgcacgattaattaagggaaaaagattagaattaatccacatgaagaccctacccaattcacacaccaccgacaactagcaccctataactacttttttgaacaaaaacatcctataactactgagacccataaaaaaaatcatccttgctaagcttaaagaaaatgaccaagcagctccaacttcaatctctttgatttagccatgatattgaagtccacgtggcatatactgtagctagctaggacagtgatatagtatcagtcccaattttgtcctgtggaggacaactcatgagtcaccagactgaagctagccaactaactgaatctcttggccgacactgcatatgtgttcctgggaaaatcagctcgtgtcatacgaaaatcagtcaccatcaacaggcctggccggtctgtgtgcagcgcattatgcagaattgtcaactttaatttccaagttccctaatgtactatcatatatatagtacactccctactaatgccattatttgtccttgttgtttaactgtagtcatgcagggatcgactagctgtagggccaaatgcagacgctgacgagacgcataccaacataaaacatttagaaaagacgaaagaatccgattgacccacacagccaatggcatggctgcccgtgatctcttgctaatttcagcgatcgagcattcgggcccaacaaatctttctttctggtgctgcaggtctatctgtctttagtttatgtgtgagcatgtacgatcgaacgagcgaggtaattggagcaacagttttcaggttgctaataacttcctgtagcaaacaatggcgatgggctccatttagatattagcacaggtgctcaggcgatgcgagccacaaacggcaagattcctcttgcttcaacggtcgacagagactgccacacaaattcatgcatgcatgtctgcaactctctgcgcatatattgcgtttatagtctactacagctaactttcgatcagattttgcttttggagaatcgtaattcagcctctgttaaccccaaaattcatagaccaaacttcgtatattaaagctcatagactagtagcaattatatggtggtcactatctagcaactgtatataaatgtatatacaattataggatggaaaaaaatctcatatataaatgtctagcaacaattatatatatatatatatatagtgggcttgtagcctacactaatacagaaagtatttttacgggcgggccgaaaggcatcttcccatgcgaaaggctggcccgcctatccgagatggtctgcgaagatcaccatcttcgcgtgcggccaggctgcccaactgcacgcgatgtggctgcattattgcgtgtagtcacttaagtgggtcacacgcgataatgcatatttgcgtgcggtccatcaaccggcccccgggagaccggtttttcctagcgcgaccacttatgacccacatggaacctaattgcccccttttatagaaaaaccgattttgtagtggtacaataataggatagtcaacatagatcgagactaacaagcatatcatcagcttataagcagtgtacccataccgaatttctcagttttttgaatttttttacggctatctcgttgaattacacgtcacctcttgctgctttcggttcctcatgcgggtgagcttgactgctgataagcaattctccagttagcctggatgttcaacaatttccaagctttgcctcgtgtccggtgccatcaaccaggtgtggcaggnttctgcatnctatgncgttttttttcaaaaagacacttaatactctagaaatagcaaaccagtccttttaaattaagattcatccttatcataaattttacaaaaaaaaccatatctttatatatgaaatacaatctgaaggagagaaatttccatttctagggacagtgttgtatcttaaaaagtatgagggcattctcacaacaacacatcctaatccaatcccatctttctctctgctgcctacccactcccaacatgcaacctttttccgtcccatccgccattcttatccgtgcgccttcctcctccttgccggtgccgaggccttcccttcttccttccggaccaaacagcgttgacggttgacctattctcctccaccgccctatatcctctaccctcaccggtgtattcctctcccgcatcgatgccatagacctggtcggggaagcgtggaggagatgggcgatgaagtcgattgccacagtgcaacgtattatgtatatgtactctttcgtggtttaagccccagcgtgatgcagttttgatcaaacagatgtaaatatgtactccctctgtttcaggttatacgacgttttgacttttatcaaaatcaaactgttttaagtttgaccaagtt

SEQ ID NO: 75462 - DNA, 2092 bp, Oryza sativa
tttgacaaaattaaaatatcttatcatctgaaacagagggtgtaattatttgacacgtctctctcaaaatctcaatgcaccaactgatcgagccggcatcattattagtacctaaaggtaaaaaaaaagctaattaaattgcaagttgcaaatctctggccccttcacttaattggaacaaacaagctagagaacagctcaacaaatcaagacaaaaacttaaacgtagtaacacaggatcagcactagaataataatgtactatcgcactctgtacaacaacccctgaaatatatatagttaatccattggagtatatagcagtttttagccgatcttaattagactcaaaagcaaggtcaattctaccatcaggggtccatattgtgcccatcgcgtcgagcataaactaacgtcctgacagcgaatggcgaatctgaacctagattttcctttcacaggcaatcactatcttgcgatgcatgccctagcacttaggtgtatttatgcctaattaatctaggggcactagcttcttaatttactgactatttgtcactgtcttacattaggttagggttttacaggtagcttcaattattgccgtccgttggttaatttgcttaattccattttagcagccttttgatcgcggtagtgtgctttagcatatatgcatatatatatatatatatatatatatatatatatatatatatatatatatatatatatatatatatatatatatatatatattactgctgctgctagtctagaagcatctaaaagaaacatgcgtacgtactggaagaatacgtacgaccgagatatgattaagatgagtagatatatggtccaaattgctgataactactcgatcgtatataattaatcgtgactgacgaaaaccctaggtttatataatacgtcgtgatcttttgatctgttcacgaggtcgaccactcgaccgctggcttcatggtttctgattattatgcctgcaagcattaagatgaatgtcttctatctcctgacgacatccatttttctctgaggaaagctagctgaaaatatcaccaggatcagctccattgcgtggcatggtgaaacttaaaccgaaactattaatgttttaatagaggattttggaccccactaaacagggcttagctccgcgcgcccctaatttttcttaaagattatatatatgtgtacattttcttaactgaaatatatatatctataattaatcacatgcaaactatgtagtgtacaagaagctcaagctagctagctgcaaagctgatcaacagagtgaagtgtttattacaatcttcaagcagatccagttaggtgtgtgtactgaagaaattaaattaaagatgccatttgtgatctgcggttatatataaggatgaactgtgcttgtcatgcatataacacgactattgcgaataaatacactatagtgtaaaaaacaaatgcaaaaattagccacctatatatgcgcatttgtagaagacaccatgtacgtataaaacaatttcaaacagtacatactcccttctcctcaaactggatgtagaacatgctgccacacccaactctttacaagagcaaagatacacagagcctcgtcggttacccatatcccctaataagccaaaacggcttattaagaaataaaaattaatttataggtaaaactatattatatatttattcgtagtgatttaaaagccaatgctaaaaagaaattacattgaaatcatcttacaatcaatttcagaataatcaaatttgaaaattcaaattttggcttttgcttttacttattagaccaaccgatagggcgcgcgcgcacaaacatggaaattgtggttttcaatgtcttctctcacacaactttattatatttatataaatgttattaatcgtatttgattatgaaagatatattgaattaacagggctgatctgctggaattaaaaagaattaaattgaaatataaagtcatgaggagggcaaggattctgacctgagtataacatatatacgtactgtagctatcatatttcgtatatacca

SEQ ID NO: 75463 - DNA, 76649 bp, Oryza sativa
acctaatctgtcaggactcggggcttttacgagtgcattgtgctgctctttccaacaaatgcaagtggtcagggttaagtgcagagcacggtgtgtgctgtccgccatactcgatgatcagtaaagtgggtcacgtagtttttgacatatggtagctgttgacatggacgaggagcaccggacgatacgccagcaacagcagccttgccgtcgtcgtcgctgccaccggtcgccctcatcgtcaatcctccgccattgcggtcttctgaagcacggaccaaggttcttgtttctttgagcacccttttagtgctttttcctagaattggaattcatgatatccctgattatcttgccaactgttaaattttggtgattcatctattgcgaatcaagcattagtcatagcatttgtgatagttgatgttgtcgtaggtgatcagtaacatgcattagtggtgattactgattagtcaggtcaggtgtgtagtttagacatggaaaaaccaccgaaaactgtgttggtagtagaagtgttgaattccgaagtgtatatactcccataatctaactcatgaaacatacagattcacaaaaaatctgtcttctttctctgttccaatcgcgatggcgaagtgatgaggtgcgatagttggcgaagtggaggtgtacggcaattcacagtcgcaaattctcctggtctatattccattaattccagcagataaatatttcactgccatggtgatatatctcgacgagacgacggcgtccagggtcaagcaacaatgacgggggaaacttcgatggtcgacaatggtgatatataggcaacattagagcaagtataatagaacggttgttgctggcattggctcggatcggcagatggcggagtccttgggcttgaagcgtgatggaagcttgcggggccaaaataagtgaaactatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctcccaccatgtgcgtggacggccgccgcttctccctggtgggtgagagatccgccgtcgttcacaagggcgcggcgcactggctgtttattgatcgtgtatctagcgcaacccaagatgacatactgtacaaactcaccgcggcggtggacacctcagaaatctccttgacaaggctcccctttggtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtagcacggcattgtcattttgatatggtttgacctttactggtttccactgtaacatcccttcactggaaaaacaaattctcttgatcttacagttcacaactacgcaggtggcatttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatccatggcgcccaaggcggagaagaagccggccgcgaagaagcccgcggaggaggagcccgcggcagagaaggccgagaaggcccccgcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggttcaccccgacatcggcatctcctccaaggccatgtccatcatgaactccttcatcaacgacatcttcgagaagctcgccggggagtccgccaagctcgcccgctacaacaagaagcccaccatcacctcccgggagattcagacctccgtccgcctcgtcctccccggcgagctcgccaagcacgccgtctccgagggcacgaaggccgtcaccaagtttacttccgcttaggctgcatgccttcctctagtttgttagtagtagtagtagcagtagattgatctgtttatgtggtagtttaagtggaaatgatgattgcaaatgaagaattgtgcggggcttcttttggggaactcactgatctggaatagtaatgctttttatgtcatgtgaacatatctctggttgccaattgattttttgttttgtagaattgattacatcgttgatgtttgcatcgtcttgaaaatactctgcttgtgactggaatatgattttcggaacatctgtctgtactccctctcccaaaatttgaactggaaatttagctaggactccatttttggtactgctcaagtacccattggctcaatgtattttgtaggtttgatggaagggaagcttgatggccattttggttcatgatgttgcatttggaacataaaaactgtgtactattttgagctgataactttgaaatctgaaagtaagttttgcttcagcttcatttggtactgtttcaaatcgaaatatagaagttgaaatagtaactgaaacgccatatgtcttcgcttactgtttcaggagaatgctgttctctttactccttcctgttctgaatgtccgaatgggtgctttttctttgttactgattcgcttgtatgctagtaactgggaaacatgaggtatgcatctcatctctactgccacatcttctatcatgcttgctgttgtggtgcctgcagccctgcagtacataccatgcctgaaaaatgtgaccaaactcttgtgggttctacttgtaaattgtaatgttatcctttctattctctgtccagcatggttgtttgaggtgtactcaggttctactggaagattctcttgtagcagcatttttggcacgctcatataaaagcttcggtagctactgtggaatgtgatagaaataatgggtctgatgtttttgggaactctccttcatttctatttggttaactgtttgagcatttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatctaagcttaatataatgctataacaccttgtgtacctctgattatttcccaatgcaatcatcaactctacatgtggacctcacgtcctcacccaacatttagctcaagtactttactgttcatttcttaaccacctgagacagaagatattcatctctgattgcatgcatctttgacacagcatctgctaacaacattcgatctttggcttgttgctttgagcaggatatgccaagtctaaggacagaaaccaagcagtcttgaacaatacttcgtgttatgcttgcatctgttatatctttattttttgcttcttcatgtagccagattgttcgatcagctatatctaggactcggccaggaaatgctgctgatgcaaatttgtgcagatccaccgaatccttgaacatgtcatcagtagggctccttccggtaaatatctcaagcaataatatgcctaagctgtaaatatcacctagtctggagactgcagaaccttctccgtactctgcaatattttcaatttcagttaatatttaagtatacctctaaatgacataaatttccaattcggaatggcccaagttgatcccccacccattagggtggagggagactaggaagtgggaataaaggcagaatgcaatatttggaactacctggtggaatataaccaatggaacctctgattccaactatgctgtctgaatgttgcagtgctttaactatactttcagggaggattcttgatatgccgaaatctccaaccttagcgctcatgtcttctgcaagaagaatattacttggtttcaggtcgcaatggatgatcggtggctgacaatggttgtgaagataatccagtgcatccaagatatcaactgcaatgccgagtctctgcgaaaggctcagtgtgttgctagaagtgggattgcctgacacgggatgaagccaaccatctaagcttccattgggcatgtactcaaaaactaatgccttgaactcgtgaccctgtggattgatacttgagcaacaggtgatgatctttataagacaacgatgtcgtactcttctcaaagcctcacattcaacctcaaaactcttggcagatcctgattgtcgaaggttgaacacttttacagccacaattgcaccttcatcttctaaagtacatctatagacggaaccataacttcctttgccaagcaaattagcttctgaaaattcattacttcctctggctaatgcataatatgaaactctatgatagtgttcatcagtacctgggattgttgctcgactattttgtctccgtttaagcttcctgcagaactgaattagaacagtagctgaaactaacagcaagattgatcctgttattggcagggcgattttaagagacttatgccaccgtttgttgtttttgcttgcatcaataatgggacatggagccaagtgaagctgaggtattccaccacacaagttgtcgttccctgcaaccgatgcgtacgtaaggttcttgaaaactccctcatctggtacttctccttgcaaattattgaatgacacatctaatttccacaacattgtcaaattttgcagagttgctgggatgggtcctgaaaaattgttctgtgctagaaatagttgttgcagattgccaatcctaccaatggtatcggggatcctaccagataacttattcatggttaggttcaggatgttgagccctttcaggttggtcaaagattgaggtatgccgccttcaaatgagtttttatctagcagtagcgattccagcacctgacaatttcctatactgtcaggtatttgaccagacaactggtttcccgacagtatcaactggtttaggttagccaaggtagcaacttctattggaaggggtccagagagagaattgtatgacaagtccaagtaccaagagagtgaaggaagctccaagatttcctttgggattgacccattaagacggttggtcgataagtccagaacaaataacgtttttagcttcccaaggcttgcagggattggcccttccaaattggtgtagtatgcgtagagcctattcaaatttgtaagatttccaattgatgatggtatgaggcctgacaagctggtgttgtacagggcaacttcaaccaaatttgatagcttcccgatgctcgctggaatcactccagataaggaagtgaaccccagatccagcgtgtccaagccaatcaaattgccaatgtcctcaggtatgctcccagagatgctattattatctaagtagagcttatggagtgtggtcgacaagttgacaacagagtttggaagttgcccgctgaaagagttgtctgagataacaagctgttgcagctgactgcagttggttagtgaagtgataaattcccaacccttcctgttatttgcctcaagtcggttgccatacaagtataatcgccgaagagatttcaaccttcccacagtaggaggcacaaatccactgaatctattaccataaaggagcacaattgtgagtgatgaaagattgaagagagaagaaggtattactccactgaattggttatccgccaatccaaagtattgtatgccagggaacttgtcaccgatgttggcaggaatgcttccttgtagcatgttgtcatttgctgcaagcaccgtcagtgttgacaggttccacagagaggacggaaatatgccggagagactgttctgctgaaaactaaattcacgtagagctgcagctttgccgaggtccagcgggatcaggccctccaggttgttgttgtccatgtacagatactgaagcaatgacaggttcgctagcgatgccggaattggcccagtgaagctgttgttttgcagctgcagcttctggagttgtgtcaatgtgttgcccagctccaccgggatgcggccgccaagctggttaaaggcgaggcccagattcttcatgctgatgcaggaactcagattggcagggagctcaccggaaaacgagttgcctccaatgtccaggatctctagacgccggaggcggccaaggctcgggggaatttctccatacagctcgtttgagctcaagtttaggctctgcaagaagctgaggttcccgatgaccggagggagcccgccggcgagattgccggagggcagcgtcagcgccgccacccgcgccggcgtccgacggtcgcacgtgacgccctcccagctgcagaaactggtgctgctgttccaggaggcgagcgcacttgagctgctccccctgaacgctgccttgaaggcaagcaacgtggcctcatcgctgctgctgctgctgccaccaccagcgacggctgcaacgatcggcgtcaggatgaggacgagggataattcaagcctcaggctcatcatgatcgtcatgggacgtattgtgtttcttgattggtttgtgagagtggtagtgctatatcttagtaccaatggctgtccgtattatatggagagtatagatggtctttgaagcaaatttggagatgatgacagtttgttgattgcattcttttaattccttttttccatttctggaacacttcgtttgactttataatatagtactccctttgtttgtttgttctaaataccttccgttcaggatatgtatctggacaaccatatctagatgcatatcttacatccattatttatggacggaatagtacttgtcctgatacatcattcatactactaatattgctttggtcacttgtttttttttccctaaaaaattacaaatatttttaaaaaaatcatcattaccagtttaccacgagctgcttttgctcatcttagcattaacatttagttaataaaactactactgtcaaagctaaaacagtgctaaatcaagctaaaacagtgctaaatcaacaagaccgttctaaatcaacaaaggtcttggaccgaagtggcgaaagcaatggcgaaggagaccatgctttggaagtcggcttattaagggatccccgctgtttcgtctttacgaggtcgtggtagccaaatttagcacgagatattcctctagtttttcataatgtcctttatcggtccctgcttgttttccttttatccttataaataacttttatttctcttaatgaaaaaaatacgccccttgcgtattaaaaaaaatccacaatgaaaagtatttcgtgaacgagggaatatatacatttcgaacggtcaacgcggccaggtgcatgttgttagtattttcgttgagtcggagagaattgactttcagaacacggcgatttaggcggctaggcgatcgacggaaggcttgcatgatcaacgcactgttacataagcctacttgcagatggagatgggtttaggctagctgcctgcttgaagacgacgacgtcgttgtcgtctcactgggatgttgacgtgggcagattaccgaatacgtagcctaacaagtcgtggagtggctttcagagcaaagaaataggcccaattagcccataaacaaagacagcccgccaagaagcctgacaactaaattgggctggactgggctgtaggcgtacgccgaaggaaagctcaaactctaaaaattcgcccaccgacgcgcgccggaaaccgccttaactcctcccgttcccgctcacatttttcggcatcccaccaacccgtcgaccccggcatccaacgtcgtacatccctccacgtcatcgatccgcgccgcgtgctttccaccaatcaggttgcacatcccctcctctacaaaatcatctccccccgtctcctcctttccccacgccgcaatctcgcaaatcccaccgcttccctttcctctcctctccccgagaagaagagggcggcatccatggcgcccaaggcggagaagaagccggcggcgaagaagcccgcggaggaggagcccgcggcggagaaggccgagaaggccccggcggggaagaagcccaaggcggagaagcgcctccccgccggcaagggcgagaagggcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaatgatatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggccgttaccaagttcacttcctcctaggctgtacgcctgcatctagtcctagtagtaatagtagtttttatatgtttatgtggtatattgtttaagtgatatccaagattggaaatggatgttaaattgttggtttggtagtcattggctgtaagaagaatggctttgggttgcttttgggaaacacttgcttcacggatcgggcataagtaaccatgcttttataacatgcgaatgtgtgctttctcttgtgccatcattgataagaatttaccttgtgccagtgttggtgatgccttcgtttaatgttgtggaattacatggttgctagtattttgtctcgtaaatttcttttcatgtcattggaatttgatttctgcagcatgtacattggtgttaggtactgctcttttgcgtgtgcctcttttgcgtgtgcctcatgtattgtttagagattttagaagcacacactttgggacaataccaaattgtttttagcctgacaagaaatttagtttcgtgctgtctgcatttgaaacaaaaagtttgtacacattgtttggtgcactagtacatgatataatctgtcctccattgctgttttattctgagattagaacttcgacaagtaagtttttcttcagcttttgtcaggtactgattttcaaagaaatatagcgacaaggaaatggtaactgaaacatcacattacaattattgatttttaagattatgttgtgcccgcatgttttctcattccgttctgaatttctgagtgctgctagcttatgagctaactgttaggtatgcatcttataccaaagttttcagtcaggctattgctctattcaagatatgcattgccttaaggcatatgtgttaagattagaccaaactcttgttgattctacttattgtaataatgtgtcttgtcctttgattcactctccagttaggtgattctccctccagcgaagttggaggtgaataagttacatccaaggttctacgtggaatattgtcctgaatttcggttgggcttgttccataatacattcgctgtcaaataactctaatttttatgacagcataaggattaatatggatgtatcataatttttactcatggaataatttcagttgctattatgaatttgcagtggttggaataacatgcccatattttgagagcaaatcccttggttctatctggttattggtttgagcacttgttcttttcttttcagacaacatgaattattattgatttggtattcagtgttagatctatttagatgcaacctatgttgatgctatgtttatgtgggtgggaatcgtggaactttgttttcttatggttgcaagggtatccctatcaggtaggactgtaggagtagttggttatattttttttattatggatcatggatgcgtagaagtttctgttggaagttgctaccatggtttcgtgtgtaagaagccatatggtcagctcttcagtattatttgatcagcatgattacattgacattctgtatacgtctttgcaatgacatgcatctgagctttatttgataaatataaatcatgcagccttgtattccaacgattatttctagtacaattaattgacactacatacatgtcttatccaacatttagttcaatgccaaccatccaagacctgagatattcatctctgatggcatgaatctctgatacagcatctgctaagagcactcggtctctgggttgttgctttgagcaggatatgccaagcctaagaacagccactaaacactgttgaataattcttctttttgtgcttgcatttgtcacatctgtctcatttgcttcttcatgcagccagattgtctgatcagctgtctaaggctctatcaagaaaagaagctgcaataaacttgtgcaaatccattgaatccctgaaaatgtcatcatagggcttcttccggtgaacatctcgagcaacaatattcctaaactgtaagtatcacccgctctggttactgcagaaccctccccatattctacaagatatgcagtcaaaattagtttctaactgtaccattagcatgtaagatatacaaagtgcacaatccgaccccacccatgagggaggaggtgggaggacttgtgggaataaatacaaaaataaaacttttaactacctggtgcaatatagccaatggagcctctgattccaattgagctttttgaattttgaagagttttagttgtgctgtttgggaggatttttgatatacctaaatctccaacttttgcactcttgtcttctgcaagaagaatattacttggtttcaggtcacaatggacgattggtggctgacagtggttgtgaagataatccagtgcatccaagatatcaacagcaatgctgagtctctgcggaaggctgagtgtattgctagtgagattgcttgacttgggatgatttcagccatccaagctaccattgggcatgaactcaaacaccagtgccttgaactcttgaccctgttggtcaatactcgaacaacaagtgatgatctttatgagacaacgatggcgtactcttctcaaagcctcacattcagcctcaaagctccttgaagatcctgacatttgaaggttgaacattttcacagccgtggttacacttgcaccctcatcttctaaagcacatctattaacagaaccataatcttcctttgccaagcaggttagcctctgagaattcattacttcctcttgataatgcatggtacgaagctctgatattgttcatcaataattagggatgtcgctcggctattttgtcttcatttgagcttccggtggagtaaacaatagaagcacaacaactgaaactaataccaagactgctcccgttgttgttagagccagtgtaagagacttaggccaccgattctttttctttcttacatcaaggattgggcatggagccaagtgaagctgaggcattccgctgcacaacttgtcatccccagcaattgatgcataagtcaagttcctgaaaacaccccattgagcatgtttccgatgttagaaggaatggtgccattgaacatgtttatatccaccgtgagcatgatcagtgatgacagattatacagcgacaccgggagtttgccggagaggtagtttctgttgaagagaagataccttaaacctgcgatgctgccgatgcctggcgggatcatcccctccaggtggttgccgttgatggcaatgcctgaagcggcgacaggttggctagcgacgcaggaattgaccctatgaaggtgttgttcgccagcgcgagcgtgggagccgtgtcagcgtgttgccaagctcaccgggaatgcggtcgccgagctggttgtattgaaggtacacggttgtcaatctgacgcaggtggtgaggttggtggggaactcgccggagaaggcgttgtggtccatgtcgagcacccggagtcgccggagccggctgacgctctgggggatctcgctgtggagatcgttggagctcaggttgagccgccggaggaaggtgaggtttccgatggctggtgagagcgtgccggcgagatcgctggacggcaggtccagcgccaccacggacgtcggcctccgccggtgactgcacgtgacgccctcccagctgcagaagctgttggcgctgctgttccatgaccatgaagcggcgctgccaacctgccggagctagccaccagcgcagccgccgctgcgtgtgatagagatcctaacctgcagaggtcatcaggctacggaggaccagagcggggggctggagatccaccccactgtgtgcaccgccatctcctcctattcttcattggtgatttctgcaggaccagcaccacaaccatcgtgtaatcaaatagcgcatccacccaaaccaaataaatcaaggtacaagcctgctctgattccagtgcatttgattaacactaacgtttctgtttgcaatgctgaaccaagcaacatctatgttagttgatcctatgtctgtgtgggagcctgagaactttggtgcctcatagctgcatcggtatctatatcagatagatggaaattttgctagtaaatatggttcatggttgcataggaatgtgttgaaatctgctagtaccatatatggtttcatgtgtttttctgaagtaaaaactacagcagttcaatattatttaacaaaccgattacattctctgtgtacatatcgagaaatttgatcaaattcctcgtatgtattttacaacggctaactgggtccttgttatggctttcaatagaagccgggtcttttgaccttctctaaaaaaaaaaatctgggaccttgtttacctccgattattccaggcaaaatgattgacactacatatgtatattatctagcatttagctctagtgctctattgctcgttgcccaaccacccgggacttgaaatattcatctctgatcgcatggatctttgacacggcatctgctaacaccattcgctctctgggttgttgctttgagcaggatatgccgagcccaaagagagacaccaaactctgttgaataattcctcttgtcatgcttgcatctgtagcatctgtataatttgtttcatgcagccagattgtttgatcagctatttccagggctctgtcaggaaaagcagcggtagcaaattcgtgcagattaagcgaatccttgaacatgtcatcagtagggcttgttcccgtaaacatctcaagcaatattatgcctaagctgtaaatgtcacctagtttggaggcagcagaaccttcaccgtactctgcaatatttgcaacacacacagttaaactttaagtgtaccttcaagacaaaaaaaaatacgaatacccctaattctacttctatctattagaagaggagggaaatgaaggaaataaggacagaattacaattttttttagctacctggagcaatatagccaatagaacctctgattccaattgagctttttgaatttagatgaattttagttatgcttttggggaggatttttgatatgccaaaatctccaaccttagcattcatgtcttctgcaaggagaatattgcttggcttcatatcacaatggatgattgatggctgacagtggttatggagataatccattgcttcaaagatatcaataacaatgttgagtctctgtgaaaagctgagtgtgttgctaggactgcatttgctcgatttgggatgaatccaaccatccaagctaccattaggcatgaactccaaaaccagtgccttgaactcctgaccctgtggatcaatactcgagcaacaagtgatgatctttatgaggcagcggtggcgtactcttctcaaagcctcacattcagcctcaaagctctttgaagatcctaattgttgaaggtcgaacacttttacggccactagtgcatcctcattgtctaaagtacatctataaacagaaccatatcttcctttgccgagcaggttggcttctgaaaaatcattacttcctcttgacaatgcataatatgaaaccctttgatactgttcctcaataaccagtgatgttgcttgtctgttttgtcttcgtttgagcttcctgttgtgtaacagaataagaacaataactgaaaccaacaccaacattgcacctgttgttggcagggctattgcaagagactttagatgctggttcttgttcttgcttacatcaagaatgggacatggaggcaagtgaagctggggtattccaccgcacaagttatcattccccacaaccgatgaaaaggtcaggtttctgaaaacacctttaactggtacttccccttgcaaattgttgaacgacacatctaattgcttcaatagtgtaaaattttgtagggctgctggtattggtcctgaaaaattgttatgtgctagacacaggtattgcagattgccaatgttactaatggcattggggatcctaccagataacttgttcacggttaggtttagtacgttgagccctttcagattggtcaaagattgaggcatgtctcctccgaatgagttattatctagcaagaggaattccaacacttcacaatttcctatactgtttggtatttggccagaaagctggtttcctgacagaattaactggtttaggttagctaaagtaccaacttctgatggaaggtgtccagagagggagttgtatgacaggtccaagatccaagctagagaaggcagctctagaatttccctgggaattgaaccgtttaggcgattgaatgacaaatccagattaaacagattttttagcctcccaatggttgctggaattggcccttccaaattggtgtggaatgcaagcagcctattcagtttggtaagatttccaatggttgacggtatgaggcctgacagaccagtgttgtatagggcaaggtcaaccaagtttgttagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccaccaaagaagttgtgagagagcatcaattcttgcagctggctgcagtttgctagagaagttacaaattccgaaccctttccgttatctgcctcaagctggtttgttccgatgtatagatacttaagagaatgcaacatccccaaggtgggaggcacaaatccagtgaagttgttatctgcgaggtacaaatctgtgagccttgaaagattggacagagaagatggtatggccccatgaaaacgattctcatgcaatccaaagaagcgcatggcaggaaacttgtcaccaatgttggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagacgtatcgccatgtggatttttatttggtaagcgtctttggagcaaagtttagtttcaggctggagatatatcgctgctttctgattccatttttccccccggcccccttgttgtaagagttcacttgacctcattgacttcaagtcaccgggcaggaccagtgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatatatatatatatatatatatatatatatatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgccgggattgctcgccatgccgtgaagagggccgacgtccgtggttttcgtcaccgacgacgttcgtccacaagcctcttgctggaaaccagaactcctcaaccatttttgtcaagccattacagcgcctgatgtccaagtgccttttcgctgccgtcgctggttgttcgtgagcttcggaacagacattattcaccagcgagctgcattacctgaaaggtatggatctcagtgtttatcactcacacatcttacattcacatgcagtccctgttatgtatagatgatttgccattcctcttctttttatctactaaactgagcacatgatgaatcacctggaacctaaatttatagattttttgttgaaatgcagttgaatttagattgttttaggtatataacatgcccgttcgaatatctttaattgcatccagtgaataaaatttaggtaggtagtgaaacagcagcaatgtctcttttacgtggacatctcaattataatctttgtaaatatagatttaattaattttaaattgaagtatatgacccgaagagaatcatattgcttgttttaataatggtagtttttaatagcatgccgcggcttccaaagtgtgcgagcgtgagaagaaatgtgaagcgtcgttccattcatgatgatgatgactttgtcactccacctacaaggaagaaggctgttcgtgttaaattcgtggcaccggtttcgcgttgtgtaccatcttccatcacacctatcatacagagatttagtgctgaaaagaaagagctggtagctgagatgggttttgaggggctgctgcatatgcccctcataacaaaccatcgtgacttcagctactggcttttgtcacgggtatccccaacacgttcggctatcgaactagaaagtggtgaggttttgccactgtctcctgaggatgttaagaaggtgcttgggattccttgcgtaggggaggagctgcaagcacccaatgttgagtttgtttctcatgtcaagaggttaattgctgaaagaatgaaagttgctagttttaaggacgttaacaaggaggtattggaggatgtattagataaacaccatagagggcaaatgtcaaaggctgagaaagaaagtttcaaaacagcattcctaatgcttgttatgatgaaatttcttgcgccacaatcaaatatggacaataaatgtccaagatatttttctgcactacttgaccccaatgaaatagcaaagttcaattggtctgggtatgtgttgaacgagatattggacgcagcggcaactgttcaaaagaagcacgctgatggcactaaatgtggttatatcactggttgctctatttatttgcaggtatatagactttttcccaatgcagtacatacactaaatgttataattatataatgatagtgagtacactaataaaatttttcatgcaaaggtccattatttggataacgtggactttggaggtgatctaaacttggagcataatatatttcctcgaattgcattatatgatcgtgatacaataaaggaaagatatcagctggacatcagcgaaaggaactattaccaggcaacacagtttggaaaattaaaggtactttacaaaaaaataattcatagtttatattgttctaacccttcacatgtctgatatacttgcactttatatcgatccagctacggcccaaaaatgaagtctgctacaaaagaacgtgcgaaagaacatctgtcactgacagcgggggaaatgaaaatgttcagattgagtctcaggtaagttattaaaaaaatttctaccaaacatgtttatttagtaaatatctagagatataaacttttaatatcaacatgcaacacagcatgctgctgaattaatacagaaggcccaagaattgaaaagtttttggatttcctgcattggcaaccttgataaggcaacagagagtctagttaaggtgacagaagcttcgaagaacatgcccagcgtgaccataccaatcagcgatgaagttgatgtttctaaaggttatacatgcacaactgtcaacgatgatgctgagaatggaatagaggtcaaccaaacaccatctttaggaaatgatgtagaagatgtgagtgcagctgctgccaattgtacaccgatggttcatactcacaacttgaaagaagaatcaatcgacttgaatcgcactgttccacacaggacttatactggtctggacttcgatcctccatcatttgatctaaatattgactactcaccatcaaataacacaggttattttcctacacgtatatgtttgctgcctgattttcatgtttcacatagtaagtacccttattgttcctttttttttccatggctggttgtgcatgctgacagtgaggcgagagaatcatggagtaagttgtcattcaaagttcaggtagacaaagatgaagaagattacaaatgtgtttgcaagttgtttgagcacatgggcatactgtgttgccacgttatcaaggtacgccagctttattttggtccttgtacttacatttttttacctctagagcatgcctctttcttcttaaattgttttacccatctaccataaatttgggtaagcgtatatgttgataagttaattcttgattcgattcatattctgtcagctttaatccagtgtatacatctgtagaaaaccatagttaccctaaaaaaaattagttttgatgtataagcagtttagtttatcatttccgtttttcattgttcatgtaggtaatgacacacataggctgcagaagcatcccagataagtacattctaagaagatggagtattagtgccagagaaggatctggcagcaaccttgagagcttcaggaatgacaaagatgctgcctcttccaggacacaccgccacacactgctctaccatgcatgtatagacttgtccaaacaaggtgacatatcggttgatgctttccaccttgctatgaaacatataactgacgcactggatgagattaaactagtggccggtaccaacgaatctcccatggggtacactgatcccccaaatgatgaacctgctggaccggatcaaggaggtgaacaaaatgaagaccccgcggctcatcaggccgtacaaagcttgccactgccacctgatcgtcgggcaaagcgtggccgacctaggtccaccaggctgaagtccccagtagatggtggagtccgaaaaaagcgcatttgttcgaactgtcatctgaaggggcactatagaactggatgccccacaaatccggagaacacatcgaagaacaaagtgatcaaggtgtgcacgaaatgcaagttagctggtcactatgcatcaacgtgtggtgttggtgtatagaagcaagtctatcgttgtttttaaatacaatcttgtaaaaatattcccatatcttgcgtgttgcacttggacaagtttttaattaaattcggatatgttttctatttcataattatgtcattcatcttgtgggatatacatgtatacgtgttcgctctgtcactcataaacctatgtgtacatgtacacctgtaaaagtacagattatgtcattaatcttgtggtattcagacgtgcattttttcactctctctctatcccgttgactatggccaattagtaccgaaatcactcgttggttactaaattaatcaattgatacccaattctgactggatcgatccatgttgacggtaacaaattatattatgtaacctatcggtcgtaatagctataaatattaccataaataagatctttatacttggtaatgatattaattttttcattccttccaacggagacacaattgcaacatataaagagcagaacaatacgactctgctcacttctggtgctctctctggttctcgccaacaacacatttctgttccaggtatggctccaacttatctgtacgtatatgtacttctcatatatgttgacctcttcttagtattctgaaatttatacttatattgccagtagctatggacaagatgaacactggtgcctggagcgataagatcgatcagtcgctgcagaagtatgatcacccacgctgccgttggcacatattatttggtacgaagtcagaactacacaacttatatcatgcacgcacagcaagtgattttgaagatacttggacggccctagtcaatgagtatggtcttcaagaggagaatgcatatctccaaaaggcgcagatgttaatagacgatgaaacgaagcccaatgattcacaggtaatttattttaatatatttttggttcacgttcagctccagttctggatttgtcactcctgctcttaacattttccacttgtttttttttcgtaggagatagatacagaccgtaaagatgtcaagagggaggtggaggctcctaagttgatcatttctcgtcatagtgatgataaattctcatcctagtgatgagaaatgtgactcgcccaccgtctgaatagcaaacatgaggcaacatgcaagtaccagccgaaaatcaactctctgatggtgtgatatggttgccagccatcggtcaaataagcagccattcggtgtttttacatttatgaatcacaatcgtactgtaataataaactagttacatctatatttatagatcgtttttactttaattagcatatgtttcatttatattatgctaaactcctatgatatgtggatgagccaattcaccgatattttgtttcctttcagacttcacttaagagatctactctttcaattcagcatattaaacttctaaaagcgcatctaaaacactgtggaaagaaattgaatttaatctaaatcggcacatatggaaaaacatggtggaaataataatacacagtacacacatttaaattttagatatacttaaaatccatggtacaaaaatatacttggatttatttatattaaattttaattttagatatacttaaaatccatggtacaaaaatatacttggatttatttatattaaattttacatccggacgtaacgacttaaaatatacttgcttccaaatttaattaggaaataatgtactgtcagcctaggtaggcgagttttaaattctaataatctacagtacacagatttgaaatatagatatacttagaaaccatggtatttctatttacaacaatataagatgacaatcaattaacatataccgtgtacacaaattgtaaatttatatacgcttggattcataatataattaaattaacgtaatttaaaactttgtatacttaacaagttagctaagtatatagaaaaaataacccgtgtatacatagccattacattacataaatgagtaaacattttctgaatctggaaattgcaaaacgcactaatttagctaggtgtacataagcataccatatacttagcctccatatatacttatattccaattacatcgtccatggtgtacttagggtacctcggtttccttatataattattttcaaaataacagcaggataacatttccatatatactacatcgtagaagtatacttagattttcatataccctaataaaccgcattatatttgttgccaaataaaccgcaaatccatgattatggtgacaaatatttagaaaccaaataacggccgtgaactgttgatggaaaggtattaaatacgctaaattaatactcctaaatattttgcatgcatgcacacgctgtcaattaccaaacctaggtattaaagacgttactaaatattttgcatgcatgcacacgctgtcaatttccaaatcaaatgtacttaacgggtgaacccgttaatcaaatatacatgtaccgatcaactagatgagaatgtgatccaacggcagatgtcagtggtgcccgggcaccatggagtcctatctgggcgtcctatatatatatatatatatatatattccatcaaatgcaagtggtcagtcaagtgccagcatatgccgtcccgtgagaatcattgccgacagacaagatgtagcgtgcattgcagtgattgtggcgacaaagaaaggggttcacggggacgatgagtaagacatggtggcaaaattaaggtccgttcttttcttcgataagagttaaatgaagattaaaatttttgtggcacgttttttaaactgttaaacgatacgtttcgtgcgaaaactttctatatgaaagttgctttaaaatatcacattaatctatttttcaagtttgtaataattaaaactcaatcaatcatacgttaataccacatcgttttgcgtaaaaaacttaaatcttcattttcatattcaggataaaagaacaccacttaagctcacataagttttatttatcaattatcaggggcatgtctgaagagcagggtttcacttattgcgctgattatcacgcttaccgcggggtacggtaggggaaattggcgattgatttggatggattttgaccaaattcaaacttttggagaaaaaatgaaaaaaaaacatggatgtagttcttgatttataattgccaatggtgaagattttttaaaaaatagagtaaactaaattcaaatttgagggtaaaataaaaaatagtttacaaattgaaaaaaggaagacaatattgggccttaagtatcctacatattctttcaattattctcaatttctagttttctacacatattcaaccgtattttttattttttccctatttatttttcatttacatgatttcaactatacagaccgcaataaccgtgcaaatatcgcggttatcacggtaaaccgtgcggtaaccgcggtgaaaccgcgaaactgccgagttttgaattcgaatttttgaatgtgatttctgtacgattttagacaattatcgcggttatcgtgctaccgcgaggtggcggtaacctcggcccaaactctgttgaagatctttatttatcggcagaaataccttcttaagtgacagcttctaagcataaaccactacaatgacgtgcatctaagctttatttaagataaaataatgaatagtatcaactaagcaaccttgtattcctccaattattcctggtacaatcatgaacactacatatgtatcttgcgcaacgcttagctcacagtgctatgttcttcatggccaagcatccaagacctgagatattcatctctgatacagcttctgataacactattcgttctctggttgttgctttgagcacgatgtgccgagcctaaaaacagacaccaagcactgttgaataattattgtttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttgtgactgcttaacttgacagtggccactgcactggaaccgaatccgtctaggggtcggtcaagaacacaagctacaacaaacttgtgcagatccattgaatccctgaaaatgtcattcgggtgaacatctcaagcaataatatacctaagctgtaagtatcacccaccttcgtgactacagaaccttccccgtactctgcaacatttgtagccaaaattagtatttaaccctaccctcaacatgtaaaaaatgaagcaccctcagtctgataggaaggggagagattaagggaataattgcccggacacctctcggtttgaccgccgcccattgtctggtctgaccggccactcagtgctgcactgttcactgacagaaaatattaattactatattttcaataaacactcgcatttaataattgctcatcacaaaaattgaccatcacatgattctagaggtgtgactccatctaatttgggaaaaaaagaaatagaggttcatgcgactggttcaattgctttatgctgtgataatgctattgacaaacaacaggtgttataccattttagcgattcaccgtggaaggccggacggttgatgaggtcatacgctaagacattaacatgtttgtatagactttagagcaaaaagaaatagtagtagctcgattagcccagaaacaagtaaacaggccactctcgtgggcctcgaatcgggaatagcccagtttccaagcctgcgacttttactgggccatgagctaaactctacgaaagaaagcccaactgcccaaccatgaaaactcgtaatccccgcgcgcgcgacggaaaccgcctactcctcccgttcccgcgtacactttccgcgccgaaacgcatctcagccgtccataggaaaacaacaccaatcgtgcgccacatgctcctccacgtcatcgatccgcggcgcaccccctccgccaatcagcgcccacctctcccctcctttaataccatcgccgccgcctccccttcaactccacaactcgcaaccgaattcccccaaattttcgtctcccctttcccttccccgagaagaagagagcggcatccatggcgcccaaggcggagaagaagccggcggcgaagaagcccgcggaggaggagcccgcggcggagaaggccgagaaggccctggcggggaagaagcccaaggcggagaagcgtctccccgccggcaaggccgagaagagcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaacgacatcttcgagaagctcgccggggagtccgccaagctcgcgcgctacaacaagaagcccaccatcacctcacgggagatccagacctccgtccgcctcgtcctccccggcgagctcgccaagcacgccgtctccgagggcaccaaggctgtgaccaagttcacctccgcttagattccatctattggtagtatttagttctgtctactatctggtagtggtagaaatggatgtcttattagtgtgtagttggcggttgtggcgctgcttttggtaaactgttgcttatttatctgagatattaacgatgctcttctagacttctatgtgcttcctgttttgtgattgctcgatttcttgtttgtggtgttcattctgtttgagattactacgatactgtgaaattttctggaacaaaattgatgttctggtatgcatacgtagcaactgaggacatggcaactcacttcaggaataatgctgctcctggcttgtttggtgttctacacttttactcatgcgttttatgtgtggacacaaacacaattgcttgaattggatagattcttgctgtttgctagttggtactagtggaagttggcgcttttgtactttgaactaacaatgtaaggtgaattttgggaaggaaccagtacagtaggagctctaccatttcaatcaagcaggaagaaggaaacaatgaaattaagcacgaaggaaacaattaggtgaattttacattaaattgtatgattctgatactctggcaaagaaatatagctctcagaagtgagaacaattgctaactgaaacactacatgtgactaaagttatttcaggattatttccaatgagcttggctattgtagctgttttcggtgtctcagtggaggcttttccttctgttctagtaatacctatgcaagctaattggcaaacatgaggtatacatctcttagtgcatgcatctctactgctacatctcttattgatgctcgctcttgaggctgttgctttgtgcaggatatgcctaacatgaagacagaaacgagacactcctggattctgctctgtataatgttatcccgtggttctacatgcagccagattgttgagtctgctatctccgaagttatgtctggaagagcatccttggtaaacttattcagatctaatgaatctctgaacacgtcatccgttggactctttcctgtaaacatctcaagcagtaatattccgagactatagaagtatagatatcaccaagagttgatatccagtacagctgtacaggcccaacatccagccgcgtttcggcctgcagcggcgaccttcacagcttgttttgcaactcgagggaagaggattgggagtttacacgagagaattgatggtgagattaagatgagaattttgatttttaatcaccagatttcaccctcctatacaatgcaatacatctactagatgcaatcgcggaggcctttgcacgtacgtacgtgcacacacccatggcggacaacgacatcatggcggcattgccggaggacgtcctcctccaggtcctctcccgcgtgggcaacgtcaagagcctcttcatgctggccgcaacatgccgccgcttcaccgatcgcgccttcctccgcgacctctggggcggccagcgcgccggcgacctcctcggcttcttcttccaccggcaacgcaactcggcctcgacattcggcttcctgccggcgccgccgcttcgcccccatcccctccagctacgacggcgagcccctgacggcgcgccgcggcatcctcctgatgcggctttccccctccaacgactggtcagaggcgaccagccacctcctcggcctcttcaaccctatcaccagcgagcaccacgttctcccgcatctgaagggcccctccaaccttggttccttcgccgtcaccagctgcgccatcatcttctccgacgacctcgccgggaagcagcagccgccatcttcaggccgcttcatgttctcgcagctgctcgtcaccaccaagcacaagagcatcaagaccgtgtacctccactcgtactccgccacgcgcagcagctgggccgcgcccgccgtgttcctggatctccgccgcttctccctggtgggcgagggatcatcgtcatccgccgtcgtccaccgcggcgcggcgcactggctgtgcaccgaccacgtcgcgagcgccacccgagacgactacctgtacaagagctcagcgtggaggtgggcggcacagccacggccacgccgcgcgtctccatgacgaagctccccgtcctcgacggcggcacgccgacgccgctgctctgcgtcggcggagacggcgagctcaccatcgtctgcgtgttcatcatgcacgtcagagtctggaagcagcagcgacgcggcgatggcgatggcgacggtgcggcggcgtggcgccgcgacgtgatttggatgccaacggaggtgtccaactaccccaaaagttacacgatggcgcatggattgggacgcaggggatcggtggccatgatgtacagtagcaccggcgctgtgttcgtcctcgacctcgacaagaaggtgatggagaaggccatggactgcttgctgcccctgcgaatggaccattcactggatcggccgcctgtgccgtacgagatggacttggtggagttctttctgctccagcttggtggtctatggctctatgcagcagaggtgatctacaggataatcaattaattaattgattgattgattacacatgtttatggccccgcgaaaattactcatgttatgcagtagaaaaacgagggttaattgtagaataggggtatgtgcgggaaaaaaaagtaagttttgatttaaggacaacagcatattattatcattgataaattcttcaagtgttattaaggtttggtaattggtgtcaccttttttttttccttttttttttgactgtctgatcctttgttcagcaatttttgttcattaacaatatggcattgtgcattatccaccctgatttatggtctggtcgtttgctcgttgcttacgcacaacctgatgaggtgagcgtgaccgtccgccggaaatgcgggattttataaggctcacgcagaatatgaaagttggccatgtcgaagggtataggaggaagaggtttcatttttctccctcacccatcttcctcgattctaaagatatggctagagtgaggtttagtgtcggttgttagaattgggttatgatcttttggacaaccttggctgtagtttcttcgttggcttagcgacggccgatctagtgatagttttctcttgggtttgtgtgttggtgggtgggtggtggttattttttcttcgtttttctagttacgatatcccagggttataattttataatttttttctactttattaagggcctatttggttctctaccctaccaattaattggtagtgctaaaatctagacaacttttagcactaccaattttttggtagggtaaagttagctagtctatgtttggtttaataccaatataaagctaaaatttagtatgagagtgaagaagattttagaatatagccaaattgagcgtaggcgctatcaattgtttggcttcaatctaaactagcacgtttactattaaaaaattttggtagggtctcaatccaaaacagccctaatattgaacttcgcagctcgatatttggtgatggcggtaggtatttagcgcgaaacccattaagccactggcccatctacgcgtcgtctccagaaacggcccaattttcatttcctaggcccaacatccagccatgtttcggcatgcttcgtcgaaccccccaccccccaaccacccccacccacacacactccccactacgctacgattcatattcagaaaagactttctcatctactagatgcaatcgcgggagatcatctaacgcctttgcacgtacgtacgtgcgcacacccatggcggacgacggcggcatcatcgcggcattgccggaggacgtcctcctccaggtcctctcccgcgtggccagcgtcaagagcctcttcatgctcgccgccacatgccgccgctggctgcgccgcttcaccgaccgcgccttcctcctcgacctctggggcggccagcgcgccggcgacctcctcggcttcttcttccacctgcagcgcatcaaggtctcgacattcggcttcctgccggtgccgagctcgccgctccgccccctcgcctcctccggctcctccaactccgtccagccactggcggcgcgccgcggcgtcctcctgatgcggcttcccatcacccgcctcctcttcctctccaaccccgtcaccggcgagcgccacgtggtcccgcgcctggaggagtactctgaccttggtccctacaaggtcaccagctacgccatcgtcgtctccgacgacctcgctgggaagccgcagcagccggcatcgtcaggccgcttcacgttctcgcagctgctcgtcaccaccaagcacgcgaacagcatcaccatgtacgtcaactcgtactccgccgccggcggctgggccgcgcccgccgagttcctggatctcctccgcttctcgctggcgggcagatcgacgccatccgccgtcgttcaccgcggcgcggcgcactggctgtgcaccgacgacgtcgcgagcgccacccgaggcgaccgcctgtacaagctcagcgtggaggtgggcgtgccggccgcagccacgccgcgcgtctccatgacgaatctccccgtccgcgccggcggcgcgacggccacgctgctctgcgtcggcggggacggcgagctcaccatcgcctgcgtgttccccatgcacgtcagaatctggaagcagcagcgacgcggcgatggcgacgacgatgcggcggcgtggcgccgcgacgtgatgtggatgacattgccggcgccttacccatactgcgtgccgctgatgcatggcttggacatgggatcggtggccatgatgtacaggagcagcggcgccgtgttcgtcgtcgacctcgacaagaaggtgatcgacagggccatggactgcttcctgcccctgcgaattggccgcgagatggatctgccgcctgtgccgtacgagatggacttggtggagttctttctgctccagcttggtggcctatgtggaggagggtctacatctacaggatgattacacatgttatgcagtggtaaaataatgagtaatataagcaccagcatatgaattgaaatgcatggaccatatgcaggaaagtttttgattgataaattcttcaagtgttgttatggtttggtaattggtaaaacagctcgaaacctgttctttccgtcccacaaaaacgtggcgcaatctcataatctgattttcatgtgtgattacaggtatgatttgaattttcattttgtacgaaaaggatgaacagtcaaaaatctttctgacagttctccacatagtagtattgccgtattggttgtaatgtacacatcggcagttactgaacgttctattagcttacattacatatagccatatgaactgacgcaaataaagactgactgatatgaaccacgaaggaaaatgctacatcttcagcgtctcagcttttgtttctcggaattctggcaagtcgccatcggcagctgagctgttaaaacattttccccagcaagcatatcttattcttgtacactcttcaggcctagttactcactgttgcttcaaatcgctgctaatttgtttcgtctcctcttccatgtccactgaaagagagccagaaaacatcaggtaagcgtcgtctctgatcgcatgcatcttcagggctgcatcttgtattggcattcgctctttgggttgatgctttgagcaggacaagccgaggccaatgactgaaatcaaacactcttgcattctgcttcttgtgatgctatcctcggcgtctacatgcacccagagcgtcggatcggctatctccaggattctgtcaggatgagcagcctctgagaaactgtgcaggtccaaggaatctctgaacatatcgtctgttgggctcattcctgtaaacatctcaagcagcaatatgcccagactataaacatcgccaagagttgagaccgcagagccttccccatactctacaaatattttggagttcattagattcaccggaatgttaaatttgtgtaagaactaggaggtaaaaagcaaagaaacaaagcataacaattcagttacctggagcaacatagccaatggaacctcttattccgattgtgttgcttgaattttgctgtgttttgctcgcgctttcagttaggattcttgatatgccgaaatctccaactcgggcactcatgtcttctgcaagaaggatgttgcttggcttgagatcacaatgaacgatcggcggctggcagtggatatgaagatattccagagcatccacaatatcaacagcaatgtccagcctttgagttaggctcaaagtattgtcagcaatgggcatatcagattttggatgaagccaaccatttaagctgccattgggcataaactcaaaaactagtgccttgaaatcttgaccttggttatttatgcttgaacagcaagtgatgatctttaggagacaacggtggcgcacacttctcagtgcgtcgcattctgccagaaaacttctagtagatccagaccgttcaaggttaaacacctttacagcgacaacaatttcctcatcaaacaaagtgcatttatagactacaccatagcttccttttccaagcaaactgttctgtgaaaatcccttggttccatttgacaattcctggtaagaaactctttcaaattgttcctccacaactggggttagggactggcccttcttcctatgtacaggctttctacgacgaattaacataataatcaccataactagagctaagaacaagaccacagctattgatgccagagctattttaagagaccttaaccaccctttgcttctctttctaacagcatgcatggagcatggaggtaagttaagatgagatattcccccacaaagctcactgtttccagctaaagacaagtaagataagttcttaaaaataccttcttttggcacttcaccttgcagatcattgaaggatagatccagcattgataacgatgtcaaattctgcagcactgctgggataggcccagacaagttgttatacgctagatacaactcttgcaggttgtggatgctaccaagggcatcaggaatcacaccagaaaacttgttcatggttaggttaagtacacggagccccttaatgtcccccagaaacacaggtatagttccttggaacgagttactgtccaataaaagtacagtgagcactatgcaattttttatactacttggtatctggccagacaattggtttcctgacagaatcaactcgttgaggctagtcaaactcccaacttcagaaggaaggggtccagagagggagttgtatgataaattcaagtactgtgaaatggaaggcagctccaatatttcctttggaatcgaaccattgaagtgatttcttgataaatcaagaacattcaggcttttcagcttaccaagattcgctgggattggtccttccaagttgttgccttgcatgaatagcttcatcagattggtaaggtttcctacagaagacggtacatggccagacaagctattgttattcaggtatagcgtagtcaagttttccagcttcccaatgctctctggaattacacctgatatgtcagtactaaacaggtataatgatcttagaccaaccaaattaccgaaatcagaggggatgcttccagaaatcctactgccacccaagtaaagtttttggagagtcttcgagaggtttgcgatcgaaatagggaactgcccagtgaaattgttgttactgagaactaaaatctctagcttactgcagtttgtcaatgactcaacaaattcccacccctttatgtcccctgcttcaagcatattaacacctagttgcagattctgcagagcattcaacctccctagattatgtggcacaaacccactaaatccgttcattgatagctgcagactcgtgaggttagtgagattggagaacgaggagggaatttccccgctgaactggttgttgaacactgcgaaagactgtaaatgaggaaacttttcatcgatatcagtagcaatgcttccatccagcttgttgtttcctgcatcaaaccccattagcgacgacagattgtacagggaagacgggagtgcaccactcaggttgttggagcagatgtcgaggaagtaaaggcgcggcatgttgctgccgaattcaggaggtattgtgccctcgagactgttcatcctgaggctgaggtatcccagggacgtcagattggccagtgaagctggccaatggccgacgaagctgttgttgtcgaggcctagcacctggagctgtgtcagcgtgttgccgagctccgaaggtatgtgcccggcgagcttgttgctgccgagggccaggtattccaagctggtgcaggatgtcagattgctggggacctcgccggagaaggtgttgaagcttaggtcgagttccctgaggcggtgcagctgaccgaggctcgcggggatgccaccgtgcagccagttgtaactcaggtcaagtttccgcaacgacgtcaggttgccgacggccggcgacagggtccccgagagatcatggccgggcaggctaagcgccaccacccgcccgtgccggccacacgccacgccctcccagctgcacggcccggcgctgccgttccacgacgcaagcacgccgttgccaccaccgttgcccaccgccacggccttgaaagcgagcaacgctgcggcgtcttctccgtctgctcctcgcactgccatgaagtgcaagaagatggacatgaagacggacagcagcagcagcaggaagctagcaagagccatcgccatggtggttgcaaacttgcaaggtacacaagtggagtgacaagcagtgccccagagcaccgtattttaaccccacgacgccatgatcccagagtgccattggcgagacggcgaggacaccgagtcaaaatcttgacttgtttagcggtctccgcgctcacagggagagagacaggagtggtaagataccatgtcgacttggagcagtgcatgttacctttttgactgttcccgccattcctttccacatcatttcccaactagatacttactgtaacatagtactggaaggatatggaaagcttggacgcatccaagctctcgtcgctgtcgccctcggccctcacacatgacttagctcgctccaattatgtcctcaccccttctctgttcgaccaaattcctgataatttcttcctgactgattccaacagagaatccattaggttggcagtccagagtgttaccttgtacagttgtacggccacccttttccacgcttgtatgcggagttccagacacacgaggaaaggtaaaagtcttgtggtgatccaggattagattcagcttgtgtagagcttccgtgaaagcatggacaactacagttgacgagcacaaaaacgaacaacaccgagcctcctgggaacaacgagaaatcgagaattacagcaggcacggccatgtctttccacatatgtacaaacttgaaaaggtccgtggcgtggaaaatttatggagattaaccaattggatgctcaccttagtcaaagggccagggacagtaagctcctcggaggagttctgtcgaacaggtaacgggcgcagactgagaactccgagtctctggagaattgttgtggctacagcgacgggagtctcgaagaagaaaaagtatacaggattgggcatcgtacgcgtcggagctgagcacggcttccagtgacggcgcattccggcggcggcggcgaggcggtgcccggaggtgagcacgagaccccggcggaagcgcgcgcgtgagcgatctgtccaacagtgaatggaccttgcggtggattagcattttggtgggcccacaataccagaaggaggcccacaagaaggttagcgcgcagcccatgatttgcaacgggctacaaccaagagagatacatttgggcccgtgtaaaggcccaaactattcgaggcaagcacgagatatggcccattatctgacaggctgagcaacaaagttgctcacttgctccccgtcgccgccgcttcaccgaacacttctcctctccgtcgtcctccatctccatcgccggtgaacgagttgacgcgatcttctgctcaggcgaagaacgtttatctgtctagccggtcaaggggaacgcagcttttcctgccgttttcctcacgcgatcgaccgcgctggcacgcagcagcgagatcatatcggtgatatgatatccaagtccagatccagtgactcaggctgtgtttagatccaaattttggatccaaacttcagtccttttctatcacatcaacctatcatacacacataacttttcagtcacattatcttcaatttcaaccaaaatccaaactttgcgctgaaataaacacagcctcatctaccatcctttcctccgaactgtcgtgttcctaatagtaatgtgtccataatagtgggtgtgtttagttcacactaaaattgaaagtttggttgaaattgaaatgatgtgacggaaacattggaaggttgtgtgtgtaggaaagctttgatgtgatggaaaagttagaagttttaaaaaaaactttggaactaaacacggcgaaaatttcttattagtccatttcaccagcaaattattgagcttcgttggttgggattgggaaattattgagcttcgcttgttgggattgggtagggaagaatgccattttcttctcttttttatggccttttgaatcgcaggattgaaaaaacggaggaataggaaaaacacaagattttgataggaatgaaagtgtaaaacagaggattgcaaaacacaggaaaaatataggaatgaccgtttgattagaccgcaagagcaggaatcagacgagagagatagactcaaggaaagttttccaagaggtcaaagtggatgttaactttcctacatttttgctctagaattgtaggaatagaaaagtttcctacgtttttccttttcttattccgacgaatcaacgacatgaatagtgtaggatttcaattcctttatttttcctccaattcaaagggggccttattttcgattacacgacagtggcacagtgcacatcggccaaatacgcctcctagcataagctcaaaaaaaaaaaaggaaagacaatggccctttcttaactcgctaaaatcctaatgagaacatattttcatgtgcataatattcataaacatcaggatttaggggtttggttggcatacccacattgtcaaaacttgccatacttcatttagctaacatatgcttaacatgtggccaacaaaattgaagccacacttcagccataggaaagcaagcctaccacacttttacgtgccaatgacatatgacccacattatgataaatgaatcttgccataagtgtggcacaaaccaaacagatgcctaacttaatcaaatttggctaactttagttgtgatatggtgaggtaaatcagttgatgatttcctcagctcttttcgactgtgacaataagagcgtcccgtcatccttggtgcgaacgcaactaggcaaattttcagatgccaaattaatctcaccccccccccccccccccccaaaacacacacacacacacacaaaagaacctatcgaggtccagtactccagtctgaaaattggactatgaaaaagaagaaaaagatatactttacatgctatgtagagtaatagcatactttgaaaaagtcacctctcttagtagttgtgctgatgcttgatgacgccattaggtccgaattatttgctgctatgtagagtaatagattgtgctgcggcagatgtttgtaaattagcagtgtataatataccttccattgtttaggttcctgcacatcaaatgaacaaaatcctaaagagcagctacaatttgcacaatcatcagttaattcagtaacagtccaaaacgttatttcagttaattttttttcccttcaattttgaggtttaccagtttgactataaaacctgatgcaaacaaggtgacaagaaaaggggggagtatgtcaggataccacatccatgtatcaagaaagatctaaaaataatgagaccaacgcatggatctctgttacttggatcaacataactgatggaacatctaattccaattgaactgattgcaaagttttgcttgtattttcagaaagaatttttgacacgctgaatccccaacatgtgtgctcatgtccactgaacaataatgttgcttggcttcagatcacagtggatgattggtagctgacagtggtggtaaagatactccagtgcatctgtggcgtcaacagtaatgccctgtctctgagctagacagagggtattgcctggagtcttgacacatttctgatgcaattacccaatttaccatgaggcatatacttaagactgctaggccagtgctgttgaatcattgaccttggaagtcaatgcttgagcaaaaagtgactatctttattaagtaacagcggcacaccctactcaatgcctcacattcagccatgaaactcctagaatatccaacaaattgacatcttcacagctgcataaacctgggctagctggacattcttaggctagatttggtcagcccataaacctaagcccccaactggagtataatctattgatgaactatttacgaacatggaatagtcttgaaattggatccaattttagattcttcctggtaagaggttcttctgtagcaggttcatctttcttcatacgtattgcttttaccaatagcttcgtccttggttctggtgtcatccctctcgactccatcgttctataataatgcaaagcctcatccagtttatcgtgggaatggagtccatgaaccattatagtaaatgatcgttgatccgggcctgatccattcctctccatttcatcccatactagctgaacccctttctcataatcccaactgacataaaggttcaatattaagttatatgtatcagagtccagtctgcaaccagacttctccattctctgcatcaatgaaataacatctttgggtttctctgtcgtcttcagaatgtaggagtatgtcatattgtttggagagacgcccttaacctccatgtcatccaaaagctcatagactttctccatccgattaatcttacagaagtgttttatcaaagtgttgtaggtagcaacatcggcctgacaaccacgatcattcatctcaccaaaaatctcaagtgcttctggaatccttttcttgaagcacaattgatcgatgatacaattacaaattgccacatcaggattgatccctttctcccacatgcttgtaaatagttttactgcagtactaagtttgccagattttgtaagcgaatttatgaatgtaccataggtgaacaggtcaggcttaagcttagacgcaattatctcattccaaacccttttagcgtctgccaagcttcccttgacacaccaaccattaagaatgatgttccagctctttatgacaggagggaactcatctttcttttggagaaagagggcctctgcttcctcaacatgcttgtaccgacagagagacatcaaaagtatctggaatccaaccaagtcaagctcaaacccataatccttcctcttgtagaacatatctatcgcctcctgcaccttgtgcgcgcctgcataccggtttaacaggacagcaaacatcctgtttgtgaccactgactggcggctctccacaggaatctcatcaaacagttgtctcatgagcctgaccttcttcatcctcccaagaatgtcaagcatctccgtgtaggcccttgacccatggttatactggggcagaccagctgcccatttgaagaaagatagtgcgactttccaattggacctctgcttctggagcacctttagcacaacatcctcatccatctcgtctgcaaattgattgagaacttcggcgagctcactgtcgccatctctagacttgaggattttaacgatttcgctgacatggacatccttggaaccatccaaagcggtagaatgacaaagccgtagagatccaacaacgcagtgaattgggagaatgctctggtgaaagcgtggatataagcctgccccgggaagctccactgaggcattctgacgaacagttggcgtgcaggaaccaaggaagccgagcctcctaataactacgcatgaacaaagtttaaattagtaccccgcacttaaattcagagaacgaaacctcgttccacttcagtatatgcattcaaattcagataatgaaacagtgcgcggtgtgatggactcatcaagagatgatgaaaaaaatcagaaggggccaagagaaaaagaaaaaaaaaagaagaaggggagtcggtgcaggtggtgcctaccgaagagcgtcctgctggacctgcaggcggcggagaggatggcggacgcccgcggcggcggcatcgtaccggagatgagcacgagagcggcggagggaacgggtaccagagcgctctctctctctctccggtcgatgactaaatgggctactaataactaagttaagcgaagctattgggccgacttgaaagcccactatgtgttgaatgggttgtggccgacgtgcgggcccgtcatgtaaggctgggcttgtgatggacacaagcgaggcccacaatgtgcgtgtccggcctacattgaggcccaaaatattcggagcaatcatacagtccggcccagatagcaacagatatagaggcctgatataacctgcaacagaagtacagaactaaccaaacagcttttaacgtttcagcatgctgcaaatctgaaccaaccaaaatacaaacttaaattagtaagagtacccccactttgaggaacttagcccctctcttctaaacacccccttagtcgtgatggaaagattgattaactcaacaatttatttgttatagaaaaaaacaattaatttcgcatttcaaagagcgtagcaggtagtagcagctaatcttgcattgaaataaattacactttttaaaattacatctatataattcagttttaagagcaggtgagctgagtggagcagctcgaagcctcgaatagtttgaaatatactgagcactccacttcacttgacgaactgagctgaagtgtcaccgctcacctgctctcccgccaaatcctctcaacccaaaagccattgagctgagctgcctccttgtatatatccatggatccacctcgatctctgccatggcgttcccctccctctccgtctccggcattctcgcgcgccacccggtgctcttctacgcggccacctggacggccgtcgccaccgccgcggtgtccgtggccgcgttcgcgccggagctcgccttcgtctgggctgtcacgccgggcgccgcgccgctggcgtcgtcgacggccggctgcccgggcggcatcgtcctgccgctcgacgggccgccgtgggacgccgcctgcgtgcccgccgcgctgttcggcagggtcaccctcgacgtgctcgtgccgcccgtgttcgccgccgcggtggtgtccaccgctctctggttcaccaaggccgtcggcgtgtgggaggacgacgacgacgaagacgacagcgacgaagctacaatggtgtgactgagtgatgctgtaattttgtgacacttagacgccatgcttgctatgcatattagaatcttggagttcttgatcttaaatattaatggctctgatcaatatcatcgtcaactaagagtgacaaagcaattgaattaggctgaactttattgaagtatgtagacagttgaagctggttataattccctgtttctgtaacagaatgaagaggaatttgtttcatttcaaatagttcttattgaaagaaggaaggaggaaaatgaattgataagaacaataggtgaagcggaaaaccgaaaaagagcaataagtccttttgtttacaagtcttctttatatagaaattcgacctattgctctggatccccgtttactaggaagatatgaatcgaaaggatcgaactacctactcattattcggaggtgaatcatagaacactaaaagctgtggtatcttatagaactatctatttgtataatgttctccagttggacaaatgttcagtgaaggtttacactgacagcaaaattgacagtctttcatggccaaggtcagtgagtggcaagattgacttgaattccattatttcaagctgcatgtgcttcggtagtttcattgtatactcttaacacctgatatggtgcctcaaaatgcagcctgttatgcaactaaaatcatgcatacaagctaagcaaattcatgggcaatagctgcacatatgtagaacaatatctagccaggcagaatttcacaactgctgaacaactcatgtatttggcaaatatattaacaagagtacacaggttgatctcattctcagccatgaccgaaggaaacattagaaaagggttcagaatacttcaggttcctaatactactgctgctacacatatttatcaatcatcacatactagtatgccattaaaccaaacagtatcagaacacttcttttttctgctgatgatcctgctttgggctctcattttgaagaagacttgatcagcttttcgctgaattcccagagttgcttcgccagcgcgtcattcctcgcaaatctgctagttttctccacattgcagtcagcaaagtattgtccggtcactcccttgagctgagggttcagtcctacatagcaagtggtagctgctccctgaaaaaagaaacatttgttaagtgtgttgtttcagatgaatttgaatttcaagacaattcaatttgtctttcagcattgctgcagagaattcggacagaaagaagaacagagaagatattgggttccaaacctggggtacgctcttccacaagatgtaggtggcaaattgaagcacccctgcaagtgaaaacaaagtgtttttttcagaacattaaggaaaggaaacagcattctcttttcaatcgaagcctgaaggtccatagcaaaaactctagaacaatgactcagaaagagagaacttgcatatacgtactcataaggaaaaaggagtgcctcatcaaattggtcatgatcaatccaggatgaacacagttaatagtgatgttcgctccttcttcctgtttcatcaatggcacagatcaaacatgtattggtgaattagtgatggaaaatagacaaaattaaatgtgttttatagaaaaatgggaaatgcatagagttttcagctctgttaatctgaataaagacatcacaaataaaggtgagaatgagggaagaaaataccttcagccgtctagagagctctttcgcgtgaagtatgtttgccagcttagattgtccataagccatcttgtcatcgtatctgccaatacaaaattcttatttcaatctctaatccacataaattttccaacagaaaaacaacatgaaaacactcagcacatacgttttctcatcgttgagtttatcaaactcaattcccttcggatatgtatggaggtgagcaaccgatgacaagttcacaatacgaccttcaatacctgtggacttcgcggttgctttcatattatcaagaaggaggttggtcaacagaaagtgacctgattgagcataacacatcagacagatatcagtatcatccaagcactttttgcatgtttaaagtaaatagttgatagtggtagagagtgaataccaagatgattggtcgcgaactgcatctcaacaccatcttcagacaatccaaacggacagaacatcacaccggcattatttctgcatgacggaaaaaaaaagaatatatgagaccccttaattaactgaaatttaagcagaaccaaaggatctttgcatgttaaaaaaaggcaagtgtgctaagagtttgaagggagttacatcaggatgttcagaggaaggttcatcgagttgaactgatctgcaaaagctctaacagacttaagggagctgaggtcaagcttcagaacatcgatgtgagcttttgggttttcctcaatgattttcttcctcactacagatgcagcctctgtgttccttgctgcgatgatgacatgggctcctctcatcgcaaagactcgcgaggtctccagaccaatgccactcgctcctcctgtaagacaacagaatttacagatttccgtaaatttgcgaggatagatgtttatgaacagtttgcagtaactagctactgtgagtctgacacaacatgaaatttactcacaagaatacaagattgatgtttggtgaaaactgaattctatgacagattggttatggatgcactagaagactatgattaatgcttttatgagcaagtttaattgacaagacctaacacagaaaaagttactattatataatgggaaaatgtttatagtttaagaccacacagttccaagctcaaactcttattttccacacaaaaagaaaggaatatccaacatctccacatcaggaaagagagggtaaaaatcctcagcccattgtcagaatggaagaactgctatgcccttccgatgaattgattttccttcacacttctgtatatcaatctatgtttttgtttttttagtattatctaaaatacctgattgaattatgaattctctgtagtcaagaaagttccagaaatctaaaccacaaccacaagattgagcaggaaacagacaaactttcatcaaaacataataaactcttctggtccacaaaaaagctacttatgcataaatttctcatatacaattttttgaagagcgtagtattattttgatattatattaatcataacacaaaaggtggctgctttcataatcccaactctaagccacccttaccaccatccaaaacacacccaaaaaggaaaagagagaacaatttgagagagagagagagagagagagagagagagatgcagagactgcctatggtgagttggtgacgggtagagaattggagattattcacacgagtttctcacaaatctaacaaaaacatggcaagaaactaaccaaaaccattaaaaataaactgcattgatgttttcaagaacaggtttttgctggccacaacaacacattgcagagaaataaattccaagattcggaggtacggaagcaggcagctctgtctcttacctgtgacgatgacggtgaggccggtggcgtcgacgccggcggtgacctgctccgccgtggacccggagccgaacccgctcgcgccggccttcccggtgatgagcgacaagatgcccatctcaaaccacgccgccaagaaacccccaaactcacgatccaacactgcaccccccaaccccaaaacccaaacaagaacacgcaaagaagctcagccaccgcaacgcaactgaattcgacccccccccccccccccccaacaagaagtcgccgaaaagaacacgccaagaagcactcaccctcgccggacagatcgacgagttgttcaatgcgcgggcgcgggaggcgggagcgaggcggaaggggaggaggaggtggttatttatggttgggggcgccggtgcagagttggtcgcggagttagaatcgatgcaggaaggattaggaagaagacgagacagaaaggaatttggaatcgtcacagaaagaatcgaatcgacctggattcatccaaattttaagagaattttatacgtttgggttttgtaatttactgctagtccggtatatgaatatgaatatctcaaaaatgtccaaatgctacaccaaattggttcacaaagaggtctggttggtgtgtagcagcgcttcgtattcgattaaaattcaggggaagtaatttgctgtagattatgaactacgtagcgtgtcactgtcccgttgggtcccgttgtatacatgatgcattgatgcagtgctcctaatcacttcctgatttgccatctgtcactcgtataatctcgtactccctctgtctcagctatgatttttcgtgtccaactttaatcgtttatcccatttaatttttttttaaaaacaaaaacataagttatacataaagtactatttatgttttatcatctcataacaataaaaatactaattacaaaaaaaaataaataagacggacgatcaaagttgagcacagaaacttatagttgcacttaaaatgggacggagggagtatgttactgccagtgctagcaaccgtggcatactcgactctgtttgggacagttctagatttaagatttttctttaactaagtattcataactctagaaatctatacatctaaaattatgattatattgataatatttagatgaattgttgtttgtattttatgagaaatataaaattttaaatctcactatagtttatcttacaaactctaaatttagcaagtatctagaatcaacaccttgcttgcctgtgtttatatgagaggtttgattttctttctttttactagtattttacaaattaggctttaattattttacagcccatagttggtccgatgtgttactggaaattattttggtcactcgtctgcggtagcaaatggggccggcctactttgtataaccattggtccattgttgtctgatcatctgatgatgctgcatttgttgaagattaggtcgatgatgaccgaccggccggccggcatgaacgaacttgagatctcaattcatcatcctctgccaatttcgctaatctctttagttaatgtattaacccaaaagaattaagcttaattgataggagtagttaatatcttttgatctgtgtgaaacagtgaaagagatatggggttaacattaaccaacatatagttaattttgactatacaaaaaaatatattatactgagtagtgagcactgacacaaatcactccattgtgcaatataatactgacacatcttttttaaatggactgacacacaaacccctccaagataatagctcgagtcagctcgtgtgtaaattaccgaggtaattaaaaaaaaggctatgcataatgcatgcagattaaaaaaaagttactgaccattacaggattttgtggtacattattgaaggagcatgcaggaccagattatttgctgtaacagcaaggaatctgatggccatgctggtcctgatcacacagtgacattagattccatctcatttctacaatcttttgccccttttttttcccatttcatcatggagagttttcttcagatttttcagtaaggtaccagtgatccagactgccagtggatgcatggttggaagggagccaagcatcatggcgcagcgcagacacgggctcacccggtagtccccatttcatgcccactggtcctgaaatgcttatggacgatggattagggacgaaattgagttgatatgtcaatttagttcctttcaaatatgtcaatttagaaaagctttcaaaaaaaatatcgatgaagaaagttctcgaagaaatcataatgctcagaagcttggaaaatgtgtccataataataataaattaataatccgtaggcagcacaccaaactgttctcatcctattgctatggttgtatttagttcctttcaaactttcaaaaattcttccatcagattaaatttttggacacatgcatagagcattaaatgtggacgaaaaaaaccaattgcacagtttgcatgtaaattgcgagacaaaacttttgagcctaattacgccatgatttgccaatgtagtgctacagtaaacatttgctaatgatggattaattatgcttaataaattcgtctcgcagtttacagacggaatctcgtttaatacttcaaatgtgtatctatatacttaaaaaaatttggcttaggaactaaacacagcctatgtgcatgttttttcaggttcagagtttcagatacgtacaaggtttagagtaggaaaatattcgtcatccccaaccctccatgtcatatagtttctatagcattaaatatattgtcacgtaagtaaaaatcttatgtgacaagagagttaacgaggataccatatctacacaagaactaagaataaaaacaaagggatatgtggataaaaagagagaggagagagatgattggatgggaatttaatttaaagacatcatccattaaatacatagtgtcataatatctatatataacatgaaaaatatataaactaatagatagtttttgggttgggatggcctcacgagctcctcgtgaatggcatggggcatgggcaaacctatacgtatctccttgaccttgccaagaaacatgaatgattcattgattcagtgctagattgagctaaatatataatgtgacatgatgccatgtgaggagcttcatcatctgccatctgatgcacgggtgttgcaagcgatgtgaggacttgtctggtaataatagctcttgaggtgtccgagttgttgcttgattgctggcttgctgctgctgctgctatttgggactgttcaagaatgtggttggagcaattcaatgatgaggcatttgctgttcttgtttgttgccaaaccctgtcaaagtgtcaataaccaacacacaaaccagaaacaggggctcacctaggttagatcctacttctacttttttttatgtcattcggctatctttattgatacgaaaatatagttacatcactcaccagcatgctcataataaagctaggggattcctaccactacagtttatgccaacggcttctcatcgtttgcctttgataagccgtgagaaaaataaacgaagcaaaaaaaattatatgtaaaacttttacataggcgttcttacaaatttagaagctaatgatgaaaaataaactgcgataagaaaacctcaaaatcatctctaaaattaagtgctaaagttaaaatttagctgccgctgataaactggcaagccagatttaaatttgactgttgcaatcaagaaagtacactttggccgggaaaaggggaaaagaaaagaaaggacactttgaactatgctatgagtaagcttatctcaggctcttaattagctagatctgaagctgcactaaatggctgcaagaattgggtgaataatatgtttacaagtactagcgaacttaatctgcattctagctagtacaccaactcaaaagtctgaagaattttctgctgaaaggagaagttgctataaaattctgcatgcttggattgcccagtttggtttctgactttctctaccagatcatttaatttaatggctaatagttcatgagtaatttcaaggacagtcttgttgagtacgtgtaattagatagcgatcatatcatctacattattgataggtactgtttgtatctgaaaccaacaaaaagaagcaaccttatcatcaaaatggaataaaggggataaaattaggtacagtctcgtccaaaatttaaatgaactgaaaaattagttgacgatcctgactccacacttcaaaaaaattgatttgtgataatagactgtaatgattttggaagggtaaatcaatccttaaacttcactgaaaataatgcagtccgggtatgcatttagtgtgtggcagcacagttaggttggattggagcatttgagcctgaagatgaggcattgggcccatgagaatttatgctcaattccagtatctagtgtagcaggtaaagagaattaaatgtttctaaatgaaaacataatcatcattcacttttactgtttataacttcatggttaacggttattatcaggtgaaaaacgctgaccatatatcagacagcaagcatgtcgatgcatgcgaatatgaagagtactgaactgaaaatttgtagttacaaacaaagaggcaagagggagtgaaaacagaacagggacgaaacagtgttccgccttcaacttatgaatcatagccaaatttaaattttagaattaatttagatgtttcatcattttctattttctggccttaatttttgtggaagtacaaaaactttaccctaaaatcaattttggttgcttcatttatttttctcagcttataagccgtagcccaaacaattagaatattttccagagaaaggccaaaagcatagttgtattattggtctcttgtgcatttgccaaaaaaacaaacaaacaaaacaaaacagagacaatcatctatttatgtgcagtacagactacagataaacagttcactcttgctcatggcagctacagtgcagaggtcctaagcaattcattgcctggacccttagttgtattacaacacaaggtacaaactgcacattagccatttgctgctcaactacctcaacagaccatgcactgcattgcaaaagggactctatggagactcttcctaaaatctcggccattgattattgacatatactaaatctgaacaatgtaatttcctatctgaaaagtctgatgaaatttgcaggcttccctttcttttctcttgcattactttttttttctcactccatcccccgtgtaaacagcataacaaacagacaaatttatacagcaaatgttatttgaacaaacataagagctaccaggctacccttgaaaacaaaaaagaaaaggaaaacaaaaacaacacaagatgctattgctagcctttgatttggctgccatttcttcagtccctatgcatcctttggtggttgggccgtctcatgttctcccagcttgagacaattaggttgaggatgtagtagtagacagtcttgacgcaagtcataataaagttccagcaagaggaaggccagtaccacggatagagaagccgaaagaacaggcttatcacatgccttggatatcggccaacctgtagcgcgacataagtcaaaattattatataactcaacaagtattcacattaatttcaaatagaatagtcatggcaaccctctgtgaaaatggatcaagatggttcatgagatatccatgtcttgctgcttattgatgaaaagggaagagaagaagagaaaacaacatatgatcctcaaagagaattgcatattcactaaatatatgcatgggattccatcagcaggaaatcatcggtgaccataaccgcagggcatcaacacagtaagtccagtataacagcatcacagtgatcatcagcacacatgcttgaaataaatcgattgtgatggtacatcgcggaggtaatatttgagaatttcaaactaaccatcgaagcgagtgttcaaataagttaaggtaagaaaatggtactcacaggaaaaagcagatccagtgtattccaggctgcatgccttactgctcgtgtagggtaggtaggacctccaggagaagtgaagctgtaaaggcaagccttcagtctagtgcttgtactcatcctcaattccaatcctggatgattttttttttcagaatgaagaatttacatttcagtggagaaacagatgcaaaaagtcttggattacttttggaatgtgtctgaaatctgaataactataccttgaaggatggtcaagcgggagaggtaatgcagaagcacaggttcaacttttagtttctggagctgaaaaacaaagaacacacgatttagtttgaggtgaagttttagcatgtcatgagaacaccgaagatacttcacttagagaacaacctgatcagtgagttcaattacatagtaatctgcagggccaccaaccaagaaagaatttggaaaagtaggaaaatgctcaaggaaacttgcaagcaagtgatctgcacatgcaaacttggatcacttcaatagcaaacaattgggaccaagaacgtggagaaaaataacataccttgatcatagaacagcataaatctcgagaggaggaggaaaagacctctaccagcctgttcaaaacatcaaattaatgacaacaaatactatcgtacatgcttattaggaaaactcatagcagagttcaatgtcaatagggagtgacctgtactgatatcttactcagttgatctgggactaaagcaacctcttcaaggagatactgtttaataaagcaagcatgttttgattttactaaaacacatacatcacagtttcaacgaaatttgagcaactgaaaccaaatatatccttacattatataatgagagaaagtgtcttgtattggtttggatgtcaatcctgtcaaaaagtaattccatcagatctatggaagtttcaggcaagaaaaaaaggaacatcagtgcaataatccctctgttagcagaaatattttgcagtaataactttctcagtcaacagatcaaatttatgggtgccatcataccaaaaaacattagtagctccttggacaagagcagagctgtatctcagtgatacttccttcccatcaagagggacttcgaataactgcaaatgatgaactagtaattcaccaaactgaaatagagatgaaggctaatacaatccggagcattcttgtatgcaagatcgaataagcgaattacagctagcatttacagaattctgtacttagcttgtttaactagctatttgcagtaaatggtggccagaacaatgggcagtataagcttgatgctgggatacaaattccccagtaagattatctttccttttgagatcatatatacattactcaaaagtgaaaacttaaaaccaccaagacattagctcattcagaggaacatatagcaaggagtaaaaggtaaaaggcacattcactgaggtactggttaaacaaattccttaaacgttactggaaatggaaaacatgacttcttgtgaacatgattgagtttgtacttatattggttatgaaaatcaacctattgcatgttctaaacatataaggttgtaagaattaatatatacccatctgtggaaaagaagtgcaaatatgttcgctgcaaaagactggctccagagttgcactatcaagtcaagtatacgcctcccactttcaggtactttaacaaaatggttagcaagaatctcatagaagcacaaccgggtatcttctcgctcatctactggagcaataccatcatcgttcgtgcttaaaatcacatctgttaaaaagaaataagtatgtaacatagcaaaaacacttgtaacaagattgagtagtattatgacccaaacattgatcataaaaggaagtaaggacagagcatgtgcagaaaataagtgatatactaatgtaacaacaaagttcttactgtcagaagaatccaagcaaccaaaactcaatactctgaatctaaaagaaaaaatggattgaatttctattaaagtatagccttattgttatgcacaattaagtcaaatatcatgttttcctgtgatgcaggtgtgcacagtaacgatggtgtatgcagtacttccctagttagcaagtgcatgccaaaacagccaacttttttagacacttcaatctacagatgcatataaaataaacaattaagatggattcctagaataaaaatgaagtaatgccaatcttggtaaacgatttttgaaaagcaaaatatagtgaaagtgacaagggaaagaactagtttttaactcttggctgacatcaatgaattgttagttctccgccaaaaacgttaaacaagggaatggatataaaccatagtacaaaggaaggcaatgcttttgccttccttcaaaaaaaaaaaaatagtacaaaggttcaaactctaggtaaaactaccacaaacttggtgccaatctcatgattactgtccacaaatacacacatgacgaaaaagcattagtttgattaacatctgaagctatgaaagaaatggcacctcgagcgcggtcatccaccttcaatgcgatgtcagcaaacaactgctgcagcagctgaagacgttgcgaattggagttgagagcctacacgcaagcaacaaccagtgaaacagtgccacctgccctatccaaaccactcaaattatcagtatcgtttcgagatcatataaagtaatctttaattcggtagagaatttgagaaaagaaaacgggagaaccaatttcgattctgtaactgcggtaattgccatcgacttagcgccattcgaaaaggggaaattctgggattacgaaacaggcccaaatttctctaactgatacgtggaaaacaaatcaaaatcgtatattcttcaacactgaaaactcccaacagaacaacagtctcgaaaaaaaccattgattcagaaaaaacaaatccaaacaaaaaaaaacaccttcctcactccaaaccgaaattaatcgcaaagaacccaaaaaggtggccaagaaatgctcaataatcaacagaaacaggccaggacaccaccagcacgaatcaacccaaccctcccggaaatcaatgaaagaacgagacgatgaggggggggggggggggggggcaggaaccggaatgcggaaaggaaggggcaggatataaccttttgcagcttgcgctcgatctccagggagagcgcctcgaggtggtcggcggctcgggcccgcatctctcgccgtcgccgtcgccggcggggggcgctcgccgtggacgctgggtcgagtagcgtcgcttcgcttctccaacgattcgtctcgtcgttgttctctttgctcctctcccctcttctgactcgtggtagggcggtccaatcagagccgtacacgtggcgggccggcgacgctggcgagtaaccgcgagttcagcggtggtggcaggataggcatcaccgtgattttgatattgcaaatggatgagaagagatgattctgattctggtcgcatttgatcggcttttccaacgaaataattttgccaaatatttttttttggactgttttgtgtaggccgtgtttagtttctctttattcccaactttttatcatatcatatcacattaaaaatttacatatacttgtaaatttttaactttttttccaaactctcaactttctttaaactttcaactttttttagaaactaaacaaacctgtaaagtttgtcaaatttttgtgttccaaacatgtgtctgattatcaggttgtactccacaatagtctgtctgtctgcgtgtttcagacatgcactgtaagcattttttttcttaatattaacagtgaattgattgtgtgattctttgctttcaatagaagcagggctgcaaagccttttctctaaaaaaaaatttgattgtgtgaaatgattgccgatttcttcttatcccacgctattgcgtgccgtctgctgtgctccaccattttcgccgcgtagctgacgtgtaccaacctttatcttggctcgaggacagcacgacagctgcatgcagcgacacgtggaaaaagcctactccacgggatcttctgcaccagctcggatcggtcactcttcactcaattcaaatcatacaatttttttgcagaatttttcatataaacatgttcactttttcacatgaatcttgtgagaattttcggtggtttaaaaggaggcctaataggcgccgtgacacgtcatgcatgcgtcatcacatcccggcaggtctcccgtctttcctcgggtcgctgacggcggtgagcatcccgtggaagacattctcgtcgccggcggcggcgaccggcgtcagcaagtcctgcacgatgaactggcagacggcgccggagtccgtgctcgtcagccggtggcccctccgccgcaggaactccctcgcctcgccgctgagctcgaacacctcgccgtcgaccaccgtcacgttctcgtacaccacctcatttggcaccagctacatatacataccaccatagtgtaattaattaattgctccttccgtttttatcatattataagttatttttattttttttaattatattattttgaagtttaacaaaatttatataaaaaatagcagtacttttaattaaaaaaatatattactccatccgtttcagattataaaacttttttactttgatcaaaattaaattattttaaggttgactaagtttatagacaaataaagtaatatttataatatcaaattagtttcattaaattaataattaaatatattttcataataaatttgtcttgagttgaaaatgttattattttttctataacttagttaaatttgatacaatttgactttaagtagagttaaaatatcttgtaacctgaaacggagggagtattaaaatatatttaatgaacctaatttgatattgtagatgcattaaatttttttgtaaaattggttaaacctaaataaatttaattaaaaaatctaagcagcttatactctgtttagggagtactggttaatcaaagagattaggtctaatcgattaactgatgcttgccttgtggtagaccctgggattcaggacggcggcgagcgggtgcatgccgacgatgaagtggttcacgaacacctggaccaccgtcgctatgatgaacggcccgccgctgccgccgacgacgccggcgagctgtccgtcctgcacaaagccacaaacagtaatggtggtcgtcagcaccggcgacggtgagctcgatcagcgtgacagcgtcgtcagccaaattgttagtaactacatgccttgagaatgatcgtcggcgtcatggaggagagcggccgtttgcccggagcgatgaagttcgccggcgccggcgggaggttgtccggcggcggcgtcccctccgccggcacggagaagtcgtccatctggttgttcaccacgatgcccgtcgacggcgacagcaggtgcgccccgaagaggtggttctccgtggtcgtcatcgccaccgcgttccggtcgccgtcgacgacgcacaggtggctcgtcccgtggtcatccagctggctccatctgatgatcaagatgtaatatcatcaatccaaatgtttcctggtatgatctctgcaagaacaagaacgtgtacattttctgagatcagttgtactttgggaagtagtagctgggagggaacgtggtgttgtcgacgatcctctgccggagtttgtcggcgaacgccggcgagagcatctccgagacgttgccggtgatgttgacgtagtcagggtcgccgagatccatccggatggccagcatgtgcttgaacgcctcgatgaaccggtgcaagccaagaaatcctttcaagaactcgagtgatttgtatccgctcaagatgttcaaaatctggaattaatcatattcaagtttggtttggatggatcgaggaatgaacagatgatcagaatttaactgggacgaatttggatactgaccagagccaccccgacgccgccgctggacggcggcggcatgccgaggaaggtgtagcccatggcgtcggagcgcatggcgtcgctcacctcgaccttgtacgccctcaggtcgtccaccttcgcgatgccgccggcgcgccgcacgtcggcgacgaacctctcgccgacggcgccgtcgtagaacgcctcgacgccgccgctggcgatggcctcgagcgtgtcggcgagcgccgggttgcggcacacctcgccggcggcgaggatcctcccctccggcgccagcacggggcggaggcccgggtccgcgagcacgtcgcgctccgtcttcttgagcgcgatctcgaggtacggcaccaccgtgaagccgtcgcgcgccagcttgatcgccggcgcgaagaggtccttccacggcagcctgccgtagcgggaccacgcggcgtggaggccggcgagctcgccggggatgcccatggcgagcgcgcccttgtacttggaggtcgggttgcccgcgtacatgtcctgtcagacacaaaaaccaccatttcagcttgtcatgtttgggaattcaaatgtaacaaattcatatatattttgaattttgattcgagcatcctttttcggatgcctctcacttcgatcgaattaagaacataatctacctttatttggaccagcaaactcagctagcagcaagtttacacaattgagaaacgtccagaggttttccggctagctctacaaggtggtaggctaaataacctagattcgaagcctcaccccttttaattatttgatattagatcattccctaatattcgcgtcttttttcttagcaagtttacacaagcaaattcagtgtaaccataagaactgcccaaataatggcaaattcagatgctctcagattttgcttcataatgctatcgatagaattagcacttgcaacgcgcgcatggtgcattatcaaaaaatgttttgcttcataaacacttgcaaatgtgctatcgacaaaatgcgttgttattgtggaactgatctgttcagttcttttaatgcaaattctcacttgaaagaaatttcctaatggacaatttcagctctggttcacacaaatcccccaaggtgttgctatctctgtttcaaattactgttccaggtttgttctaagttaaacatgtttatccttaaccattaatttttaagaatccgtgaaagttaacaaataacaatatatgaattctatattataaaaatattcttatggtgaatccaaaaatataaatttttgatgtttagctacacaactttatataaatttatagtcaatgattaaagtgtttaacttagaacaaatttaaaatgacaaataatttgaaacgggaagagtatatagttaatgttatgcaagttgttgtaccgaattacaccaattttacaagatcatacatcatgagcacaactattttctttaagtaatttcagatattttttcccaaatctattggtttcctatccttttagctatggttttcaaaagaagaaaaaacatcatacatggtttcctcgtaaaactacagctttgtattagtaacatgatcattgctatatatcaaaggtgctatgtccctccaaggctccaaaagtccaaataatgacagggaccatagaaagtactaaacaatggagttgatgaaccatattataacaaactatacacaaatggcgaccttatactgttatatataccgaaaacatttcccggagatatgctagttctaatgggcgatcgatcaccctacctacctagtagcgatcaggtagccccctccacctggtttccttttttggcaccgcattattttcctattttaataaatttatgcatctaaagtttatacatctcaagtttacacatctaaagtttagagaccaaaagtttataagtcaaaagtttatatatccgattcaaatttgaatttgaattcaaatattttttatatatatagtatttctatacatataaagtttatatacctaaagtttatagaactaaagtttataagtcaaaaatttatatatctgattcaaatttgaatttaaattcaaatatttttcatatatagtatttctatacatttaaagtttatacacctaaagtttatagacctaaagtttatatacccgattcaaatttgaatttgaattcaaatattttctatatatatagtatttatatacatataaagtttatacacctaaagtttatagatccaaagtttataagtcaaaagtttacatgcccaattcaaatttgaatttaaattcaatttatatatatatatatatatatatatatatatatatatatatatatagagagagagagagagagagtatttctatacataaattgttctaacttttgttttttaaaaaaaattgtgtggtgtactttggtagaaagagaagaaagggaggaggaagggggggagaggagggaggagtacatagtataggagagaggcaggggggtgatcgctgggcggatggaggagcgatcacccgcctaataggaattaccaacgcgtgaaacatgtgagaagaagaaaattataaatctagatcgaatctggacaaatttcatcttttttattcagtgtgaacaactgaacccatattttattatcttaaagaaactgaactcattttcccaaactggcaactgcagtatggtaatcgcgaagtgcagaaaaactataaagaccaccttgaagcaaccaatgaattagcccatgctgattgcacgtgtgaaatagagagtcttacagaaatggacattttctgaagcgatctacaatatttcaataatataatcaatgtccatttctgaatagttctgaagactgaagcagagttgtagcttgaataattctgaattacaaaatcacagcttgattaaaaaaagagtaaagtgtattagcgattcttaaacttgtagggttgtgttatataggttcctaaactctcaaaatgcatattcaggtcctagaatttatcaaagtgtatcatataggtcccaaatcggcacatcccctctaagatcctacgtgatgctgatgtggcatgccacatggacgtgacgtgtcattttcattttcttttcttcttttctttttctttttctttttcttcgttttcttctcattcttctttttttcctttcttctgctcgggtcacagagaaaggagaagaaagggaaaaaaagagaagaaaaaaaagaaaagttttaaatgtgacccatttgtcagtcaaaatgatgtcacgtcattccgtgtgacatatcacgtcaacgccatgtaagatcctgaaggggttgtggcgatttgaggcctaaatgacaccctgtaataagttctgtaatttggatatgcattttaagagtttagggacttagatgacacacaactacaaatttaacatacactttactctaaaaaaaaaaaggactacctactaagcgacctacaatgtgttgtttttgtttaatgtggttttaggatcatggaccacggggtagtcgacaatgcacatcgcacgcttgtacagtggcatgcctctccatgaatggaatggaatttgcaatgagccaaaaaaaaaaatcaaagtcaaatgccaatcatgtttctagatatggtgacttacatgctgttgctaaactaaatgaagcggggttcaatttaggttgtgttattttgtgcaagtcaccaacttcttatttatcgtttttaaaaaaatatataaaaaaattgctttacaaaatcatactaatcatttttaagctctttatagctaatacataataaattataggctaaaatgtttcatcgttttgcgtgtcatacctccaaacacagccttaatagctgtcaaatgccatcacaaaataaacaagttacggagacaacctttctaaatgaaaaaaacaatagctctattcagaaaaagaaataatgcagtggctactgaggcgaagaagaaagaaaagaaggaagaagatgaaaacatgagagaacgattctaactttgtaaaattttagtgatattcagctgatattatgaatagtaatattttttaaaaaaaattggtaaacttgtaataacatgatccaattaacccctttttgaaagttgcaatgtagacatttcgaattcttttttcaaaatttactgatagggatacttcgaattgctgatgtgaaatttttcttgctgttcttttacagccccgtcttttcacttatgcttatcaaccaaaatttaaaatttcaaccttaaatttagagttgattttggagttttctcatcaaagtttattttacagcatttgcttttagatcactaagaacacgtatataaaagttttattcataaattatttttcgtttgtaaatataccgtttcacttattccggatggggccgttagttggtgagcagaatcacgtgcctatcatttgcgtaggcaggtgtggcccaccagacagtgacatgcgccagaccaccgaatcgctttaaatccctaatattataagagcaggtatagatatattttaattttaatgaaataaaaggtgaaaaaaaagagcagcgggttatagatctgtagccagctgcagtacagactccaagagatagtgggtgtatgataggtgagaccgtatattaatagtatataaagaaactattgtataaattggctattagactataatataatatatacatatacatatatatatatatatacatacatacatatatatatatatatacatacatatatatatatatatatatatatatatatatatatatatatatatatatatatatatatatatatatatatatatatatatatatattggagctagtagtgagctgtactattcaacttgctctaacggaggtctcgttgccggccacgtggcgcgtggccacacacgtcatccgctcaaaatttccgggaaaaagttttttttttttgtttttactgcgtgctctagttggtgacgagtagtaacgggtaacgcactcaccggcgtggccgcggccggcgcggtctcgcgggcgtcgaaggctacggcgtcgccggaggcggcgtccctggcgacgatgaacgcgccgccgccgacgccgctcgacatcgggtgcaccacgccgaggcagagcgttgccgccacggtcgcgtccaccgtgtgcccgccggcgcgcagcgccgcggcgcccaccttcgagcaccgcccgttgtccgttgccaccgcgcccaccccggcctccacctcgtgcgggctcagtctcacacccccgccgccgccggacaccaccctgctccgatcatcgccgcccgagctcaggtgcagcacgacgcacgccgccagggcgagcagcgccgcggcggcgatggcgagcgcggtgcacggacggcggcgccgactgtccggagaagaaaccgcgccgccgccgaggagagggttctctaggccgcctcgcgcggccatggccgccggatcgccggagattgtagtggcgatcggcaggtaggtcgtcaggaaggggagggattcttggatggcgagagcttgtcacactgtgcgtttgttggcttgtcaatgagacgcttgatttttataatgatcgtgtgtctaactgggcaatgattctacagatcctattgtacttgatattttcactattttcttaattatactcccttcgtacaaaaagaaaatatataacagttatagagcgggacacatcggtagggctgtcaaaaaagctcgagactcgcgagctgctcgagctcggcttgtcctaggctcgattcgagctcagctcgagctcctgacgagccgagccctagcctctctataagctcgcgagctttgtcgagccgagcttgagcttccaacgagcttagtaatatatgatttttgttattatttaataaattaggagatcaaatatgttatttgtatggcttatattgacatcatatatttattttattcttttttcctcttatattaatatgatgaactaaaaattaattatatttttaaagattatctttcaaatatatgttgttttacttaaaaatcaagctcggcagtcgagctcgagccgagcctatcagaaagcttgaacattttataggctcggctcgagcttgtatcgagctcgagcctaggcagacaagctcgctcgagctcggctcgttgacaaccctacacatcggtattaaaaaagtgagtggatattgaggaaaagttatgattcgtgaggagaaaaaaatataggtagagataaaatggagaatactccattttgggacaagttgagaagtgatagaaatagctttagagctaatcaaatgacttgtgacttgtgatttggttaagatgggagaataggtggaaaatagttttattttaggataagtttaagtgatagaaatagttttattttagaacagagagatctaatcaaatgaaaattcagaatttgaatgtttgacgcaattgtactgattcaatggcgtgattctaactcatcaaaagcaataacccatcagatttttttttaaaataatatttcgatttagtgctacttgttgttgggatatcactttccaaattaagccgcaggaattacctttttcttgtaagtaaagaagaaacagagtacacagcagattgacaggtctacagatgtgtatactattgtcagatttatgagatcacaaaatttaaattctgacagttgatcttcttaagagtgacaaaatatcagataattttttttgcaagaaagaaatagagaaaataatctgcacctgcaaagaatattatggtgtggacagtgtggcaagcagtggactgcgtagccgcagcggcagcttgatcacagaatcagctgggaaaacaaccattggcagaatcaggagctctgatctttcagagttgtgacaaactgattttttttaaaaaaaaattgatcacgtcattataaattttgcaattttacaatttggcattactatttgcctatatacatgttgaaattgaaaaatatgacactaacattgaaaactgaaatatcccttggctgtatttttcaatttttgggaccaaaatacccaatcttctccgttcatcctctcatgtacctccagtcatcttctccaccaaaccacccatggctgccccgtgctcgagcgccacagccggccgttccactgctgtacaaattttgaagaatttccatataaacttgttcagctttcacatgaatcgtgtaagaatttcggctgtctaaacgggggcctaatcgatgccgtggcgcgccatgcatgcgccatcacattccggcaggtctgccgcctttcctcgggtcgctgacggcggtgagcatcccgtggaagacgttcccgccgccgtgctgccgacggtcggcggccgagccgaccggcgccagcaagtcctgcacgatgaactggcagacggcgccggagcccgtgctcctcagccggtggcccctccgccgcaggaactccctcgcctcgccgctgagctcgatcacctcgccgccgaccaccgtctcgttctcgtacaccaccacgttcggcaccagctgcattatatataccaccgaccagacagtaattatgagattgatttttgtgcatgtccgttcgaaaagttataaaaaaatttaaaagaatttgtcaagatagatcaatatacaatatatcttttcacaaatatgtgaattaaaattcgacatatacaattcgaaaaaaataaaaataattaccataatgtgttctatttatagtcaaatttgttatttttttttaattgtataagttaaatttgaatttgtattatttgtgaggtgacatattatataacgatctatttctactaatttttttaaatttttttgataactttttaaagcgacatgtaaaagtgagagatatcctaattgagtttcccagtaattaattaattgctgtttattaatcgacgagattaaggtaattaattgatgcatgcgtgcttgccttgtggtagactctgggatgctggacggcggcgagcgggtgcatgccgacgatgaaatggttcacgaacacctgggccgccgtcgcgatgatgttcgtcccgccactgccgccgactactccggcgagctgtccgttctgcacagatagcactgcagtggtcagcatcggcgagctcgtcagcgtcagcgaaatggttagtagttactactatatgcttgcctttagtatgatcgtcggcgtcatggaggagagaggccgttttcccggagcgatgaagttcgccggcgccggcgggaggtggtccggcgtccgctccgccggcacggagaagtcgtccatctcgttgttcagcacgatgcccgtcgacggcgacagcacgtgcgccccgaagtaagagttcaccgtcgtcgtcatcgccaccgcgttccggtcgccgtcgacgacgcagaggtggctcgtcccgtggtcattcagctggctccatctgatcacacaaaaaccaaaatctcatcactaaaactgctctagctaacttctgaaagaaacgttcatttctgagatgagaattactttgggaagtagtaactgggagggaacgtagtgttgtcgacgatccgctgccggattttgtcggcgaacgccggcgagagcatctgggagacgttgccggcgacgttgacgtagtcagggtcgccgagagccatcctgatggccagcatgtgcttcagcgcctcgatgaaccggtgcacgccaagaaaccctttcaagaactcgagcgatttgtatccatccaagatgttcaaaacctgcgattaatcatgtcaagtttgatatggatcgatcgagggatgaacaaataatcgaaattgactgggaatttgatactgaccagagccattccgactgtgccgctggaaggcggcggcatgccgaggaaagtgtatcccatggcgtcggcgcgcatggcgtcgctcacctcgaccttgtacgccctcaggtcgtccaccgtcgcgatgcccccggcgcgccgcacgtcggcgacgaacctctcgccgatggcgccgccgtagaacgcctcgacgccgccgctggcgacggcctcaagcgtgtccgcgagcgccgggttgcggcacacctcgccggcggcgaggatcctcccctgcggcgcgaacacggcgcggaggcccgggtcggcgagcacgtcccgctccgcctccttgagcgcgccggcgacgggcggcaccaccgtgaagccgtcccgcgctagcttgatcgccggcgcgaagaggtccttccacggcagcctgccgtagcgggaccacgcggcgtggaggccggcgagctcgccggggacgcccatggcgagcgcgcccttgtacttggaggtcgggttgcccgcgtacatgtcctgtcagacacaaaaaccaccatttcagcatgtcattttgggaaatcaaatgtaacaatttcctatttttgaattttggctcgaacatcctttttgagtgcctctcagtttgatcgaattaagaacataatttatcttaaattttgagttttaatgctgaaatttggagtccatggtcatgcgaattttcaccaacttcagatggagatttacaaatagaattgaataaaatgtatttctccttttactactatattggagtgttagacttttgtctaatcatagttagcttctatgagctcaatgttgagtgaacaatatttgtaataattggttgtagcatcttttgaagtaacgaccagatgttattttcattatctaaaaaaatatgtatgagcataattaaaatttaattttccactttttaattatgctcttcacaaaaaacatcatacttgaaaatagaaaggtctaaggttgcatttgtatgtgtaacttgcttgagcttttcacctgtacgtaaaactgagaagaggaattagagtataattaattaagtattaattattaaaaaaagtagagagttgattttttttattttttaagaaactttgatgtataaagttttcaaaaaacacattgtttagcctgtttagcagttcaggaaatgcaccaacgaaaaataagaaagttgttgtatagagttgctcaaaagaacgcaacataaataatgaagatgaaccataccatactaaactatttgtatgaaattgtggcgatggaatctacactgttacaccataaacatttccctacatgccaaccaactcgtgaagcatgtgaggagatgaaaatgacaaatctagatcgagtctgaacaaattctgtcttttttattcaacccgaacaactgaacctgtattttattattatctaaaaaatctgaacctttcttcccaactggcaaccgcaatggggtaactggtaggagtatcgcaaagtgcagaaaaaaaaaagaccaatgttgaagcaaccaaatcaattagaccatgctgattgcccatgtgaaacacagtgtcttacagaaaatgaccatttttttgggatcagatcacggatcatgctgtagttgataatgcaatgcacattgcacacttgcacagaggcatgcctctcagtgaaatgaatttgcaatgagctaaaaaaaactcaaagtcaaatgctgattatgtcttctagctatggtgacgttttacacgagacatgccgttcgctaaacaaaatgaaacaatgtggtgtaatacggaaatattagggagggtcagcttagataccgagtgaaccatagttaatcaggagtaaaaaagataagtacagtggtttttgtgcaaactgcaatataaagccattcggaaaagaacaggattgctgattggacttggagaggaacgtcaggtgcctatcatttgcgtaagcaagcgtggcccaccagacagtgacctgtacccaaccagcgcatcgcactaggccgtgggccccacatgtcatgcactcaggattgcagtaaaaaaagttttgctttttctttttttttttaatttttactgcggcgctctagttggtgacgaggagtaacgtactcaccggcgtggccgcggccggcgcggtctcgcgggcgtaaaagattacggcgtcgccgaaggcggcgtccctggtgacgatgaacgcgccgccgccgacgccgctggacatcgggtgcaccacgccgagccagagcgccgccgccacggccgcgtccgccgcgtgcccgccggcgcacagcgccgcggcgcccacctccgagcacctcccgtcgtccgccgccaccgcgcccaccccggcctccacctcgtgcgggctcagccccacgcccccgccgccgccgccggacaccaccctgctccgatcaccgccttgctccgctccccccgagctcaggagcagcagcacgacgcacgccacggcgagcagcgccacggcgatggcgagcgcggtccacgggcggcggcgccgactgccctgagaagaaaccgggccgccgccgaggagggggttctccaggccgccgcgcgcggccatggctgggtagctgccgccggatagccggagatcctggtggggattccaaggtaggacagagaggggagggatttcttggatagcgacttggcgagagcttgtcgcactgtggtgttgggtggcttgtgtgcttgagacacttggatatttatatttagtgactgtctgtccagctggccaatgattctatagagcttgttctaacttggattgtttctagtactatatttttaacgactcaaagctggagtagtaattacttatcagatggaaattcagaagttgaatgcttgacgcaactgtactgattggatggcaagagtaattctaacacattagagtgaatctggacataccttacgttcagattggtttattttagaacggagggactatggataaaaaaaaatttgaactctgaccattaatctgcttgagtgtcaaaacatcaagttctcaaatgtgtactactagtattatttttgttgcaaggaagaaacagagaaaagaatatgcagatgcaaagaatattgtggcgtggtgtgtgtgagatggtgcagcaaccattggcagaatcaggaaaacagattctttcagagttgtgacggactgatatttattacgtttatttatgcttagaaaacccagcatctgaatatctgataagcaccttggatctccgtctggctatcactattttagcctttaatttcatttccctattttttaataaatgaaacttttattgatctcaaacagttctccgcaaaaaaatattaaaggctaaaatatactacccattacaaaatatagcaacttttagctataaatatacctcatcccacaatataataatttttagctacgaattagacatgccatttgagcggagcgaccaaccaacttggcgaggcgagtgagacgaccagagtcggtgtaatcgcgtctcagcaatttgtcgctgtcaagtgtcaactactccggtccaggggcatgacttgttggtaatccatgcgtctcagcttctctttgctgcaccttctgtcattttctaattaaacggttgatatgtgttattccttaatttatgggttagttattactaacatagtacggagtactccgtaagtagtactagtatttatggtttttgcgaattgcaagcagatttctggatttttcacattttggtccttttaaaaaacttatttcgcaaatagacccctaaaaaaacttattctaaaaatggtcctttttaggcgccagaatagctggctcccccccccccggccgaaattttttatttttgttttatttgtttgatatttttttcacgcttagggacacacaaaaaccaaccatagaaaaattgaactcaaatggacgtaatatgtgacctgtagaatttttccactcctctcctctctctccaaaccagtgcaaaggagagatgtgcaacttttttatttttatttttattttttgatatttttttcacacttaggaactcacaggaatcaaccatgtaaaaaataaactcaaacggacgaaatatgtggcatgtggaattttccaaagttctaccgaaaaacttctcctcgaaaacacaatcttacaagcggaatttggaggttttaatatcgccgaacccggcaaagcggggagaatcggatgtaatattttctgtagatgtccgtgcatatattatttgcctgattccgagttcgtatgagaaagttacgcctattttaatagatgacatattttgtccgtttcgattgagttttggaaaattctacaagtcacatattttgtccgtttgagtttattttttatacggttggttcctatgttctcctaagtgtgaaaaaaa

SEQ ID NO: 75464 - DNA, 2721 bp, Oryza sativa
ccgttccacttccagtaattccgtaaaattgagatctatttaatggcactattaattagtctaaataggatccttctttggtcttttgtttaggttttcgattgtttgtgtaaagttgcggttgcggattttcgtcgatcgcgggttttctcgaagattcgtgaagcttcgtgaagaccttgagcaaggcaagtcaccctttgaccaattgctcctataattggaaaatcattattattttgtttgcaactggcattattagaatcacacacttaacttgcttggcctcggtttgcgtgccaaaccgacggacctacccagtagtcgcactaatttccgtaggtcgtactaccctgatttccttgtcactccacccttgtggtacctcggtattcgtgctctctgagcgcatataccaaatatcccacatacaccgttgtttgtcgaaaacttgggaaatgggtttgtgaagccttcaaaacccgacatgtggtgtcggtttgtttgaaaataaaaggaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggttggagccaaaccgggttcctggtaaggcaagaacgagaagcttgctcacttaccgatcaaggtggttggagttgatttgtgaatgcctaaaatggcctatgtttatgtgagaatttgatccttctatgtggcatgaggtaaccctgggtcggcttaggaaaggctttgtcgcgaacctctgacaccggccagtgtctggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatagacgacctgagtggtcagaaacgaatctatgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaaatgagctgttgaaaaacatctcttaaagtcgaaacgagacgcaagtctcttttcggcccaaacttagaaagaaataaatcacttagtgttttcaaaatgtcttcaaataaaagatttgcaaaacaaccttgcctctcttccaagcttgcattaaacacctaagttcccgtgacttgctgagtacgagagtactcacccttgctctatatatatatatatatatatatatatatatatatatatatatatatatatatatatatatatatatatatatatatatatatatatatatatatatatatatatattctttgaattgcttcttttcttcctgctcagcaacttggatttcttccaccggaaatacctggctcttggacacatcaattactgccatcaacaagaaaccgtccaacgatcgattacaactgctgccacccttcacgagcctgactattactgaattgggctagcaatcattatctcctgatccattccattaatccattccattaatcgaaagacaaatcttttatgaaccgagccttcacttgatattccagtaccatgataacaagaataattgctctacttaatgtgtttacttttccataacaatacaaactttaacttccatttacttcacattgaagacgtgagaattgaatcttcttgctattttttcttctaaatcaacatctctttacattcctcgttgttgaatgtcttagccttactgacactattcttttgacttaaaaaatagtgcaaaaagaattgtcctttcagacaccttgatataatcatttcttctataaaccacattgtagtgggaataatcatcttgatgacatagatgtaagcttttattttccttattccttattgactcttgctcacatcaaacttggaaccttatatcgtgagataccaaatgtgaacaattctcttgaattttttttcaatggcgtcccttgagcttctgacttttaaccttccttggctgacagactgtgttatccacaacagcatctggatgaattttatttggagatccagacacattgttccttagctgaaataaccaggttgagtatattaaatgtttacttgtttaaaccactggcaccgttgagcacaaaacttcctttcctttaattcattctcttaggtaggaggtaagagagagatagaaagggaagagaaagtagataggagactcaaaatagaatagactttttactaagctttattttttttattgatgtgaagtaggttgttttttaacactaaactgaacactgaaactagtatggttatatcacaaccctcgatatactccatacgctaaaacccacacacacacaaacaaaacttaagcaagcaagctaacaca

SEQ ID NO: 75465 - DNA, 1378 bp, Oryza sativa
atttctcaaagttttagtacatatgtatgtccaaatcaatgcagcccatttctcctttttagcttgtcaaaaatgttgtttacagtttttttttaaaaaaaaaaatttgtggaaagaaattgttgaatcgatcactccgtgacatgaaactacaagcataaagaatcagcacatcgtttagcttattcagatgctagaacaaaatgtaagtcgcattaataatatctccaacatgaataagtggtaatggatagaatggaagcgaagccagctttgagaggtgctaagttaagcttcatatcatatgaggtcaccttcaaggtcggtgaggcctctagcggaaaaagtctggagctcgtcaccaacgtcgccatctctaaggtggagatcaaggagaagggcagcaaggactgggtgacgctcaaggagtcgtcaactaacacatggacaatcaaaagtgaggcgccgctcaaaggacccttctccatccgcttccttgccaagaatggtggctaccgtgttgttgacgacgtcatccccgaaagctttacggccggctctaaatataagagtggcatcaacatctaagtgatagacatgtgtgtttttattttgaaataattcttaacctctctataattcttttttatttcaaaagagagatcaagtctgcattcggggaagccaataattaattttctatggttattttgtgaaatatgccatcaacaaaataaagcattccgtatgccatgtctgcatgttgctgcagaggtatatatccagacgattttgagtatattacgtatataatatttgtgggaaaaagtatagttggtgaaacttcatcgagatagtttcttacattttatttttctaaagtttgagtacatatgtatatgtatttccatatcaatgaagctcgtttatcttctttagtatgacagtatgacaaaaatgctacaaaagtcgcatttacaatagtgattgttttgtgaccacaaattgttcaactatgacacctacagatactataagcatgatgcattggtacatattttagcttactcagaaggcagagtgcccacaaatcatgttcatcccatctccagcaccgaatgtgtggccatggataaaatggaaatgaatccaacttcgagaagattaatctatgcttcacgtcgtacaattggccaacaattaaagttttatctaatatcagttatccgtgtgttgcttcggataatagaaatatatttaatattatctgaaaaattaaaatttgctttctattaaatgtgttaataatatgtttggtaaagggaatattgatcctaatttaattttatactccctccgtattttaatgtatgacgcc

SEQ ID NO: 75466 - DNA, 2514 bp, Oryza sativa
tcttacattttattttctaaagtttgagtacatatgtatatgtatttccacatcaatgaagcttatttatcttcttcagtatgacagtatgaaaaaaaatgctatgaaagtcgcatttacactagtcattgttttgtgaccacaaattcgttcatgcgttggtccacatcctccctaaatggaaaatgaggaaatgattagttttcaatatttgtaagttaaaaaataagtagaaaaaagatgggattgcatagctgctatttgagaggtttgcatgctctacgctagcgaaacaaccgggactacccaaatcacatctatttatagcaattgcataagaattcctcaacgaaaaagccggccaacgatctacatttgcaatgtgcgtccatgcctggttttctaaccccaggcgatataaatagatgtcgtccacatcctccataaacaaaacatgatgaggtgattaatttttattatataagttaaaaacagtagagaagatatgtgaatgcattgctactttttatgaggtctgcttgtcctgcgccagcgaaacaaccgggactaccaagtttgcatctatttataggaattgtattagatttgctcgatgaaaaagtcggccaacgatctctttgcagcaccatgcgtccatgcctgtttttctttgccccccgccaccataaatacgcacccagctgcaacatggatcaccaaacatatcgatccttccctctacccttcaagaaacaagaaagacaacaccaacaaacaatctatcttgctaatggcctcgttgtcctccttccggctcatgcgccactgagcttgccttcaaggtcggtgagggctctagcgacactagtctagagctcgtcaccaatgtcaccatctctgaggtggaggtcaaggagaagggtggcaagtactgggtggggctcaaggagtcgtcgactaacacctggacgctgaaaagtgaggcgctgctcaagggctccttctccgtccgcttccttgtcaagaacggcagctaccatgtcatcgacaacgtcatccctgaaagctttacagctggcactgaatacaagaatggcatcaacctctaattaatagacatacgtgctcttgtgttgggtcgcatgggaattattaacctctaaataattatgttttagaagatatcatgccgtgtgtgagtgagcaagcaattaatttcccatgattattttgtggtaataggccagtggcaaaataaggcataaatgtgttcttccaaaatattgttgtggggctatatataagcatgattttgaatatatatattgtttatagaggatgcattgaaaaattatactccctccctcccaaattgatcatcatataatggaattcaaaatttctcaaattaatcatcatatacctgcatgtacacagatttcatcagaatacaattactgcagcatggcagaatatgtgcatgctaaggtgtaattggcatggtgttttaatcgatgcatgcattgtgggagaatgtgtgcttgatgtcttgattgatgtgatttaaattatccttggtcttggtgcataagcatatatgatgatcaatttgggaaggagggagtatttggtcagttttcattgagatgattgttggtgtttgattttccaaagttttatagtatgtccaattcgatgtagtccgtttctcatttttagcttgttaaaaatgttgtaaaagtcaaatttacacttggtttttctttttcatgaaaaaaaattgttgaatcgaccatattgtgatctaaaattataagcataaagcatcgatgcatcatttagcttactcagatgcgagaacaaattgtaagtcacattaatcccatctcaggtattaatgagtggtaatggatagatattaatgagtggtaatggatagagtgcaagtgaaacctgcatttggaggagctaagttaagtatcatatcatatagttggctaaggccctgagctatagtcaacaacaaagtttataaaatactaagagaataccaatctattgcaaaggatctaaaataaatacaccattagttccaactttaaatagaaaaaatatttacactaccaatgtgttgcaaaggatctggaaaatatacagtttattccaaactttaaatgtaaagaactaataaatctttaaggccaaaaaaatgtagtggtgatttatggttcctcatccatcgtatgcctagcctcacttccacgccctcttaagtggttcccgcacacatgatgtcccttccccttgcacgattggaggcatgccctctaatgcccaccaccccgtcaaaatccatccaccatccttccccggtgcttgcccatgtacctcctctcacatgtagctctcatgctgcatggatgtaacaatgtgtgcacccgcccattaaaaatcaattgaagataaagtgtactgttgtatgaagtacaatctacactaacatctggaattgca

SEQ ID NO: 75467 - DNA, 44233 bp, Oryza sativa
ggcaacccgagcaatgtacccaagttagtgttttaattcttaaaacctgcttaacaactaaaatgtggaatggttggcctgggttggcttgggacaagctgggacccagggtcgggttgccagttcggtctgaatcatcgtaggccttgggttaaggcaggttcgtgtgggttcacggccttgattaataatattgtatagctctagggtcgtatttacaaaatagctttgagcaactaagtgtcttttaatgctgtttactgcaaaccctaacccctatattatggctcccttgtactcccttgcatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcctccgctgtttttcgtttgtcttcttgtgtgctgggccttcgccgcccaggtaataaattaactatttacgcttccgcttgataagctctaaaatgtatcaacttttggtataccttgcctcctgggacatggaataatacacgcacgtaaggaacgcccgttgggttatttccggtcgtgacaggttattgctaccgaagtctaatttggttccgagaggggggcatattaccactaattgcatagtgtgcgattgtaatttttttgttgcaataagtaggaagtatcgcaacaaataaatttgcgttaaaattagggtgacgatattgccgcgctttttgttatcgttgcaatagttatccatgtcgcaacgaatttagagcgttgttattagagtcatgtatatagcaacgcgaaactactttgttgcaaatgagtctgtagatattgcaacgcaaacctaaatcattgaaaattagtctataggtattgcaacgcaaacctaaatcgttgcaaccattcttagatattgcaacaaccaccggaaatcgttgcaactaacaagattctctcgcaacaatatttcgtcattgctatagtttaacgaatcgttgcaataggtgaaattggtggtgccacctacagattgttcatgggcctttgtattgttaaactttaacttgtttgcatcattgtggcccgggtcggggtcatgacttacgtaattaagtcggcccggccaattagctgggctgtatcgtgtaataaaaacaggtacgattaaccctacccttagcagtcgatagatagatccctgatcatagactagctggcgccagcgacccttttatatcttgcacaattgccggcgacaccgaagcactcgacgctagcgagaccacaccctgtccctatctcccaactcgatatctcgacgccgttcgaatcgatccctatatttatatatattcaggtacctcttcgatcacgagtgcaatgaaaactattgattctttattttctatatatctatgtaattaaaaattggcttatttcattgcataccaccccttaggcaaatttggtaacaaattttctcaattggaatatggcacgtgatgatgatcatagttggatgctattgtctcagtcagattgtgtgtggcaagttggatttgaaaaattcatttaacatacatttgaaggtacccatccaggagggactgcggcctgtccatgtactaggtgtcgttgcatggcatacagaacgaaaattgaggttcaacaacactttgcttggtagagggtttgataaggatttcataaaatagaaacattctgttagtaaacctatggttgtggatgatcaggagattagtgaagccgaagttgatgatggcggctctatcgataatcggctttcttcgctaatcagagatagtaatattgaggtgccaaatgagtcagcaaagaattttttcaaattaatggaagaagatcggaaagaattatacccagggtgcaaggaggctaccatggtatctttcattgtcaggctatttcagattaagtgcatgtatggtatcagtaacaatgccatggagcaaatacttcacttattctgtcttttgctccctgagggacattgtgtcccaaatactttggataaagttcgtaaggtagtccaagatctcgggttggactaccaaaagattcatgcttgtgtcaatgattgtgtgttatttcgtggagagtatgataatatgaacagatgtccaacatgtggggagagtaggtggaaaaatatatattctggagaactcggggaaggcagtggcattggaggagtaaagaaaaaagtccttcgtcctcgtaaaatacttaggtattttccacttattccttgacttcaacgattatatatgaatgacaccacattgacctatatgcgttggcacaaggaagaaatagttgatgatgggaaagtgcggcacccagcaaactcattggcatggaagcacatagatgaaaagtacggggatcggtttgaatctgatccacgcaatgttaggattggacttgcatcagacggcttcaatccatttgggatgttgaatgcgacttacactacatgggcggtgatcctaattccatataacttgcctccttggttgtgcttgaaacaatcttattggatgatatcgatgctggtacctgggcctagatctccaggaatgaacattgaagtatatttgcagccactgatcgatgagcttaaacagggatgccaaggtgaaaaagaattttacgcttcgtgcaattctgctttggacaaaaaacggttttcctgcgtatgccatgttatcaagttggagcagaaaaggcaagtttgcgtgtccttattgtcacaaggatactgaatacttgtggttaaaatacggcaagaagcattgctacatgggccatcgccgctttttggcttcaaaccacaggtgtagaaagaacaaggttagcttcaataacaaggttgaaatgagggggactccagtggcactcagtggtgacgaagtattgaagcagtacgagagttttgagcaagtcaaatttggcatgatgtcaaggaagaggaagcaacgagatgaagatactagatggcacaactggaggaagaagagtattttttttatcttccttactggaaatcattgcttatacaccataatctagatgtgatgcgtattgagaataacatatgtgagagcttgctaggtactttgcttgatttaacaggtaaatctaaggacagtgagaaggctcgacttgatttgcaagaattgggtattaggaagaatcaacatctattggtccataaaggaaaatacactttgtcggcagccttgtacacgttaagtccaagtcagaaggaaattctatgcagatttctacaacatgtcaagatgccagatggttatgcctcaaatatcaagagatgtgttgatgaaaatggttggaaggttagtggacttaaaagtcatgactaccttgttttattacaaaaacttttaccattggtggtatgccatattttgcctgaagatgttgtgatcccattgatcgagctcagcaggttttttaacaaactatgttcaaaggagcttgaggtgactgaaattgaaaaactttgcaattcgattggagagaccctttgtcggcttgagatgatattccctccatcattttttgatattatgatgcacttactagttcatattgcttcggaggctagaattagaggccctgtttgttatagatggatgtatcccgttgagaggtacctacgtacccttaaaggctatgtgaggaacaaagcgtgcccagaaggttcaatagcagaggtatatatctcggaggagtgccttactttctgtgctcggttctttgaagatgttagtacaaaggtgaataggccagaacgtcaagaaatgtaacaccctgaaaattcaaggcaataaaaatcactaaatgtaacatacccgaattctaggattaaggaatttccatcaaaactagttgaaaggaaagttcttcaattttgtgaacgaaaaatttccattttaaaccctaggtgaagttaatctaacttgtactgaagtaaaatctgagaacaaattaaaaccttttcatctttaacctataccatagatgcaaaaacaagtgaaagcatgcatactcgtttacatcatgttttgacttaagtccttcttatgcatttggattttcgttttgcatttcataataggtctcatgaataataactaagatctagataaacaactaaaccattagggcctagtgctagctagaggaagttaaaataggaaccatacaccttaaaatatatcaaaaaggcctatgtcaagccccacaaaactaaatttggtcatccatttgaagacaagtcataaacatggaagtgaacaaataaattaactcatatagggtatattctatcttaatcatctctataagcattctcttaatttaatactaaagtaaacttatacataaataggtaaggagcttacgacatgtgtaaggtaaactataattttaacatatcaacatcaccttatgttaagaagagtccaaatataacttttataaacatttacatgcatttaggcaaaggaaaacacatataagagataagtcttactaattatctataataattcgtgaaagataaaatcatgggaaaaattcatgtaggctctaattaacatatacaactcactgtaattttggttcaatttaataacaaaatttgatacctcaaataaatcagtcaaaccagttaaataatagactaattaaaattcctaatcggctaaaaccatactttgtttaaaaatgcatttaacttcatgggagtgtataggggaaacaatttattcaaatactaggtcatttattatgaataaatatattttttccagaatttatcttctctgtttaggtctcctaaaaattcaaacagtttccattgagcccttcttcttttaatttctgtgagcaatctatccataattcgtgagtgaaaccaaataaaatggaaactaggtacattcatctacttccagtaaaatccacatgaattgatctgtaccccaaaaataatatatgaattaacaaagatgggtaagagaaataatcctgaaaatttgtctaaaatcacttacacccaattatctacccatccctcacaccaccacctagcttacaccgacctggacccacctggcagcctccttggcttgcccttcctctgtgcaacttctctagccgaccaaaactgagaaagagaccgagccaacagccctcaggcgcgtttgacacgtggccacgacgtgtcgacgatctaaaaacgccgagctccatctccgcctctcccagacgcgtcgtcactcctcacccaccattccagtgccgatccaaccgagggagagcatccttgctgcccttctccaccgtttctctatcgccggtcgcgaagaagatgatggccacattcgttgatgagccacggtcatttcctcttcttttgcattccaaaacctactctcgatgccatctctatttcatctaatttcgtcccattctatgcagcggttgagcgggaacgccaccgtgcccacaaacgccctggagcgcacaacgacgaccgctgtcgggttctcgtcgtcgttctaaccaaaccgaaccaccccaagccgaacccttgcgccaccagaatcgcctagacgtcctcttcaagattctccaagaacctcatggatcggtgaatcgaggagggatatcggcgtcatcttctccatctccggccgccgacatcgatcttcgattccttgatcccgggtgagcttcagcgcaattcctgactcgtgtagcatctttagatggtctttgagccgttccactctttttcttggcagcccggagtccggatggtggttgtcaccgttggcatgccgatttccgccgccgtcgggacatcctctgcatcgtcgtcgctgtccaggcctacccgtaccgcgtccgagctttggtgagcaccctgcagcctatagaacatacatgcatgcatccctttgggtacatccagactatagcatgacatgcaccaccacccgaaaacatcctctgctcggactcgccgctggcgctactccaatgtccgctatctgataaatgtataggaatggaatcgaaataacatgatcttcattttgtattttggtcgcacccccaaacgagccatcgtttgtcgccggcgagctcgagatcgagctcagccatggcgctctgttctgtccaggtcgcagggacttcgctttgagaatttaaacaaatataagggttaatatgaaaacatactaaacactgacatatgggcctaggactgcgggttggtttctagaaatctcaagggccttcctgcatattggccgtatgactgacagcggacccctagtaacaaaatctgagattatgtaagaaaagtacctaaaacttgtaaaaaatccatagaaaatcaaatataactcattttgagatgattatgtaaactcatataaggatgaactttaatgttatgaaataaaaacttacacttgcagtacaaattacacctctaaaatttatttaagaaaaaaatatacataaagcatgcacaaacttataaaatgcatacaaaattcatctcaactcattttagggtaaattcacatttcaaggaatcataaatttgttgtccactgtaaagtgaaataaaataatatacttactttgtacctgatgcctctaaaactattatctttaaaatgaatagttttagataagctgaactttagaagttcatataaaattcatcttagatcctttttgagtaaacccaagttctgtagattcaccaaaacatatacttccaatttgtaaaataaaatcatatacttactgtgtaataaaagcctctaaatatttatgtaattaataaccaacatagagcaacatttaatttgtaaaatttgtagaaaattcatctttagtctaaatgaagtgaaccaaatttctataggaccagcaagtaatgtaattcaacctagtagagtgaaatatggcaccctctgttcataccatagctctaaaccttaatttggtagtataggtactaaacacataatagtggttaaacaatacatataaataagtatatatatgcatggtagctccaaataattccaaataaaacttgttaggaccagtggatccatagttccatccccatccacaaaaacttagaagaacttagctcatataataatttctagattgatataatatattgctagcatagactagagctcccctagtttataagaatatgaactatgataataaagaccataagcttatgaactaaggttagactagttaactaaaatactcattttgtacatcactagctagatgaggcaagttctggacctaaacctctaaagccatgaccctatgtaacactatacacctataacacgttataacttgtaaaatacataaagaattcatattaactctaaaaattgtgaaaccaaatgtgttagtcttagaaaacacatatcttcaccttaataaacttaataagaatcaccttacaacagcatttcataatagtacctaagtaaatcctacactataccgacgaaacttctaaaattcataactctcaaataaaatgagataaaatagaaattctttcacctaaattcattttagaccagtacctattcactgtgcacaaatcatgcattttagagcattttgtatttttcacatatttcggtgtttaattgcattaggtgtactttgtatagatgattgcttaaacggtgaagaagtgaattaggtgctgacattttccagttgcaaggcaagtcccaccttcctctctttgatcattttgaacctttattttggaggttattgcaaatgtttgcaaatcttgcatgtcgattgtacactaataaattaaaattttcttaaacttgttagaaaaactcctattatttgcattatcaccctaaccccacatatatccatatccatcattcctaaccataggaacaatatgactatgccactttgtatatgagtttagatgccactagattgctataatgcttagccatgcttacaatggtcttccttgtcattatgggctcattacaaacatgtcaattgattttgaaataatctggacagaactttaatacttgtgattttgataaataaaatgatggaaaacgtggattttaggtttgggctcaagtggtgcacatatggtgattagttgtgtaccgatagggggagagtgcacccaaaccgacttaaagacttcactcaatgtcagtccatttcgtatacagtacaaccacatgtgctagtatgggatagcccaagcttagtaaatcatttatggtttagccttacattctggtaggccagtgtgggtgggttcccgttgtgtccgccaccacggcgttaagtttaaggtgtgggcccgccacttaacggttctaggtcatataacgtgtaggcttaggatggagtaacacgtatcgtgctggtgtaaggctaaatcatgaattttgaaaaagctttgttgtgggtaataaatcgggtacttatgtttcgcgtgacacgctcttgcatgattattatttcgcatcatgtgggtaaagtgtacaaactctgcagagtaagaactaatcgattagccgtgctcacggtcataagcagcatgtggatatgtattgagtatagacttgtgtttattcttctaaatgttgaatttaccttcaaattatgttgagatttgagaatgatctccttgctgccatggatggcaatgaggtgcacatttatacattattaatgcctactttgatgcccatatgctaagtactagcttgctgaaatttatttgaaagaaaatttgatttgaatgtggtttatgcaaataaaacttgctttgtgctaaaaagaaccatatcatgccttccttgattatatgccttgcaagtagggtgttaggcttgtcttggtgcttgccagtacattatttctaataatgtactgattcttgccgttgaattaaccttttgcttgcaggttttagatttagtctgtgagtgatgcgcgtaatcgactgcttcgcctaggatttgaacataatggggtaaactcctagtcggtgtgcttgtggattgggtagacaagcttccgctgttctatatatttatttggccggtcggcctatgtatctctaagttagttgtaattttaatcgctttcatctttatttgtgtttgctatgtatgtccatgcttaagatgaaagtgtgaatctagtgcacatactgggaattagattcacatgagtataagttaagaatatttgagatgttgtagatctttagctatttttgtcaagtctcctgaatgtgtaacacatctggtcgccgccttcgagtggtttgacgggcacatctcaggttgaagttgactggcaggatattcctctcttgaggcgtcggatatttcattatgcttgttagatgatttgaattattcatttcatctctcaattataatggaaggtccgaagagcctacaacactaaaattttgaactttttaaaacttttgcatcatgctggatgttatggttgctattgcttgccaaatcgtaaatgatcataaagaaattaaagaaaagatctacatttaagcaatagataaaatttacgagaatatattatttatgtttaaccctataaatacacacgaaagcaagccaaataaagtacaagtcaaatattaatttctattttgaatcacaaatcaaatattaaatattcgaaccatcttgatagcttgatgtcatatttaacaaaaggaaatactaagattaaatataattcatttggatccaacctcacatgaaataatggtcaccaccataagagcatctccagcagggtcctcaaacaaagtccctaaataagttttgagagttgatgcaaaaaatataggtccagcaaagtccctactagagcccccaatctagggaggcccctagatcactcctccaagcccccagtccggggggctcaaccccacagcccccatcctctttttttttggcgggggaaatttctgagcgcgcgccattgtcatcctccctccctcccgcgtcatcgccatcctcccacaacctcccaacgagcaagccgccaggtcgttttgctccggccggcgaccacccgacatccctcgggaagaaacttcggcgagattccacagtgtgccgcctcaagccatcacaatcatcggttttactccgtcactcactgtcgccgacctccttgcatctttggccaacgcgcgtcgtcaccgatcgatcacgcctaggtgagtctcgacgtcctccccgaactagctgctcacccgctgtccacaaggcctagcgccgaccatcgacagctatctatcaccggccgcacacatgctgcagtaaaaaaattcagagatgatggtgattaaaacaaatcacaatagtaaagttcagtttcgtatgtctgagtctccttgtttgattttgatctttatgggcttcctaggcgtctaggcccatctaaatcattcgcacagcaaaacgtacattgtcatcattcatgttttatatgcaatgtcttgttctatgtcagagagctaatcttgctgagcatatataatatttaagaaataaatttgtgtttgcactgagtccttagtactgcggaaccaatatatatgctaaataaatacatattgcaaacagtataacctgatgtacattgcaatcatttgttgatgtttctgagatagattggaaaggttgtcaatttatatatttattgcagtgactagattgcaatgacaagtggaggtgattcctttgtgcgcatgatgtccgaggacactgatgtcgaagtgctaatgccaaatgaagaccttcgtacttcaacaaatggtgcaaaaggaagtgccaaaagatcaagcaactatactcgtaaggaggacattcaattgtgcatttcatggcagagcattagctcagatcctattattggcaatgagcaaccagggaaggcatattggcagaggatcgcagagcactaccatgctaaccgtgattttgagtctgataggaatgcaaactctcttgagcaccattggggtaacattcagaaggaagtaagcaagtttcaaggttgctacaatcaaattgagcgtcatcatccaagtggcataccacatcaagagcttgtaagttaaattgtttatttattattattaataacaatcttgtatgtatgtgaactaaaacttaaattatgttgcaggttcttgaagctgaggcattatactcgtccactgcaccaaagaatagggcatttcagtttaatcattgttggctcaagttgaggaattctccaaagtttcaaacactagaatcccacaagaggccacggtctaggaagtctttgaccccaattgagagagctggtgaagaagatgaaggagatgatgctagcaagagtacagctcctgatttatctcagccgagtgctaaaaagagaccaataggtaggaagcaagcaaaggagaagttgaagaatggaggagaagatggaccatacaaagaggcgatgaaagatttgcttgacgctaaagagaaagaagcgaaattgaaagaagagagatggaaggaaactaaggagattcaagagcgcaagctcttatttgctgagcgtaagttagtgtgggatcaagaacagaagattatgttttgtgatgtttccaccttggaaccggatgtgagaacgtatgtgttggctatgagggcacagattgcagcttcaaaggtggctgccctcaatggtggatttgatggtagtagtggctttggaggtgagtttggtggcggtaatggagaagtttgagcacttcgatggaataagttggattctattggatgatccacgtgtcctttactagtaggatatgccattatcacgattggtctttgaagtccttttttgttaattatttccacaataattttagtgtcacttgctagtaggacatatattactttcagatttgttatttataatcgaaccattcatggttgtaggatgtattatttttaaattatataatgcatcattgggttcacatagtttattttttatgagcaattttcattttcattggtgaattacgaatattggttgcatcttgttgtcgtatatggcactgtacccataccatatttacatgtttaaaaattttaattttgtattcgaattgtagtatttgaaattgtgaatttaagtatggttaaattatgtgagttagaaataattgtgttcgaatttttgtggtgttaaacatactgtatatggattgtattttaaaatacaagataaacatgagtagggactaagaaatagggggtactgctggagttggaggcattttttagtcattgagaaataggggcagcccttatttaacttttaggtgcttcaaaataaggtctattgctggagatgctctaatgaccctatctatatatttcactcgaatatttaacatatctttcttcacataaaattcacttatgtaaaatggttggtcacataaataactagagcaaatatatcactacctttatgatggatttaatggaatattttaaacctacatttagatattgagtctccaaaatatataagttctgatgaggacatcaacaccatcgatacatccatgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgtggggtggattcggactgcagggcagcgccaacttctgacggccgccacgacttcatgcgaactccgatttgggcgtgcaagtacttcatggaaagattatcaagtctactttcaaatggatccagccacatgtccatatctattctggagcggccgcaattgtcattttactcccgactattttttgtccatggtgctgcgtcacctcttttggcccaatgggctgtgtatccatgttgggcccattaggggcgcgtcctagggttggagcacgaccctattgtcgttcttcccctctttttatacctctagtcgccgccaagaataggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagagaatttacccttcccttcgtcattaatttttttttcctatagtccagaaaagaccaacaaaaaaaaatagtagattagtttttcgatgatcctatagaccattgtgccttttccctagtacttgttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccatcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctacaaaaaaagttacatccgattctccccgctttgtcgggttcggcaaatttaaaatcgccaaattcctcttgcaaaattctgtttttgtggcgagaagcttcgggacctattcgcatagaactttaaaaaaattctacaagcttcatactttgtccgtttgagataagattttctgtggttggttctagtgtgctcctggttgtgaaaaaaatatcaaaaaaaaagttgtgcctctctcctcagcactagagagagcaagcaaaaaaaaaaagaggatccagcgagcacaccacaccattccccctttgtcaccaccttctaccaccggttcttgttttcgttgttgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgacaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtccagaggataaagatgaggagggtgcatctcattccccacgcaccaaaggcatcatccaatactttacaaggcaagtgaagcagcacacagaaggacttgatacagatttgcaggtgacaaatgagaagattggacaataggagtccacgcagatctccaccaacactaagcttacagggttggagacagcggtcgcccgcattgacactagccttgctgctcttgtgaggcattttgatgctctcaatgctggaggcaatggtgggggtaatgacgatgacattgacggagagtacatcgaggataatttagaggatgaatatattgctgacactgaacaagatgatcgagatgctcaagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgttcctctcttgggagattgctgttgaccaaaaatttgcataccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaatagattgcaacaattgagacagggtgcgaaaagtgtagaggaatattatcaggagttacaaatgggcttgcttcgttgtaatttagaggaaactgaggacactgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctccatctagtgacaagtccgtgacaaaggccgctcagccagcaccgagtgcttcttcaatggtatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcctcaaagagcgttgttgccgcatgatcattgatggaggtagctgcaacaacttggctagcagcgagatggtggagaagcttgcacttagcaccaaaccgcacccacatccatactacatccaatggctgaacaacagtggtaaggtgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtcttctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattactgagttgattgcatcaccttcagttgcctatgctttggtatgcaaagatgctttgatttcacttcacgatatgcagcattctttgccccctgctgttgctaacattttgcaggagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagttgggtgatgaatggaaaacaacatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggaactttagataaggaattattctacttatgataaggaattgtatgctcttgtgcgaactttagaaacatggcagcattatttgtggcccaaggaatttgtcatacattctgatcatgagtctttgaagcatattcgtattcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctagaaacaatcaaagaccaatatgcgcatgatgctgattttaatgatgtgttgctgcattgtaaggatggaagaacatggaacaaaatcgtcatcaatgatgggtttgttttcagagctaacaagctatgcattctagctagctccgttcgcttgttgttgttgcaggaagcgcatggaggcagtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattctgtgttaggattgcctaggaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggagttgaattttgaacctggagatatggtttggttgcatttgcgaaaagaacgatttcctgatttgagaaagtctaaattgatgcctagagctgatggaccatttaaagtgttagcaaagattaatgagaatgcatataagattgatttgcctgcagatttcagggttagtcccacatttaacgttgcagatttgaagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtacacgtcaactaaattatcaggtgagttctttcttgagttcatattcctcgtctttatacctcggagacgcgtgcactcgtgttttactcaggaacgatggagaggatccaaagggaagaggattcgcgtggggtggattcggactgcagggcagcgccaacttctgacggccgccacgacttcatgcgaactccgatttgggcgtgcaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctattgtcgttcttcccctctttttatacctctagtcgccgccaagaataggcgggttttgatgatagagatagcttcttgctaccggctcgcagcgcgcgtgttggctaaaccgcccgtctgcctgtaatcggaaccccaccatattgtgtttgatagtgaaactttcatctttttctagcaatctcagtgcttgtcctacttgttcttgcttgttcttcgattgcttgcaggacgagtgcccttgtggccgggttgacgcgcaccacaagttcgcggcgaccattggagacggtgtatcggttgctaaggtgcagcgtctttggacagttgtagtcgggccgtgaacgtcgacttcatctaatcgagttatcccttacctctcatcgaaagatcgggccacaaaccctagcgggttcgcatcaagttcaccttgggaaaaatccaaattaatctaaaaacaattcaattgtgggtgaataaataaataaccaaataaagcatttgaatttacaaatccaaaatatgttgagctacatttcaattccaaatccaacaccattttgcagattagcccttccacttttcctttttcctttccttcttttctctctttcctcctgtcggcactattcattgcccaggacgtattcgttctgggcccaagcctcttccctgtgtcacgcatgccatccctgtcaccatcgcgcgccgttgcagcgccgcacgaacgtcgccctcgcgtcgccgctcctgccgcgtcgagccccgcgtctcacgccgtcgtgtcgccatcgccttcgctcagccgcgcgctgccacgtaaatcgcccatctatgacgttttcctcatgatgttgtatattttcgtcattgaatagaccatatctatgacaaaattttctatttcgtcatggatcagtcatggcgggataggtaccaaaactctatgacgaaattaaaaatggcgtcaaggtacaatagaaaatttcgtcacaaataatgcacacctttcatttattaatacctgttggtcccacagcgcatacgtggatatccaaatttcatttattaatacctgttggtcccaccgtgcatatgtggcactggtcccaccgcccgcccaaattatatgtgccactggtcctatatgtggctatcattttttttataaaaaaaaatacacctgggaatcgaacccagtccatgagcatttgcgtaagaagctctaccaccatgatactaagatctttgagtgaaagcttgtttttttgttaattgtcctttatgcggtgaacctggagaggacgcggcggccgtggcgccaccatgtggaacacacccactcggcggtgtcgtgtttcatcatctcccacgttgggctgttccccaccaggtggtttggatctgaatccccttgaatagttgatttacgattgtgccctcattatatgtgtgttgtagtgttgtaccgatatgaacgaggggtaagtcagtccaaaccacaagaaaattcacaagaatagcagcaggtttttacttttaatgcatgaataaaattttaaagtagtttatctcactcatatgagttcgaaattagacgattcctttttcattattcatataaaaatattgtctacaatttcgagcacgtttagaatgttgtcaagtaaacagtgaagactcataaattgaaattcaaaattttgaattgtagaacaactgtgtggtttttcttttaaatctctaggtaaaacttgtagaaagtctttctccctcatactgacttcaaatttgattattcttttttctacaaatttctaaattcatgatctatcaatttattgtgttattacaactatatttttgtttactgctagataaattaatccgagctggatgtgcatgtgcttgaaagatggacaaatttttgggtggtaacttttgcactgacttcctattagcaaatggtaagaatggtcacttgaaccatagtgtccaactgatctacttagtgatgttgctgccacattgttaaattttggaagtgggaaaatgctcttttgatgtgttttgggttcctgcctggcatttgcactccatattgtcgtggaactgttgttgtatgcctgtactttgtagaaatgaagcatgtttaaattgtgtccataactttacaccacactttacggtcctgcatacaaatctgtatatctaaatgctatatgcctatagtctgtagaaatgaagcatgcataggaagttacttgtatcataactttagtgtcgagaaatgtccaggggtcttccggctagctccacaaggtggtaggctagacgacctgggttcaaagcctcacccctcctaattatttgatattaggtccttccctaatattctagtttttttttatcataactttagtgtctaatttttagtgctacactcctatgcattctagttcagttgcttgtttgtttggccagtgaaatgaggtgggttggggatggtgacattgagttctgttagtgcaatatattatggggacatcggattagtgttgcaaattagccctttcattcaaaaactaatatcgtatctgtcgattgtttcttgttgtttctctagcgcataaaaaaataatctaacatatggtactatcctatcaggttgctgtgctcctccccatcaccctcgggcaggtcagaaaaataattgatcctgaattattattcagttgtatctgatttggagaataagaaatttgatgttgatataatctgaaacttggttttgtttgattgtcaggtgttgatataagctgtcttagtctcctttattatcttatgcactgtgatgaactccatctacttattttagttgtgttgatgcttctatgagcttactgtcgtgtggtggacttggttatgtaaaatgatgtttggtgctatggtggacttaaattatcatcctgtggtaaacttttgtggacttaaatgtgaagatatgtgtactaggttgtgtgaacttatttgtaatatggtgctatgtgaagttggtatctgtgttcaatgttgatgttgggcctattcataatgtcctgtgaagttctaattgttgctccaaattggccaatgctaaaaattttctagacctaatagtgggttggggccacaactagatgtaaaatgtgtggctaaatgggttgggccaagacaaatgatcagtgggccttcatcctaatgtgtttgacacgtgtcattgaaacagattaacacgtggctatatcaggtaaagacatgtgtcattaatcagatataaacacgtggcgcctcaaaatgagaacacgtggcgctgccaccttcagtcacgtggacatatgaaatgccaacacgtgggattaaatacgactgccacgtggctctagtatactggagatgctaatccaacatggagtacatgtcatctgccacgtcacatctgtcacaccccgaagttccttcccaagcctaaattggagttttaaatggtctcaagaaaatacctgtgtcaagcaagagcaaaccttaataaattaatgcaaataataatcggaattggcatgtggaatttttcttaagttttacatgccgaaatacgctaaaaagatttttagtggaattttcagagctctcgaaataattttaaccaattaaaattgagcacaagcaattttaatcccaggaaaaatcctttttccttctttttcctttttctttcttttcttttctttttttttcctttgaatgggccgccggcccattcctcctttttctccccctcctcccgctgggccggcccttcggccaggcccagctaagccgcgcgggccggccgcccagctcccctctctccccgggacaccgacaggtgggccccacctatcggggtcgtccccttcctccggccgcccgctccacgtcgccaccaccgccgaaactgccgccacgcccacctccgcctcctccgggccacgacgtccatgtcgccctcgcgcccgcgcctcccgcgcccactcccctctctctctcccgcccgcgcccgcgcccgagatgaccgggatccgattttcgaatcccgcctctctctcctcccctactccccgcgttggccggcggaattccgcccctaccggccacgtccgggattcccctcccctatttaagctccgtcgccaccccctctctctttttccccattttgccgaactctcccgagctcttgatcgctcccgcaccgtgcatccgcccgccgccgcctttcccaccactccggccgcctctagccgccgctagactcgccgccgcaccgcgccgtcgccgccgtcgggttcgcgtggccgagatccaccccgtccgcccttcctccgtcgagattcgtcaccggaacccgcatcccctcgcgctctggtgagctctacccctaccgccgccttcggccatggtttctgattgccgtagttcgtctccctccctctaacctctctcttttcctcccttagggcattccggacctcgtccgcccgccgccgttgtcctcccgtagctcgccgtcgccgttcgccgtcatcctcctccgcgccggccactctcggtgaggcactccccctcctctattcccctccctctccctcctagccgcgccgggtcaagccgctgccccggtcgtcgccgccgccccggtcgtcgccaccgccttcgcgccgccgcctccgccgccggttgccgtcgcctccgccgctggttgccatcgccggcaacgcgtgcgcgcgcgcgcgccgtcgccatcgccgtggccggtcggccggccttgagccgagctaagccaaggcctcgaacaatgggaagctagtgaggatcatagctctgaaggatgagatagcacgcttgaagaaggagaatgctcagttgaagggtctcccagcgccaggaggagtccggatccgcaccacgccccgcaagacggcgactgcacccgtgcgcattcagcttgcgcccaggaacccacctccgcccgcaattctcgcagctccagctccaaccccagctccagttccagtgccagctcccgcgtccgctctctccttcgctccagcgtcagctgccaggggtccagccagtggcaacggaggttggttgtctgctactcccagtggcagccgcgaccacagcagcagcagttccagtggctcagagccgggcagcagggagacgtatctgccagactccaggagccgctaagagggatctggtgacgagcaggaggatgccttcgactccaccgaccgcaggagccgttccgagcattaggcttgctttccattagtttatcgactgtttagcatttgcctgttagtttgagtgtttaggtctgttcgcttgggggtcagtcgacggtcgatatcatatgcctatgatatggctgtcctaataaggatttttgcttgctttttaagtgttttaattcagatcagaacaattgcagtttaaattcctatataataaagcttagttcctgagcatctgtttttcttcttttcccccgtctgctcttcctcaagatggtctacaccaggaatggtaaccgtgcaataggcgagggcagcaacggcgaagaacgcactaacggtgtgcatcccaaccgtgattccggcaatggtccgccaccactccccgagaatccgacccttgcccaagtaatggctcatcagacgcagatgatgacagctatgatgcagcagatgcagcagcagcaccagcagatgtaccagaggatgcagcagcaagccgagtagcagtagtttggtccccctccccctcagtccaaactgccggagtttctacgcgttagaccacccaccttctccagcaccaccaaccctatggaggtaaatgactggctccatgccatagagaagaagctcaatctcctgcagtgcaatgatctggagaaggtcgccttcgccacacaccagctccaaggtcccgcgtcagcttggtgggacaatcatatggctacccgcccaccaggcacggaagtcacttgggcggagttctgccgcagcttcaggaaggcgcaagtgccagatggggtcgtggcacaaaagaagagggaattccgggcactccaccagggcaacaggacagtgacggagtatctccatgagttcaatcgcctcgcgcgatatgcaccggaggatgtccgtactgacgccgagaagcaggagaaattcctagcaggtctggatgatgagctaaccaaccagttgatatctggagattacgccgactttgagaggttggttgacaaggcaatccgtcagaggatcagcgcaactaaatggaaaggaagaggaaggcagcgcagttccggtccaaccaagggagccaccagcgaccgcgcttcactcccggacagcaaggtggacctaccaccctaatcgtccgccagcaccgccctttcagtgccagcaacttccatcagggcgccagtggcagccagaaccaccatggcggtcagcccaaccgcagtgcagctccactcccaccaatggctccagcacagtcagctccgtccgcgcaagccaagaaggagactgggacaaagccagggtcttgcttcaactgtggcgagcttggccacttcgctgacaaatgcccaaagcctaggcgtgtcgggccaaggtttgtccaggcccgtgtcaaccacgcgtccgcagaggaggcgcaagcagcaccagaggtcgtactgggtacattccctgtcaactcagttcctgctacagtactttttgattctggtgcaacgcattctttcatttcaaagaaatttgtggggatgtatgggttaagaaaaaaagagcttagtacaccaatgaaggttcataccccaggaaatagttcaacctcggtcagttatagcccttcagtgctaatagaaattcaaagatcaccatttctagccaacctcatccttctcgaatccaaggatctagacgtcattcttgggatggattggctgaccaagtttaagggcgtcattgattgtgcgaatcacacagtcaccttgaccaatgagaagggagaaaccgtggtgtacaagtcaccagtctcaccgaagcaaggaatctccttaaatcagattaaggtggaaaaccctgtgaccaccggggagaagagttcgcggaaattggacgatatccccatagtctgcgagtacccagaagtgttccccaaagacctcactaccatgccacccaagagagaaattgaattccggattgatttggcaccaggaactgcccctatttacaagagaccgtacagaatgacggccaacgagctagcagaggtcaagaagcaagttgatgagtagctgcagaaagggtacattcgaccaagtacttcaccttggggtgctccggtcatttttgtggagaagaaggacaagacgaagagaatgtgtgtcgactatcgcgtactcaatgaggtcacaatcaagaacaaatatcctttaccgcggattgatgatttgtttgatcagctgaaaggagctaaagtgttttctaagatagacctgcgatcaggctaccactagttgagaattcgggaagaggatattccaaagacagccttcaccactcggtatgggttgtatgagtgcacggttatgtctttcggacttaccaacacacccgcattcttcatgaatctgatgaacaaagtgttcatggaatttctggacaagtttgttgtggtcttcatcgacgacatacttatctattcaaagtccgaagaagaacatgagcaacatctccgtctggtactcgagaagttgaaggagcacaggttatacgccaagttcagcaagtgtgacttctggttgtcggaagttaaatttctgggtcacgttattacagctcagggcgtggcagttgatccatcgaacgtggagtcagttaccaaatggaccccaccgaagaccgtgtcgcagattcagagttttcttggacttgcgggttattaccgccgattcatcgaaaacttctcaaggatcgcccgacccatgacttagttgcttaagaaagatgagagtttaaatggacagctgagtgcgacaagagttttgaggagctcaaaaagaaattagtatccgcaccagttttgattctgcccgaccagatgaaagacttccaagtctgttgcgacgcatcccgccacgggcttggatgtgttctaatgcaagagggcagagtggtcgcgtatgccttgcggcagttgcatccacacgaagggaattatccaactcatgacctggaattggcagcagtggttcatgctttaaagatctggagacactatctgattggcaaccactgcgaagtatatacggaccataagagtctgaaatacatcttcacccaaccggacctaaatctctgacaacgaagatggttggaactaatcaaagactatgacatgagcattcactaccacccgggtaaagccaatgtggtggcagatgcgctaagcaggaaaagctactgcaatgccctatgcatcgagggcatgtgcgaagaattgcagcaggagcttgaacatctcaatgtgggagtcgttgaacacggattcgtagccgctctagaagcacggcctacgctcgtcgatcaagttagagcagtgaatgatcttgaaatagcagagctgaaaaagaacatgagagtcggaaaggctcgggatttccttgaagatgaacacggcacaatctggttggcagaaagattgtgtgtacctgacgacaaagaactgaaggatctgatactcaccgaggctcatcagactcactactccattcatccaggcagcatcaaaatgtatcaagacctcaaagaaaagttttggtgggtcagcatgagaagggaaatagctgaattcatcgcactctgcgacgtttgccagtgagtgaaggcagagcaccaaagaccagcaggtttactccaacctcttcaaatcccggaatggaaatgggaggagattggaatggactttataacaggactgccccggacatcatcgggccacgattcaatctgggtagtcgtggatcgactcactaaggttgctcacttcataccagtacataccacgtatacgggcaaaaggttggcagagctctacctctcgagaatcatgtgtctacatggagtacccaaaaagatagtatctgatcgagggagccaattcacttcaaagttctagcagaaattgcaagaggaattgggaacccggttgaatttcagcacagcctaccatccgcagaccgatggtcagaccgagcgagtcaatcaaatattggaggacatgttaagggcctgcgcacttgattttggtggagcttgggacaaaagcttgccgtatgcggagttctcttacaacaacagttaccaggctagtcttcaaatggcaccgttcgaagcattatacggccggaagtgtcgcacccctctcttctgggatcagacaggcgagtgtttggaacagaggtgctaagggaagcagaagagaaagtcagaaccatcagggaaaggttgagaattgcccaatctcgacagaagaactacgcggacaaccgccgaagggagctcacttttgaaacaggggattacgtgtatcttcgtgttactccgctccggggagtgcaccgttttcaaaccaaaggcaagttggcaccacgtttcgtgggaccatacaaaatcttggaacgaaggggagaagttgcttatcagctagagcttccttccaacatgatcggcatccatgacgtgttccatgtatcccaattaaagaagtgcttgagggtacccgaggaacaagccaattcggagcacattgatattcaagaagatctgacgtatgtggagaggccacttcgaattcttaagaccagtgaaagaagaaccagaaacaaggtcactaggttctgcagggttcagtggagtcaccattcagaggaggaagcaacctgggaaagggaagatgagttgaaggccgcccatccgcacctcttcgccagctcctccgaatctcggggtcgagattccgtttaagagggggggtaggtttgtcacaccccgaagttccttcccaagcctaaattggagttttaaatggtctcaagaaaatacctgtgtcaagcaagagtaaaccttaataaattaatgcaaataataatcggaattggcatgtggaatttttcttgagttttacatgctgaaatacgctaacaagatttttagtggaattttcagagctctcgaaataattttaaccaattaaaattgagcacatgcaattttaatcccaggaaaaatcctttttccttctttttcctttttctttcttttcttttctttttttttcctttgaatgggccgccggcccattcctcctttttctccccctcctcccgctgggccagccgaaggtccaggcccagctaagccgcgcgggccggccgcctgcctcccctctctccccaggacgctgacaggtgggccccacctgtcggggtcgtccccttcctccggccgcccgctccacgtcgccaccaccgccgaaaccgccgccacgcccgcctccgcctcctccgggccacgtcgtccacgtcgccctcgcgcccgcgcctcccgcgcccactcgcctctctctcccgcccgcacccacgcccaagatgaccgggatccgattttcgaatcccgcctctctctccttccccactccccgcgttggccggcggcatcccgcccctatcggccacgtccaggattcccctcccctatttaagctccgccgccaccccctctctctttttccccatttcgccgaactctcccgagctcttgatcgctcccgcaccgtgcatccgcccgccgccgcctttcccaccactccggccgcctctagccgccgctagactcgccgccgcaccgcgccgtcgccgccgtcgggttcgcgtggccgagatccaccccgtccgcccttcctccgtcgagtcgtcaccggaacccgcatcccctcgcgctctggtgagctctacccctaccgccgccttcggccatggtttctgattgctgtagttcgtctccctccctctaacctctctcttttcctcccttagggcattccggacctcgtccgcccgccgccgttgtcctcccatagctcgccgtcgccgttcaccgtcatcctcctccgtgccggccactctcggtgaggcactcccgctcctctattcccctccctctccctcctagccgcgccgggtcgagccgccgccccggtcgtcgccgccgccttcacgtcgccttcgcgccgccgcctccgctgccggttgccatcgctggcaacgcgtgcgcgcgctcgcgccgtcgccatcgccgtggccggtcggccggccttgagccgagctgagccgggtcgccgccaaccgtccgatcggccccgaggtgatctgggccgtcggtcccatggaccggtggtggaccacccgcgtggtcccggtccacggtggaccggcagccttaggccgctgacccgggggccccacttgccggcgcccctctctccccttgagctgctgacatgcgggccccgcccgtcggcgccgccgcccccttgatgacgtcagccctgggaattaattgcgcaataaattatttaaggactttttgttatagtaataaacacagtgaatcttataaaattcataaataattcatccgtgctccatttaagcccattcaagtctcagtaaatcaagaaaaatgtgtagaatccattaaaaatggttttgttctctgtttcagtagtcttatagcctgtttgcattgtttgctttgtatgtcgcttagattccggttcttccgacgctccggtgtacttcgaaatagtcaccgaggtttctccagcagcagagcaaggcaagtcatgcttgtcacttgaacatgttgatcctatattgcaaatgctctattgtttttcttcaaatactgcattgttttataatgttactatgggatgtttacctattgttacagccatgctattttgataccatgctcctttgttagcttgggttataacatgaatagactttggactaggaattgcttagccatgcttagttcaactagcacacattggggaaaaatcctattaatgtttagactgtaggttctaatggtaatgttggattagtgacaccgcttcggtgttggttaattaaaatgaatcacatggcgggctgtgggtgcatggttttgttggtcgcacccatggcagttaaggaccggttcacgggatgccctgaaagaacttatcgtacttaccacaagccagcgtgggcaacggctgggcttgtagtgtagcttttctctagccgacgcatccaggcaagggtgggcgtgatggagtttggatgggccctgtgacggcctatgcggcttccgaattcacctaggcacaagaggggactgcccgctgccttgcgaggagtggggttgaaacctgaggtgtggtgtgcttggttagagggggttatgcgaatggtcctgtcacggcctctttccggtatgtcgtggtggcatgtcggcgcacggaaacatgtcgtggggctgtgtcttgtgggtacagttgtacacctctgatcagagtaaaactattcgaatagccgtgcccgcggttatgggcggtcaaccagattcaccgtgattagtctcaccctagtttaatctaatgaaattggatagtttaggtggatggttgggcccgttgcaacgtgggatagcgttggacagcggatgattaatattgattaattattacaactgtttaattcttacaacttctgtttataaatgctcgctttatgcaaatgaaccactctagctctcctttgataattccctgcatcatacccctattccggtatggcttgctgagtacagtgggtagtactcagtcttgctctattttccccaacccaagagtacgagtatgtgtcagacagtgatttctccgaggagtaggatgcctgtggagtggtgttcccgctgcagatcaagtcaaggctcagctccagttatctttcgtttttccgctgtatttatgtaagacttttatgatgtttgtaagacgtggatctgaatgtcaacattgtcatttgtgtaccccggccggtcctggacggggattttcatgcacattctgcttggaattctattcgggaatttctgggcgtgacaacatccaacgtggattccacgcataacatggagtacacgtcatctgccacgtcacatccaacgtggattccacatatggcagccacgtggcttggacgacgcatgtcactagccagctggaaagcaattctgtgacgagcaccttcgtcatggatagaagcatttctatgacgaaatctaccattttgtcatagagaaacttatgtgacgcgagttctatgactaatcctatttcgtcataagttcatcatagatgttattttacgacgattattgcatcttccatgacaaaagtagatcatcatagatgtaccgatctctactagtgcacgtcgtcgtgtcgccgccatcgctatcaccacctcgagcaccgcccgcgccgcgtaccgttgccgtcgcgcccgccgtcccatcgccgttgcccgtcgcgtcgccgccctgagacacgcaccgccaagccatgtgccactgctgcgccgtcgtccgtcgcgtcgcaccacaccaagccccgtgccacgtcccgtcgccgcgcgccgtcccatcactgtgccccgcgccgtgcaccgcgccatgccattgttggatagtataggagagatatactatgaaacgttggatgattgtattgagcctcagggggccggtatatataggagtacatgtggaggagataaggaaggattacagataaggaaggaatccacataaatcaatcctatcctaatacatctctaactaccatatactctaacatccccccgcagtccaagcgtgagcagcgcggacacttggactggagaagaaaccggcaagagtgcttaacatggatgatagccctttgtgccatagtcgatgtagtcgagatgaagttgtcgtagtcgtagtagccagtcgtcgccgatatcgatgcagcacaagtcacccaatagtgtgtggttgcggttcgtggcagggatcgcggcgtcaggcgcgagagtgcgcaggtgcaggcgagaagccaacaaacacgacgaccaaaaggataaattaaaaaaacactatggtgaccacggcgcgaagacgtgatgacggacagacgacgatgtcgaacaatgtcgttgtagcttgggacagcaaaacaacaacatccttgatctcggtgaaacgacggcgtgggcgacgcaaaccgatctctgatcggaaaaggaaaataacagcagcaagcagcaatatgccaccaaaaccaatctgaacctcgagctcatggcattgatggctttcctggcagcatggaggagctcacgtgcagcatgttgactcaacccatgcatgcatatgtgccactgcagacgtcgagcatgtatgctcgtagcgtgcatacacaggtgcagaacagccagagccacgagtagacggtaacgatgagactgctgttggtgctgcttgacgcgaacgacgaacgtcgccgcccaaggagattgagacatcctcccacacagcaacaaaacacgaggccgcgtcgagatcaagattgatccttcggtggcaaaccatgatgatgacatgacgccaggagatcgatctctccgaggagaacaatgacgacgactggaagaaaaaaaggtggccgcccccgggagcgagatcgcctcccgggggcgacggcagccgaagcgattagcatcactctgataccatgttggatagaataggagagatatactatataacgtgagatgattgtattgagcctcaagtgactggaatatataggagtacatgtggaggagataaggaaggattacagataagaaaggaatccatacaaatcaatccaatcctaatacatctctaactacaatatactctaacagcaatgtgcgcctatgccctaaccgcctctagcccagcatctagcccggttggccatgagctggtgagcttatcaatcttagcttccagcacaagcccctcactcgcctataaaagacctcccagccttcacgagctcgtcctcccctctctgccttttcttcacccttctacacatttcgtcgaacatcttgtgggcgtgctgcagcttcttcccggctccaccgccgccgcggaacttcgtcgttccgccgtccctcggtaagtcctcactcctgttactcctcctattcctctaggaactacctcccccaactatttcgtcgattagggccataatcgtgacaagcccgagctccgaagctccgcccaaggaggtcaccgtggacatgccatcccgggggctctcccttcgatttttctagaaaaacggaaccctcatgcgccataaatgctcacgccctcaccaatttggtcggaaaccctccgtatcgccctagcacctagctacccgtgcccggccatggcggccatgcggcgcctctcgcccccgcgccgtcctgtgccgtgactgccggcaggaggacaccggagtcttgccgctccctcccctggtcaccgtcgggtcgccctcggccggccttgctgcgcgcgccgcgtctcccctgctgctcccgctcggtctggaggtagaagacgatagagagaacgagaaaagagaagagaataggttgtgggccccacctgtcattagcaccatccaatttcctttagaaaataattcggtagaaaaaggaataaacccggggtcccacttgtcagtcggtacaaaggctaaagatatactgtatttcggattaaaaataaatgaattatgaacagtagcttttcacaatttctccgattaattcgaaattgaatctttaaactagtataacttgctcattttaactcggatttgagtgaaacttgaacctaaattcatctaaattcataagatttctaatggtatataattcactatttaataaaatacatttataattataaaataattaatatcaagtaattagataatggtcaacttaaatatgtgctcataaataggattgatattttacagtagagtagatgtaataatataggcctttaacatgttttgtcactatagcaaccccataaattagttataatcaatattttaaattaatggatgtataggaaaataatagtgctgtttattaatctatgtcactactcgaaaatcgatttttcatggcgtttggaaaatatttttcatggcggccatgtggaaaaaccgccagcacagaaaatcgtgggggtggggggtcaagggccgccagcggaaacacatcttcgctagcggtgtacttaagaaggccgccagcgaagataggatatcttctttggcggctttcttaagctcacgccagtgaaggtattgtatgttcgctggcggtaaggggatgcggcccaccaacgaagatgtaggtgtctttgctggtggccctcttaacttaacgtcagcgaagatatcttaacttaacgccaatcttcgctagcggtgtggtgacgtggaccgccagcgaagatacctacatcttcactagcggcgtcctcaaccctccgccacctcaaatcattttgaatggaggttcaaacaaaccgacatatgacgaccgccagggaaaacacgctgaactatatgaaccagctacattaacctcgagcaccattaggagcacgattttctctctcttaagaacacatacatagtggggaaggttttgatcttgaatcttttgaaagatttattgtaccagaggttagttatactttgtcctactctttttgtcaagttttttttcatttttattggttgtatgttgagatttttcatcacaaaaaatacttgacatggaggaacaaaaacattttttatttgttatttggagctcaaaatggcaaactttgcaagaaatattgtgcatgatccatgttccatatatatatatgtagttttcaataggtttatttttagcagatttatatattagttaactgcaaaagaatgagctagctaggaagagaagagaaagaagggtagtttggtaattcgtccgagggatgtatgttttatatatgtagatttttggctaggtttaattatcttgttcaaaatatttaaaataattaaagttgtattatttttttcgcaattaattaattaatgcatagatggcggacagggcatggatgtataaagagagatatcgtgcgtcatatattgaaggagtcgacatattcatgaaagcagctaagaagaatgctgcatctaagaagacaaaagatattagatgtccatgcgtacactgtaaaaatcagaaaagttggaaggatccatctgtaatcgaacaacacttggtaacgcatgaatttgttgcacgctacacaaactggtcacatcatggagagatcccaagcaagcaagttccgaaccaggctacagtacgcgacgaagtgttgagctgggacgaggatgtcattgtagtagctcaagaagaagaagaagtgcatgcagtagaacccgttgatgatgatgatgttgttggtggcaatggttagcacagtacagttgatgatgccgatgatggtaatgtcagcgtagatgtcacgcctagaaattcacaagtaatttccgaactaatttgtgcattaaaacactcgtgcaggaatcagccgaggtacacaaactgacaatttaatacacagattcatcaaaataactaaaacgataaatacttacataagagacacttagtcctcaccatgaagaaaactgcagcagaaaacaaaatctagcgaagcttcagctccactcccataggcagctcaactgggatctaagccaaaggtcttctccttctggatcctttctcttcaactgaggtttgatgattattgcaaggtgagtacatggaatactccgcaagccacacagcaagtatgcaagtgcacatggataccaaaggatggcataatatagggttcatttgcgaaagcagcatttagcaaagggttgagaatttgtaaaacagtagagtaattaatcatccatattaatcaacactgaacagcaccccaatgctgcacaggcccaaccaaacctgaacaaccaaccccggtcgtacagatcaaacctccaaacaaggagtcaaattaattatcacattgttgtcattaatgagtagtgcgggactaatcacgaaaaacattgttagacccgcccataaccgcaggctcagctattcgaatagttttactctggccagagatgtaccactgtacccataagacatagttccacgacatgtcaccatgcgcctcaataccaccacggtacctcggaaaggaactgtgacaataccccttgtacaacacaactcaccacagtgcaccattcctggatcataatcagcccctcaaaaaccagaggcattaactccccagcgactcccacggacttctcgccgcttcttagtctggcaccccataatgaaccatgctatacaaaaggtaaagccgttgcccatgctgacttgtggttggcacggttaatatttcacaacagtatctcgcgaaccggtccttaattgtcatgagcacgaccttcaaaaccatgtgctcaccacccaccattaatcagattttaattatcaattataattatcataacacgattcaccaccgtgagctaccattaaatataatggtaagtaatagtgaagcatgatttatcccattaatgagttaatgtttctaagcatgactaagtaattttgtatatagcatttagctgaaccaaaccaatatataaggtccaagctaatcaatttattacccataggaaattaaagtcatcttcggccataattaaatgggaaaggctgactacccaatgacaatcgaaaataatgcataagttgaaataaaacattagctttaaatgggttcaacatgctcaaagggttgtttgggatctgtgtgacttgccttgcaaacaagcgtcttcaattcgtctttaggaacttctccaacgaacgaacgatcctccgaaacaacggaaaactaaacctagaacgcaaaaccaggaaaaacactaataaaaaccaaataaacagtacaattaaaattcataaataggtagagcttgaatttagatgaattatgagacttgaacgaactcattttgagttcgtatgaattagctatgaattttacaagatttaatataatttagccttatatagaaaaggaattacgatttatttggaaacgaaaaacgcgctgacgtcagcgatgacatcatcaccggcaacggactggactgcaaggtcgcaggtgctatgaggctcggccgggctatccgagagcactaacgcgaagaggacgacgagacgaactcacccaagggcggcacgaccacggacgacgacgggagatggccggctacgagattgagatggcggcatggctctgtccacggtgatgatggcgtttcggtgaggggagacagcaaatgaggggcggacggtcttcacctcgctcctgcgatcccgtgggtggcgaaggcggcgatggacggtgatgagcggcactgctaaaaacgcggtgacggaagatgagcggcacagccttcacggtgacggagacttccggtgggatttggaggaaagcgacggcgtaggtcggggacgaccgaagaggcggcgcgacgtggctggagcagctgccggcaaaggagagagaagccgagcgtggcagcggctctagggctagggaaaaattcaggaaaaaaaggaggaaacggaagaggaggcccgaggcatgctatttatagccaaaggaggaggagatcggctcggatacgaggggaatcggcggcggaagggctagggttcgccagcaaaatagaagataaactccacttcgaatccacgcgatataccacgggatatactccgattcttgaggggaaagaaagaggaggataagggcaacaaatcccctcaatcaatttcggaaacgggacacaagatgcgacggatttggcggtggtagcggctgcacacacggctcggcagggagtctggaggttgggggcgacactgtagcagagggacacaatacagacttcttgccgggctttctttctcggcccgattggaagagggagacaaagcagacttcgccgcgagagacagccgctgctcgggctgaagaagagagagagagaaaggagaggagtgggccggattaggccggatttggcccggagctaggaagagaattttaattgattttataatttaaataattgctgaaatgatgtttcatttattaaaaataattccaatgctcaaataaatccaagaaaaatcctgaaaatacttgggcacacaaagtatttaataaaattttatctatatcaatttaactttcaaaattttcatagattttattcacacacttactttaattattaaataatctccaacaattcctttttcacaacgatttataatttagcgattttcagggtgtgacaaatccaccctcttacagaaatctcgtcccgagatttggaacggctagcaagaaatcggatagggcaatcctttactgaccactctgttgaactgactagccaatctgacatacctttatctaactctttttttcttccttcttccaatagaactaacacctaacataatcctcttgtagacattgtcaggtctgccttttgaaaacattatcccttcaacctttcgaatgttgatcacaagatctccaaacattgttgtattcgatcaaaggttccgctttagcttttccttggaatactttgaagtatatcaagtccatagaaattttgcctataactggagtcaaattgattcccatgattccactttagtccaatccaacctatcatggtaaaatgatttcctcttacattatggaaacaagtttcttatcctttaagtatattagtgaaatatctgagccttctcaatccgggcttaaaaatgctttaaattgatagctaatcctgaagtatcttctttgatctgacctttatgtttttgcagtaaaaataattattgtctgtatctcaaatattatagaattgtttcctataacggtgacccattaacctttctaattctagtttccaatgtagcttcttcaatagcttgactatcaactatctggacggactatcaagactttacttccaacattggtgtaaaccactttgcaaccgtattttatggcctctgcagttccaaaataccttgaattagagaactccacacttgatttgactgtcctagtgattattgttccatttcaattgactatttatttatcacctttctatgtatccttctccttattatcatctccatacttcagattgacatagtggtaatgtccattgtcctctttgtacttcagattaacatagtagtgatatccctgcttatctttttaccataggtgtacgtgtaactgatagaacgacccatctaccgtctcacagaagctttgtagtgattcgtcaaaacttcttgtacttagtgatgtgtcggaaagcaaaccattcttgtccttgtaccatattagtagagtataaactttcttaagtgcttccaagtagactctggtgtaggttccactacaactttatatatccttgattaatcatcacttcgtctttattctcattttcctgagttgccataaacatctgtttgacatgagtatacctctgaccatcgataaatattaaggttcatgtatcaactatattattccaatacaataccgtagaatccatagtctcactttcattgattacatacttattcaacacggtgatgattctatttaactgaatccataacctttagatagactggcattccttaaaacaactttgaatctcatatatctttgacaatctggaatacatgaataaactgattgcttggatccatatcttatcctctgtctaattattattgcacctgccggagccatattttttttactcatggaaaacgaaccatttaaatctcttgaactataatgttctttgcaatatagacattggttggcctttcattcatttgggtaatagtaacgtagttaattcgtccttttagttataatctgaccaagatgcaatagagaatattgttgtgactgacatcttgcatcaattattattatacttcaaacttgctccagtttccatgtaatttactgtagacatccagggtagaatcatatgtgcaaccatctactgtgaatatccatcttacttgattgactattaatgctagaacttcaactatcgacctttaaaaattgtctcacattgaatagactatcgtgaacacattttccatgtatctccctctagaactgttgattcttagctgcgattagcatagtttctacaaaaatgtgttgactcaaaacaattaactcataccaatccccaacatgaaaggggtgcattcctcttcattaacaatcttcttactcaaactaaaacatatacaaacttgaacctttcttgatgatacctttgctgatcacatttgacagtattatcttgttactattaatagaaataatgtcatgagcacccggcggcgaatgccctaatttatccctctctttcacggtaacaataataatcaaataattaaagttctgaatttttccagacagcagcaaatttaatgcacacgatagcaaatcaagcagagcaaccaaattaatccagcttaatagcaaaatataaaaggaccagtcttggcttacagtagcaaaaaccaatccctagatagtagtactccacccgtgttcttgagacacgatcagagtaagtggacttccaataaaatccagaaaacgtccccaggagatggatctcctgataagtagtaaaaaccaatccctagatagtagtactccacccgtgttcgtaagacaatcagagtaagtggacttccaataaaatccagaaaatgtccccaggagatggatctcctgatcacgtcactctccaaacatcagccggcagcagcgacacttcaatagatagcagatgggagcgccataagctttttccgagagaacaaacctcgacgaaaacaaaaaaaaaacctcctcccgtactgcttggtagagtttatatatagtatatacggcacgcaggccaactcaaatacggcgcataggcccatgacacaaactaacagaactctgtttggactcaaaacaggagaagtctaatcacttttgctaaatcagccgctaatgaccctgctaatgataattggctaattagcctaccggtacaggaactgaaccaatatatatatatatatattctttgaattgcttcttttcttcctgcacagcaacttgtatttcttccaccaaaaatacctggctcttggacacatcatcctccctcccttgaaacaaagccatccttggctttggattaatttgagtcagttctttctttttctttacaacaggaaataccagtgacttgatagaactatcatgcattggtttcagcacatgtttaacaccaagatgcataaaagaatagtgattacttctgccctcatgcgttgcattaagatcaaactgccatggtcttcccaaaagcatgtgacaagcattcatcggcaccacatcacaaccactttatcaacatagctcccgatagaaaatgcaactct

SEQ ID NO: 75468 - DNA, 7818 bp, Oryza sativa
acaaataaatcttaccatgtgcccttcccacatattgcagcgaagctatatatgtgcacatgattttgaatatgttgtttatgtaggaattatggtaaaaaggtatattatttggtcagccttcaccgagatggttgtttacatttgatttttccaatgttttaatacatatgtatatctagaacaatgatgttcatctatcattttgcatgtaaaaaaatcttgtaaaattcgcatttacacttgtgattttttttgggatttctttttgggaaacacaaattgttcgacataccatattatgacctgaaactataagcagcattggtggttcttttagcttattcagaagttaaaacaaactatatatttgtggatgtgttctagtgttctaacggatgatggattatatatgaactatgtttattacaataattcaagggcacaacaaaagaatagataatcattttccgttaaaaatatattatagtgagtgatgaacctatcatcgcttactcccaccaccacctgatatgtgggttctattgaatagtgagtcatgcaaacggttccttctcaaacctaaacatgttcaaatattgtttgtagcaacgcacgggtgtatttacctagttaacaccatgtgtcgaaactcgaaagagtttgcctatgtgacatatactttggatatatatatgccaaaaatctccacttaaatactatgtttccctattttttcactctcacttacaaactagtacatatacaatataatagtagcatgacatcactatagagtataaattgatggccggtgatcagtggcatgtgcatgttatattatttattcgattccactcgtttgagctccaaaatatgccaaaccgtcatcaaaaccatattaggggtaatataagtggtgttgtaaagtttttttttttggagagcagaccatgggagggggtgattggatgtccgatttaggactttttcctatttgaattatattaatgcactttgcattttgagaggtctacatcattacatgtcaagacaagactaccaagctcggagctatttatagaaattgtacaagtggttgtctacaaacaagctggccagcgatctccatggtgcaccacacgtccataggtaagctttcttgccctcgccacccataaatacgtgcccagctgcaacatcaatcaccaaccacattgatccatccctctatcaatcaagaaacaagcaagattattctagccaactagctagcttgcgaatggcttccttgtcctccttaatgctcgtcacggcagtggccgcattgttggtcattggctcatctggcactgaggtcaccttcaagatcggtgagtcctctaccacctctacactggaactcatcaccaatgtcgccatatctgaggtggagatcaaggagaagggtggcagcgactggagggggctcaaggagtcatcggctaacacctggaaaatcaaaagtgatgcaccgctcaagggccccttatccgtccgcttccttgtcaagaacggtggctatcgcatcgtcgacgatgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaatagttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaatcttcattggcatcccaacctttcttatcacttggcaaactatctgcattggcatcccatcatttctcatcactcggcaaaatatcttctcattatgcatcgttagtaaatattttactatcgagattaatatcattagtaattcttttactaacattttatcaatcgggcccctcttgtaccttctatctgtacagtaaatactttactattgatataatatttgcagtaattcgttcactaaaagtattaattattcttatacctcctactatccatattagtaatacaattattaaaatggcacctattaaaatctacatgacaaaaaggtggcgctgaatgtttttccaccgcctatatgggaaacaggggaaaatcacatctcaatgcctatgaataaaaagatttactcttgaatcacaccagtagaaattacactcaatcaactgcctccggtgacacactggcgaaggggcaacgtcgacatgcaaaaggaaagttacactcaatcagattgatgcctgcacgaatccggcaagcaggacataaggacattacaacaccaactagctagacctggtttagttctcaatttttttttcgaaaagtcacatcgaatctttggacacatgcatggagcataaaatatagacaaaaataaaaatcaatttaacagtttgcatggaaatcacgagatgaatcttttgagcctaattaatctatgattagccataagtgctacagtaacacacatgtgctaatgatggtttaattaggctcaaaagattcgtctcgcggtttccagacgagttatgaaattagtttttttttaattcgtattcgaaaacccctttcgacatccggtcaaatgtaacacctaaatttctcttttcgcaaactaaacaaggcctgtacacatagacgtcgaggtgatgcagcactgcagcttcctagagacccagatcctcctcgttgacagatatttgtcacccacagtcgcctccaacacgagcacctgcatgggctgaccctgctggctgtccatcttgctgcaaacaaaaagctataatgtaatacatccaaaatctgtaacttaacgaatcaagaatcagctcgtgaagtgcaacgacgggatgcggatttccgatatccaacgggaatacaatcaataagctgctgacgctagtggccacaagtaaaattaagaatatctagtctaaaaaaagtttattctgtcaaaacattcagataaaaaatcaacgggaccatatgtaatgagcagttcaggaaaaaaaaaacaatccatctgctttcttgaaccacaaaattcaagagaatcgccatcaagctccttgagttttcatgtattgaaaatttcagaaggaacaaaacaaaggagctcaagaaaaacatggctcagttgcaagcaaatgaacctctcaactagcggacccatcgtgctgcccgcagccccctgcccatgtgggatcgatatgccatcgacgaggctgacccatcgcaacagaactaaagcttgtatacccttcatcccaaaataagctcatttataggtttctgtatccaatcgagcttaaaaaagtagctcagttgcaaccccaacaaagcaaagcttcacatacacacatacgatgcgttaattacgtttctaaaattactcccgcatgacacaaccgtgattagatttgagaaagatagtgatgtgtgtatgtgttatattatttgttcaaatctgctcgtttaaactccaaaatatgcagatctgccattaaaaccacattaggagtaatataattggtattgcaaagcttttttgggggggagggagggggtggttggatgtctggttttattaatttttcctgtttggattagatatgaggattgcatgccctttacattttgagaggtctacatcactccatgacatgtgctaattttgcctgacagaaagacaagcgggactacctatcttagatctatttatagcaattttacaagtgtttgtcgaagaacaagccggccaacgatctccatttgcaccatacatccatagcttagctttcttgcctcgccacccataaatacatgcccacatatgcaacatcaatcaccaaaatcatcgatccaatggcctccttgtcatccttcctgctcgccacggcaatggccgcattgttggtcatcggctcgtacgccactgagctcaccttcaaagtcggtccaggctctagcaccactagcctgaacctcatcaccaatgtcgccatctctgaggtggaggtaaaggagaagggcaccggtgactggacggggctcaaggagtcatcggctaacacctggacgctcaaaaccggggcaaaactcaagggccccttctccgtccgcttccttgtcaagaatggcggctaccgcgtcgtcgacgatgtcatccctgaagccttcaaggtcggctccgtctataagagtggcatccagctcaagtaacgtacacttgtgctcttgcattggatcgcatggaaattgttgatctctaaataattcttttttaaaaaaagagagatcgagtctgcctgtgcgcaagccaataattattttttatggtccttcccgcatattgttgtgaagctatatatgtgcacatgattttgaatacgttgtttatgtaggacttatggtaaaaaggtatattatttggtcagccttcaccgagacggttgtttacatttgatttttccaatgttttaatacatatgtatatctagatcaatgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgctctaaactttttagtagtcaaacttctataaatgttatcaaatttataggaaaattgatcagcatctataacattaaattagttccaattaaactaacatttaatatttttttagtatgttcattttatattgacaatgttactatacttttatataaactgaaccaatttttttaaaaaaatgactagcaacaaacttaaaattaaattaaaattaaagtgacttaggatatgatgagacgaaagtaacagctctttttctctaacaacgaactggcgtacgtggaaggaacacggccacgatatcgtacagacaagagaagccgcttcgagaagacagccgctgtccatgccgacgcgactccacgcgcgccccgcgtctccctccgccgcagcagcctcgtcagctcgcgagatcaacgccggcccagtcagcccagccacatcaccgcccactccaccaccccaccccgcatggcccggatctaataaccaacggacgcggctcgcgggcccaccggcccacccacgcccgcccacgggatctctcgctgactcggacgacgacatcgccttcgccgctttcacagtgtgggccccgcatgtcggcgccacggggggccacgcccgcctgcgctggatccgagtcagcctcgcgtcgctgtcacactgacgcagccgcgtgttatcttaatcagccacaactttttaatgcctaacctttaaattaagccgcgacgagcactgcacggtggtcggaggaaggcgatgatgaagaagtgcccgtcggagctgcagctggaggcgttcatccgggaggaggccggcgccggcgaccgcaagcccggcgtgttatctcccggcgacggcgcgcgtaagtccggcctgttctctcccggcgacggcgagatgtccgtgttggatcagagtacactggacggaagcggcggcggccaccagctgtggtggccggagagcgtccgtacgccgccgcgcgccgccgccgcctttcggccacggccgacgagcggacgccggcgtccatctccggtaggtacacatgacataatttgagtttttttgagttacagagctattgtgcaaacagcccattttctatgcgtttatttggagttatgaaacacacccaaatttagtcaaattcatcacatgttgggttcattttggttgcagatgaccccaaaccaaccacctcagcgaaccacgcgcctgaaagcgactcggactccgattgcgattcgctgttagaagcagagaggagtccacgcctgcgtggcacgaaatccacagaaacaaagcgaataagaaggtacatagtgatcgatcaatcttgatttctagcaaatgcaacaaatttgaacagagaacgcattcttatgaactgcttgttcgaatttcaggatggtgtccaacagggagtccgctcgacgatccaggaggagaaagcaggcacagttatctgaactcgaatcacaggtattataaacttcaaagttcaaatttccagatgcgttgatgcaaatatcagtgtgatcttacagcaatccatctatgatcaggtcgagcaactcaaaggcgaaaactcatccctcttcaagcagctcacagagtccagccagcagttcaatacagcggtcacggacaacaggatcctcaaatcggatgtagaggccttaagagtcaaggtaattagaaaccaaactctccttcagccaccaattatcggcgcatttaacttttcgccacttttaagatgaggtaattaagaatttaccacccatagtctatgacaacatatgggtctttatcactttatgtgtctatgacatgtgagtccaattgcaaattgtcactcgtaagagtggtaaatagttaattgtttctgatgatcggcttccggcatctctccaaacttaccaattcttggcttcgatcccaggtcaagatggctgaagacatggtcgcgagggccgcgatgtcgtgtggcctgggccagctcgggctggcgccattgctcagctccaggaagatgtgc

SEQ ID NO: 75469 - DNA, 5756 bp, Oryza sativa
accatgatgaaaaaaaagccttcaagagatagctagctttaaaattaatgatattgatttaatcaatatacaatggatgagcaatctgctagctattttcatttaattactttgattcatttacaaaggtatacatatttaatttgtatccggttcttattttgaagggaaggaagcatgcataaattaagaataatggtaccatcaaaatatcaatctgcagcagtacgtcattcagatgcgcatgaagtgctagatttatgcagaagctagctagctaccaagagaagaaaattaaaacagtcgtcgcagttaggtgatgtggagccggccgggcggctatagcaatttgcaaaaatatacagtgcatctgttgacacagcaaaatctgttcctttcttgctagtggttccccgggaatctaaatatgatatggcaccttccatggccccacccttgtttaatatgtggacaaaccgaagcggctgcaggtatgcatgcatatatatgcaaatggtagcaatatcatgtatatgtgcaatatgcagattacgtacacatgcaacgacacttaaaaatactaattgaccgatatattaattattaccttcatctaaaaataattgtatttctaccattcaaattttgttccaaaaatatatccgtagtaaggtgaaatacatctaattagttagatggggatatcctgctcccctatatatatcattccatctttgtctgccttaacctatctttcattttatgcatgtggggtttattgtggtctttgtatgtcctattaatatgtctaaagatttctaaaaatataattattttaaaatggaggtagtagcatgcatgcatgaggtagtaatacacaaaattatcgtgcctttttttttcaaatatataattttcatacgaactcgaaccattaattaatctctatatctatatatacaaaattattaattttgtaaaactcatgcatgcagtgcaaattaaggagtcctgactcctgaatatgttgggagaaacacctgatctaacacacacacacttgctatttcatcacgacaatgccttgacaaacgccaaaaaatggcaaagaatatcttagagaaaaaaaggacagctaatgcaggtcaagttaattaagtttatacaaagcatgggttatgtcggatatgtgaaaactacgtacgttttctatgtaaaatatatatggcttgcctaaaacaaatgaaagtgatggtacatgtactgatgtacacaccttcgaaagcgacttttatttagggctgtcgtcgtgaaaactacgtcaattcgatgaagggacaataattgatctataaatcatctgagtccgatctgatatatttgtgtcactctcttgattttgcgcttgtccgataatttataccggtcaatatcttgtataagatcgatatcgagaaatacttggaatcgtatttaattagtgcatgtcatatcatacttacagagccccattaattcttcaaatttatttgatttttgaagcgcatagaaagggccctttacttctttgcaagaatgtaattaataaataaaattacaaataaaataaattaactcattatcatgagaatatctatgtatggtctatttcatctctggcaggtgctagatcgatcgaggagacatttttaaccaacaggaacaaggcagatacatgcataatatgttgatcccgcgccgtccacgcgagggcagctcgagggccaaccctatcagccaccgccgcactcctctcccctcccctccacctcgtcgccaccggagcatgccgtaggaaagtcgagcggtgagccgggatggcagcgggccatcccccggtggagctccgcctttgacacaggaaaggcggcgcgacagcgtgcgtggcgtagagaaggcaacgtgatagtgcaggcggggagagaggcggtggacctggtgccaccgtgttcagatctggagcacccatggcaaggggcagtggccggcgccgccacgaccggatctggagcccccacggtgtgtccttgccggatctgaaggttttcatgaggcgatagcctcgagcggccagcgcgcggtgacagtctcgagcagtaggcgtgggagatcgacgcgaccagcgacgacggagagaggatggcgtggatgatagcgggaggatggcacgggcaatgcgggagatcggcgtgaccggcaatggtagggaggtcggcggtggctagtggttggtgcgttcagcgacagcaacagtctaccatttgtgaggcgatggcatgagaagcagctggcggtggccagcggcaccgacgatggccgagctagcaaccggtgtgggaggcgtcgttggccgcatggaagacccgacgaaggctagtgcgggctggtccacggtgggacactggtgctgtggtgaagctttgggggggcgatgataggttttggtaagggtgctgcaggtgaaagtccagtggatgggtgacgatggcgcctctagtgtcatggccttcttggaggtgtcatctaggagatctcttgttcctcaacatcaccgtcttttctcggtttgatcgtcagagtttttttgttgtcgtcatcaagttggagcaagggatgagtgaatctccttctctctcaccctctccctcaagtcctcaactcaacccctctatgtgagtcgttgttcttttgtgtggagtcagtgtttagcacggcgtttgcaacccccttgtaggtctagcggcgttcggtctcgtttagtggcgatcggttcggtgctagcaccttctccgggttgtgctgttaacttgtggtggtgatgtgcttgtgtttttctctttcctgattataatctctagggttgtaatcttttttttattaatttctatgtcaatatgaaacattcgcaatgtctgatgggagttgtttcatgataaaatatataatagtcgatgtagtatatatatgcgtcgtcgctgatcaaaagttgattgggatgtgccaaataaaaaataattaaaggtaacactagtaaaatttacttcaatatataccattccaatcaattggaagatgccaacggcggtggagtaataaactggtgccactacgccagatcctcacacctttgacggcatacctgtgaaggcataagtgttggtcagtgataagagtcacctttgatgggttctacgggatgccgtcatcggtgagccatccggcaacggcccgtcacagatgttatgaaaccatctataatttgtcctcttttttttctgtcataggtggaaaccacccaacctgtcggtgatatgggcccgggggtaccatgtttagagagaggaagccgcccccaaactcgagtggcatcccctgagaagggtggcgcctgggtggagcggcggccaccccctcccagcttagggtcccaagtttggagggaagaggctgcccccagacccacgtggcacttccccgagcgggtggcgcccggggtggagtggcggctaccccctcctcgcttgggggtcgggcccgtcccgaccgagactagagggaggaggccgcccctggcgccacgtggccctcccccgaggggggatcgggcccgaggtagggcggtgcccgccccctcctgtgataggggtcgggctcccccctcccccgaccccctctgtaggtcgccacgtgcgatggattaggtggacgcctccaggcgcccacctacccgcattcatggtgacctgagcggttgcgccacaccacatttaatgcagcgtgcagtgcactcaactgatctgtgaccgatccgtgaccggttgaatgaccgatgggacgacgactgtgtgccttcgccttgtcagtgtgtcaggcgccgtgcggcgtgccccatcccgtcccatcataatgatgaggggcttcacagcctcttatctcggtcagagctggtctaaccactctgaactgacccgggtacctttttcctggagtgaacgggaacccggaagtccttaaccattaaacaacgaatgacaagggcgccccgcatgatctgatgggccccacgcagcagccgacgcgcagatagcttttgggctaaggcgcaagacatgtaattaatatagagaatattttcccttctccctaggtagcactcgtagcatatgtgggatccccttagagtataaaaggaggaccatgcctagtgagaggggggatcggactctggatcccaaactaaagcttctctaaccctagcttgtacttgggagatttagaggctttgcaagcatagaagaatcatcatacacacaggagtagggtattacgcttcatagtggcccgaacctgtataaatctcttgtgtctcttttgtctcgaggaaattcagatctcactcgctcccccggcggaactcacaaaagggggatctcacgatctcccgctagagaggatcactccttgacacaacccaatccttatctatcacccaccgacagtccgagaccactcatctctcgttttttctttcttccttatacatccctctctctctatcgttttttcttctttcttcctcctccacacgcaccgagcttgcacgcgccgagcaccgggtccaacggcggcctccgactccacgcgcaagtagcggccaccgccggttgcttcctcctccgccttccaatcgccggccagcgccgcctcccccgaccgccggccgccggatatggcctacggggcgcggatccggccaccgtgggctgcttcctcctccgcctcccgaccactggccggccctgcctcccccgccttccgaccaccggccactggatctagcctatagggtgcggatctggccaccgcggcctctgcccccacagcccgaccgcttcctcctctgcctcccgactgtcggccgccagatctggcctacagggcacggatccagccaccgcggcctctccccccaccgccagccacttccttctctgcgtcccgaccgctggctgccgccgcctcccccgcgtcacgaccatcggcctcgaaacgtctgggggacgcagatctggcgcctctcccccgaccgccagtcgcctcctccgccaccccaccgccacctgccagatccggcagcagcctcctccaccgcactggcaacagttggatccggcggcctctaccccaaccgccgacgtcgtccaccgtctccttcacccgctagcttcaccggttgtgcaaattttcattgccaaatttcagattgggttatactcatggttgcttgtgtggatttgtagtttattactcaaagttgtgtggatttgtgatgtatattacttgtgtgaatgtgcttcatgtgtcaacatatctgtgaataaaatgcaaagttattgtgtcatgagatcttgagatgttcttcatgtcattagatatggcctaagggctgagagctaagagctagctagaggctgagggcttttgaaattttttttcgttgattttccacacctgtgacgggtggtgagttgaacatgtcagaggtgtttgtcacctttgatgggctgaaaagatccactcgtcacaggtgtcaatcatcattaacgggcttttactcatttgagatgaggttgttgacgaaaaaaatcgaacacaccggcctaggagatctgcttagctcctgtgcaggtccaaatcttgatgagatgtgggcgtgc

SEQ ID NO: 75470 - DNA, 23767 bp, Oryza sativa
cgtcgcctacacaaccatgcacgaggtacatttcccttaatgcacgcttaagagatccaaaagatgaaataagacaaaaaataatgtgccctgatctattatcgcggtggctcattttcatttaaattacgttcaatagtccattttacggttgagaatatatagtggctcgtttaattatacagagtatataaggccatgcatgacggtttatttattacagagcggactatggtcacgggctcaatctgtttctgttgcatgtggtgagcaatttacatgtgcacgcccgcacagacagagttagttgtagcactattagttagttactaactactaagagcaagtataataggaggctgtaagccgacaaaatattgaggtggaggaaaaaagagaggagagagaggagaagcgaactgtaaacttatagccggcttagacataagaaccaataaactctacgagagaaacaagtgggccatatattaattgtaattagctaactgttatataggtgggctgagagaaaactgtaaagaactttatagcctggctgtattattaatcttgctctaagtaacggatacaataagagtaagtttaatagtatagccaactactaactccaaatcatgtatagccaatataatagccaattcataaaatagctggttactacattattaatatccggtcccatctgtcatacacatattatatcttggagtccgtggtgtagctggctacaaatctataacatgctgctcttctctctcttcttttatctcttaaaaatatgtttatagctggcttatagtctgctattgtatatgttgtaaagtggtgtaaaccggctgtagagaagaacaagctagtataggcctgtgtcataagggcaagttttatagaagaggtggatattgcatctaatcttgaccacatcatcaaccaataaatatagaggtaacatgtacaatatatcacatctatactaattctaatacactagccccaatggttgtttgcccaatctactcttcctctctcttctttgtcttgaattttgtgtagcagttgcctcttacatgagaggtggctctttatctctctcatctcttctctcctccacctcactatttaagcttacgtggcacctagaagattgtgcttggatgtccatagtacttgcactaattcccaggtcggcggggctagcttaattaattcacagatgcagtccagctgaggtagcaaagtatcccaccccgtgtaccgtacgcgttccaatcggtaaggttcctgttgccggcggggacgggaacacgatcgaacgcgcgcgcaccgtggccgtgcacacaacacatgcatctgaaaatgaaacgagacgaatgatccattgacatatctgagatatatatatattgatggcgccaccggctaatagctgcataggatcggaggaggctggagccagccgcgccatacactcatccattctcctttcccacggccacggcggtagattcatcgatcgatcggagcattgctttcgattcgctttcgcgaccaaagggagggaaaggaagttgcgttgggtcgctagcttagctgcaccttagctatctcctcctgatatttttgcacgccccctcccgttccttcctccctttcccgctctccgcgtacacctgggatccagcataacccatactccactactggactactacttgctgctagctgccgcttataatttgttgccctgtctcattgtccctccaaaatatcaagggccaaagaggctttagttcatttattttatttagaaactagtttaattaattaattaattaattcagtgatacatcattattcaagaaataagtcaatgtgttgtatgatcaaaagaattattcctggtattttgagcatgtgtaagaaatggtgttctcctaattatcaacgaaatgcatgtctgctagttcgtgcaagcagaactaaaattaaagacctaaattgaataaatatcgggatattaatgaaacacaatcagtgggttgtatttttggcagttcacctctcatgttcattcatttatcaacggtatccaaaatttgaaatagttaattttgagatatattcatcatagatacaaaagtttatttataaattattcctattgtactttctttattttttaagggcttattagccgtagaccaaaaacgagggattttcacaagaatacgcatagtaacatgccagtgtttagagttaatacggggaaagatgtataagtatgatttatgattgtgcttgaaattgcaagaagaaaactaggggctagtttggtttggttccaaattgtgccctaccaattcattggcaatttttaatagtgtttctggttgtttggattggtgccaaattttaacaacacatctcttagatagtaaaagttttggccatccaaatttggtagtactaaaagttacctaaactttggcactaccaagattttggtatggcactaaaccaaactggccctaggttagattttagttaagaggttgtatctaaggaagatggtatactatacactcattgtgtaactgttactccctccgttttaaaatgtttgacaccgttgcctttttagcacatgtttgatcgttcgtcttatttaaaaaaaaattgtgaaatttgtaaaactatatgtgtacatgaaagtatatttaataatgaatcaaatgatatgaaaagaataaataattgcttaattttttgaataagacgaatggtcaaacatgtactaaaaattcaacagtgtcaaacattttgaaacggtgggagtattcaacaatttacttgactttaattatttttttctcttattataaatatttaatgtttgctgtcgaataaaatttagttaaatatttataattttaattatattaatagtttttgaaatgcttagttaaaaattaagaagaagttatgtgtagattggtcttgaaaagtatagtcatactatcgtaaacttaattattagattttataaacttattttagtacaaaagttatggtcaaacttttaaaggtttactcggatcttgttctaaatgtaaaatatatagggcttgatgaattgagtatgtatatctcatccatattttatatttctaataataaaatataacactcctagtacttaatgtgtctaaattcgtactgcccaataatctgtctatttgaatatcatgtccataattgagatggaaagtgtaataacgagtgatgcataagcattaaaaaacgtttaccaaacagcattacaaactcagcccggccggcttcccccttatatacccagaccatacaaccaacaccaccatagtaaccagctgctgctgctgccgccctcttctttgtgttgccttgttgttggtgtcgcgcgcccgccatggccgccaccaagagcaaggcggccaagaagggcgctccgctcctcggcaagtacgagctcggccgcctcctcggccgcggcaccttcgccaaggtctaccacgcccgctccctcgcccccggcgccgaccccgtcgccgtcaaggtgctcgacaagcccgacctcgccgccgccggcgccggcatggccacccgcgtcctccgcgaggtcgccgccatgcgccgcctccgccaccccaacgtcctccgcctccacgaggtgctcgccacgcgctcaaggtgtacctcgtcatggagctcgcccccggcggcgacctcctctccaggctcgcctcgctgccgtcgcgccgcctccccgagcacgccgcgcagcgggtgttcctccagctggtgtccgcgctcatctactgccacgcgcggggcgtgtcccaccgcgacgtcaagccgcagaacgtgctcctcgacgcacacggcaacctcaaggtctccgacttcggcctcgccgcgctcccggactcgctccgcgacgacgggcgcctgcacaccgcgtgcggcaccccggcgttcgcggcgcccgaggtgctccgccgcaaggcatacgacggcgccaaggccgacgcgtggtcatgcggcgtcatcctttcgtcctcctcgccggccacctgccgttcgacgactccaacatcgccgacatgtgccggaaggcgcaccgccgcgagtacgcgctcccgcggtgggtgtcgcagccggcgcgccgcctcgtgtcgcgcctcctcgacccgaacccggccacccgcctcgccgtcgccgagctcgccacccacccgtggttcaagcgctcgctcagcctcgactcgcagctcggcagcctcctcggcggccagccggagcgggagctggcgttccaggcgccgccgccactgaacgcgttcgacatcatatccatgtcgccggggctcgacctgtccgggctgttcggcgagagcaagcgccgccgggagaagcggttcgtgacgacggcgtcgccggagcggacggtggagcggctcggccaggcgggcgccaagctcggctacttcatggtgggcaagaagggcgtcgaacgcctgcccctgggcggcctctcgggcctcgtcgccatgtccatggagatgtcggaggtgtcgccgtcgatgatgctcgtcgagctgaggctggagggaggcgacgacggcgacggcgacggcggtgccgaggagttcgggtgggaggagctcagggcggagctcggcgacgacgtggtgatggcatggcatggctgcgatggagggaagaaagacaaggaagggattcttttgtaggacatggactttgtcacatgtatgatgatgtatattagtaggattttgtggcattgttgtgtcaaagattatagattgttagttcaatctaattacgatgttttgtgactaaattgttggtaggaatggatctagatcatttgtgaaagcttgaagttagtgttaatacttcatatattggccttagtgatgaacacgagttgcccatgcatgaaccatggtactctcgattattaactcattctaattcaactaaatttaattttattgaaccatggtattcgattctcgacaattctagttttagttcaactaaattttacttttactgattggtcttatgtatttatttatttaataagttcacttagctcaacaagattgttgtcaatggtacgtacacacggatcgtcccatccctactggcctaaatcaaaatggtcatttaggtttttatacttttcaagtgttcagaaggtgataataattactatagaggttattccctcacatcgtttgcttgttgccttatcaatcgaggaggaaatttgatttttgaaagttaatcttagagttgattttgaggggttttttttctcattacaatttgtttttcagcattagcagaacttatacataaaagttctacctataaattatttgtggtaccagaagtacaaaggtaggctgtataaaacagcaatacgtaggacttaaaaggctatactgttagtaaaccacagttttcctgatagcctagcgcatgctgtttcctataagcacacaaaggtcattaactttaagtgaatgctgaacaaaacagtgtccaactcaaacagatctctccattctgcattctgcatgcactgtcattctttttccctgatagctactgaacctgaagaaaaatcatccaattgcaactgttaccacggaatcccacctagacacagttctctccaatattgagagtgactctgcgtgttccttatttaattggttattagagagctatttatagagctaataattccccatgcatatatatatatatatatatatatatatatatatatatatatatatatatatatatatatatatatatatatatgagtattactatatattaataccataatcaagtgtttaatttgcttctctaggcttgcaaagtgaacacaaggacttaaattaagttcctgtttcaccgatgttaatttctgccataatattttattttctgtattatattagctagtttccaatttttagttcttttgtgcctgtccattagtgggcactaaatcattgtccatggacagaatcattttcatccacccaacaactaaggtggtagtagtgtacgtacctatatctgtatatgcctatgctttcctgaaagaatatgccatctaattgattaagctaaagttagggaaagttacatggttgctgtttctaatgttccatgacaccaccaattaggttggtggacagatcgacgggccgacgagtaacatcttggtaaagtggaagtcgcgatcaataagagaagcaatcgattccgataagtgattgcctcctcttcaaagtggaagaaaatgcaaatgagaaacggaaatggagaagaaactgtgccaaccgattcagatggttcatagaatggttcatcgcaactctggattgatcaattggaaggaagatatgatgccagcaaatttggtctttaacagtgactggcagctgaccatattttcaatgtagcagcttctttcaatttcttatcaaaatgcttgatagaattgtcatcgaagcaccaagtcaaatgaacttgacaaaacttcagaaaacatatgaaagttttgcttataatcgttaaaatatcggcacatccaatggagtatctactctctactagtagctagctagatacacagggatagatggagactagggctaattaatggggtaaaaatccagggaagaaaaagctagtagtgatattgacatgcatgcatgaacacatcgatcagggaaattcaggaacagtccagcagcttggtgacaaaacaagcaagtaacttgtatgggcagtctatctcagctaaattatttgtctaaaccatgagctagctgttagctacaagcttcctatgctaacctcattaaactgacctgtaaagtgatgaaaatgagcaggtatttgactgaattttccggttaggccgtcagaagggaagaaaaaagaagcagcaggaaaaaacggaacaacatgcatgtgtgcaggaaaaagaaggcaaacatttgtgtttggtttcttatgatcggatgttttaaatttgaaccgacagatattgcaaaagagagcacacacataagattgttatttttgtatcggacttatattaatgtgctcctcactttcattttaactttttgaaagaaattatgtatccactactttcagtagtgcttaattatctcctaccacttttaatgagaggttacaataagttcaaacaatttaatgtaagtgttgaagaatggagactttaatcagttagatagaagagaaaagaaggaactctaatgatgatgataagctctgtagaaaggagataagcccataattaagcacgagggaatgatttgatgaggagaaatattattcctggtacatctttgtgtcatactagctacaggagccctgcccggataagtcaccgatacttatcaagttagtggtatcaccttctttggagtgtcaaagtccaacaacaccatgaatgaagaggaagaagaatatcgaacacccctattactccggaatctctttgtccatttgcttccggacgtgcaccttagtgaagattcgattcaaccctggtgagcagtgagtgatccataataatatgcaagaacaggggtggtcataatcacagatgaacatttgcagaggttttggtatcccaagtctgaaagcaagcacacattgaatgggatgacacctaatgcaaatgcagtactgtagactgtagaggatgtgtcgagcacaaaatatacattgctataagctaacagtatcagattactcgataaatcatgggtggacttgtcaacattacgtttagagttgcgctggttttttcagtacactttaactccttggaatggagaaattttacatgaactgtacaagattcgaactactaattcttacgtctcaaagaagcccttatttcctttcttttctagattggggaatcaatcacaaagcatttcgtccatgaagtaacaatacaagggaataatttgtactgctaacattagcaaagattctttctaacctcacaatctcgggaagctgagaaaagctgaaaatcctagcttctaatttttgcaagccagctttttcagattgtacaagaaactggtccgtttggattagatggagaagctaggaagtaatagagggagcttgtctcagctgcagcttttcccaaaagctgcttctgctagaagctacctcaaacaatccacagcttctaagaatctgtagttatagattctgaaaaatgaactaagaagccagaagctggagaaactgtgtttcagagcttttccagattctcagaagctggctaccaaacagctgcttctcagaatctaaagctcccccaaacaggaccatagaagccccccaaaattccaaagcacttcacaaatagcgcaaatactagctaggccacacctgtccaacaacaaggatttttttcttttttaatttttttaaatatttacagaaaaattatatcgacgaaaatatttaaaaaatagaccctaccgcctaagtggaggacggaaaggtgacgtggcacacggcgccgtgcccttgacgccctctgcacgggcagcaagtgggtgaaatgcaattttcgccgcatgcacctgctcagcggcctccagcgccggctcacacacgtcaccctgccgtcttggggagggctgcagggtctatttctgtaaatattaaaaaaaataaaaatgaaaaaaaaaatccaacaacaagagcccatttaggcctaaatctgtatgggccgggacccatatgcgtcgtcctcgcagctaacggcaacagcccatctggaccaaacggggcagcccgcgtcgcgtcgccgagcgtgagagacgacagtgacacgtggcataaaacgacgctaagcctatcccgtcgaaaatatccgcccgcggccgctgcttcgccgcaatccccttctccgcctccgcagctaagctaagctcgccgccaccgccatggggatggctccggtcgcgacctacccgtcctcctcctcctcctccaccctcgcgcggcctccgtgtgcggctgcggggagggcggcggcggcgggccgggcacgcgtcgcggcggccgggatgtcctcgagggcgtcctccttcgtcacgggaggggcgggggggctcgccgtggcggtggccgcgcggacgagggcggggtcgggggcggggtcgcgtgggggaggcgcgatggggtgcaagtgcctgttcgggctcggcgtcccggagctggtcgtcatcgcgggcgtcgccgcgctggtgttcggccccaagcagctgcccgagatcggccgcagcatcggcaagaccgtcaagagcttccagcaggtaagcaatcgctgatttaatgcttagagatatatgaatttaccaattaattgctcccctattgcttgacacgatgaggtctcaaggttactccgagcgaaatttctgttagcgctaatttgcaatgttagaaacgagaaccatggatacaattctgatgatttgaaacgattcttgtgattagagaacatcactactctgccatttgaatatgcccatacgcgaggtttagccgttcaggtcacttttcagtgcactacgtgttttcgtctataggaagaatatcacgctagctcaaagatttgtgagtacatttttgtatattttgaagctaatctgggatttgtaggtttgtttatgtgccactttttccttgtgtcagaagtttgtggattgtccaatgttgtgacagcacaaaaggtggcatttggctcagggaaatacatgggtttatgaatgaagaatatgaaattatgttatgtgctaccttttgtaggctttgagttggaaatgtgggttctacaagataagtttgtgtttcattgttacacaattgtttagagctacagtaacatattattgtgcatttgttttagctgtttcattgacacagttgtttagaaatagatgatcatggatttaatgattttgaaatacagtttattttggttgttgaaattgggcataccttgatttagcaaatttaggacctgctacagcatttaagatgattatagtactgaattgtttccttgttgaatccttgacaatacaatagaacagtcaatcaaaagcatagcaatcagtaggagcatgctttaacgctatttttatgttggtcctaatcaaattgcttgacatttgatcatttgggttctccattatctgatcagctacccctctgtctggatccctctgatgtaaaccacttgtgtctggtgaagtagcgaaagaacataactaattccgagtagcctacatgttcacttgaccagttctgtctacatgtttagatttctttttgcatttttgcaatgtcatcagaaatgcaatgtgaattatagatgaaacatgtaaggctgcattcagggagcatttggtgaactttaccacttgaacaattagaacatctctgatcatccttagatataaaaaatcactagtgttgagaggtatccacagttccagatttctactgttaggttgatataatttgttaagtacctgtctaagactaatagactattaagccgcattatcacttgccaatagctcaagctacttttcatgctccaagggcttccagtgttgtactctgttgtgcagtactttatcaagttacggtgtgatactacccttttgaaagcagattatgctatttccggtttgtaactggttcactgacccatttacacaaattcactcaggcagccaaggagttcgaaacggagctgaagaaagagtctgatgatggtggcgaccagcccccgcctccaaccgagacggcggttagcgacggtggcgaggagaaggagctcgaggcgtccagtagcaaggagagtacatgagggccagtggagaatggcgagttagaattgtgtatgtacaattgtatggatggtgtgttcctttgagtagcggcacatttctccctctctttttgatgacgatcttgcaggtgatgtagcgatgttatttgtacccgggaaaaagaagaactttatgtgaaaataccattattatttatgaggataattgtgtacatcagtttggtatgacctctatgcactaactcacattacagaaggatgagctattattgattaacataagttcaggtgggtttctttcttttgtgcaaatttaagtgccttcttggctaacctgtcgactataatcctcagctgattttgaattttagaatttgatttttattgactaatttatggggtttgttttgccacttttgtgcttatctcgttttccaagattgctctcaggacaaggaaaaatgtacatagagttattcctaaaaaccaaaccttaaaatttaaaaccttttaagctgaaacaaacagttccttagtttggaatgtactaagaagaaagggataagaaaaaaatgcgcagaaaaggggaaacaagagcataagctcggatttttttttactgttttttttattattgaaatgcaagcctcaacgaaatgacgaatttcggtaaattttgttcaaaatccaatacaagtcgagcagtttggaggagctctgaattcaggtgaacgaatttgtgaaagtgccatttacgtgggccccacattgtcagtcaccgcagcttggaaaataaactcacgtgctatatccgcttcactctcccaggccagtgggtgaaagagggagaaatccaaacgcccgaaaaatctagccatggttctcctcgccgccgccgccgtcgggccacacaaaaccctaaaccctaccctgagcccgccgagctccggcggccgccgcccccgcctccgcttcccgctgccccttccgcggggcggccacctccgctgctccgcggggtaccgcgaggcggcggcggcagcggcgtcgacgtcgtcgacgacgacgacgccgcggccgacggagatcccgtggagcagggagctctgcaactccgttcggctcatcgggacggtgggcaccgaggtggagctgcggcagctgcccagcggcggctccgtcgcgcgggggcgcctcgccatctggaagtcggccaccgagaccacatggtaatcgccccgtgatatgccgtagcgctcgcctcggttccatctatgcgtctcgttttttcagtttctctgtcgttggattggatgccggcaacgtgttgggccgtgtgcgccagtgtagcatgtggccaatgaactcggcattctggcgatatatgcagaagaggaagattttgtatctgttttgcccaactctccataattaaatggggtttgattttttgcattataaataggttgttgttatacaatgtgcaagagtctgtgtatggttgctagctgcacgtttggtgaaattttactaagaattaattgaactaaattgttatctacaatgacttgaataattgaaattgagttattgaaaagagcactctatttgagcagcagcaaaggtttaagatagatgtcccatttagcattggttttctgtctgtttggttagctgtctaaaggatataggagtaaataacgtcacaagattttgaaacacattggtcaacaaatgagttgtggcctcttgaaaataattagccaactaagcatgagttggaggtttggagctgtacctccttcgtgctatgtaagactagttctttagcagtcgtttcagagtcatacaccttaaatatttgtggttttattacaagtttcattattactataaattgtttccgagtgcttaatgattgtagtgatgctttagggtgactctagcattttgggatgacctagcggttgtggcttctgagcatgtgaagaagggtgaccgaatatttgtttctggacgccttgtgtcggacactgttgatgagggccctgagaaacgacaggtttattataaggtataatctctggtaatatttctttctttgagttattttgattcctttccatgcttttataagaagaatcatatgtttcacaggttgtggttcaacagttcaatttcattgagtcctttcagcaagtgcagttatatgagccagaggcaggcctggataccttaggtatggatgttatgtagcctgtaacatctttgatactatcatgtgtattataaaacggcgggtttcaaattcttgtgatggagtagtgaactagttgaagaataccagttccagaaggccatactatcacatatgtaaacaaataatatttcaattaatgttatctgttttccctaaaagtaaagaaatagcacagaacattgcaggccttagttcagtctttgaatactcttgaaaataatgaaaggtttgttgcattctgaatttctggcaatgcatagcataaaacttcctttcccaaatattttgtgcggaagtttcagaaaacccacatataagcattagttctcacacaaccctaatggagaataattgcattgtgggttgtctgtgtggtctaatgtgtgatacatggtcaattaatatggaattttctacaacttttttcattaaagatgggattgagtggagctcttgcttatactgggtttctgaaactcagaacaaaatgtatggtggaaaatacaagttaacttacttacttttctgtatgtaagttcttcaaatacaagttacttcacttatttggctgctatgtagctgtttaatactttagtgatttaagaaatatagaagagaagttaactcttttctgtataaccaaggtggaaagcatggagattatgttggttctacctctggctcgagtgagggtaaaagtagggaccatgttgactcatcctcccgttcaactgaacagttgtggcaagccttctttgctaatccttttgactggtgggataacaggacaaataaggtaactttcttcttattgttcatttagacattcaaatgcattatcttgtaatatatattacatgataaacggactaatggcttctgttcttgggtaaaccatctacctccttttaggagggtcatatcctactaagtactgctgcaaagatttgagagcacttctaatagtccaaaacttctcagataattaaaatactactatatgaagtattaatggttcatggagtttggctgaacattgtaaaacagaaacattgaaggtgtcaaatactcaaatgtaatcatgaaggataaaaaaaaaaggaagttgcaacatagtcagcatagcgatgtggctatattgttatttgagtcatgcaattgttttttggggttatttctagtgtcttgtaaaattgtagaaaccacccaatcctgaatttataaacaagttcagtataaatgaaatatttatctggttttccatcaagccagcatatatgctgtaggttacttgaaaaacctgcttgtcatatacatgggtttgcttcaaaccataaaactgaacatgctcttgttgcatcagaataagtttcaaagtattctttgttattccctccaaagaaagtatttttagttgtgtggcacaactagtgcagactaattaatagctagatgcctcagtgcaaccatgccaaccacttttggtcagggcactagtggaacaaagaaattctaaaataagtagatggataatctatagtgaattgtgaagtaaaaaatttttgtattaggagaaacaaaaggagtttgctgtgaattgtcaatccttagtttttcctttatttagtttgtcagaatttagctgtttgtgtttctcctaatttttttattgaatttaattttgatatctgtatggtggtctgacctcagtactattttaaactctttttaattttgctttccagattggctgaccaatttgaattcattcttacagtcaactattgttttgcattaaatatctgtccaggaattatactccctcttttgccttttcactctccatttatgatttatgaaatattgccatgggagtaatagggactactttgtttgatttattactggagaatctccaaatgaagctacttttcttgcatttgtctcgcgataacttgcaaaagggttaccatgctgtatcaggttgtgaaatcccatgccctctttcttccacaaagctttatcatggaagttggttgcagttcttatttgtgcatttatttgtttggtcaataattcaggttcaatacatgtctttttcaagatgttctggagatttgttttaataatgaatacgtactatttatggctacaatgtccctcttatgctacattttcactgattggtgtgcatgtatgaacagaagaacccgaggtatccagacttcaagcacaaacacaccggtgaagcattgtgggttgatgggaggaacaatccaaattgggttatctcccagttggcaattctggactcgagaatgggttctcttcaaggcaatgataggaaaccagttgcctttatgtatgctgatgacttcatgacacctgacaccgacactgaagcccatatgtgaaaggaaacctcccattcaccgatttatcatagcactatgtattagatagaaaatgtactactgcgatagtgcacctgcgctccttcaattttgttgtacataggtagaatcgtgaagtttaccatagaggcgtgcggccatctgttgtagtcagtagtaatgacaaatgcagatgtagtaaagaatcggatggccttcccttaaatttgcctgagaaacggtgtacatcacttggtgtgtttgcatcagctgagcctcaactgacaagtgacttaattacattggcatgctcattggcttagatggtgcaacaatgcaatcatcatcatatctgccatgagttgtgacctgtaaaaaactatgagctctcttttgtttcacattgcccgagtgctcttatgcttccctaagatgaaaccacatatccaggtacaacagatacacgatcctgcttgtttttatccgtatggcatatccatatcttgctgcgctgtcgtgtgtattgtatatctgactgctaaggcatacgctgaaccatcgagatatacatctctaccgcttttgatacccttctagttgaaacctgacatcaaatcagaaatctcacaggaggaaagaaaaaaaaaatctctggagagggacacaacatttttgtttaatgtccaccagcacatggagctgccgttccaagagctccagcaaccaaaccaccgcagcagcatcctggaaggcagagctgaagaaagaggttagcattgcatagtactaccttcaatttctttttccttgcatgcattgatttatattttcctgtaggaaaatgacttgtcatcaatttgttgtgtggattaaaagacttgatgaacaatcagttgactgactgattgagtgatttgataatgcatatcatatatattcatatatatggtgccaatggatggatgcttctgtatacagcttttgatctctccctcatatgcatgtgcaccacatgtatgctgtccgcccatagttcgaccattgcatgtgttaacaaacagaaatacagggggcttgagtgctctgcatgggctgtgcttagtttcttgaccggtcttgatgacccatctaattaagctatcaattatccccatttctttgccccctctgactttactggtctaggtcagaattggtattggatccagtgatcatcaggcatgactaaactttaactaatcttgtagcacatggtatatgtagtacttaagtagttttgttctttggaaacgtcgtagtaaagttaatcatttgcttagttaaggcttttttagttcaagtcaatttgttctaacaaactgagctcaaagattcagatgcaattgcaagaagttgattgcaaagttaatcgtccatgtgtgctacgtatacaaagtgaaacatatgtgtcttctcaattaacacaagtgaagcaaggaaacaaaaaggaaattaatttaagctgcatgtcttgagtcttacgaagcttagcttccggttgcaattttcttttcccgttttccctttgtatgatcagtttaattatttggactcataaacggtgaatcatatcaaccacaatatagtacacaaatcttaataacaaccgatatgtatagtacaaaagcattgaagcgatagtaaaatccacaattaggagacacaataatcaagggcaagggaacgagaaccagttcatctttcccggcctcttgttgaaatgatttgaagtagtatagtagtagtaaccaacaatcaatatataataactgtttcgtttgtacatacacatggagagttgaacccaaatctccacatctcctttgtgctgctaaaatcataaaattaaaacctactagtttttaaagatggaaacaaagcagaagcacatccatgtgtttgctttgatgcccccaagctcatctcctttttggcttgggaggaaaaaaaataaaaagaaatgaaaagttgatggaatgcatcgatcgatctcttgtcgctcttagattagatcttcatttgccttggtgatcctagccctgtggcttcagatctcttcatgatcctcaacttcttgcatgtgctggtgaacatgctgcaaaatcaaacagcaaatttaatcagtttgactgcaaatatatatataagcaaattactaattaattaagagatttgttgagatgaaaagtttgtgaagaacttactcgaaagggacgtcgccgacgagcatgaggtcgccgtccttgtcctggtaggtgatggcgaactccgacgggttggcaccgtcggcggcgccggagaagcagacgaacatggcctccagggcctcgcggagctccctgtagcccttgtacatcctcaggtcgatcttcctcaggtacggcgccccgtccatgctcaccttcaccagcgacccgccgttggccgccgccgccgaggaggctgccggcgccggcgccgcgttcttggtgatgggctcgtctttgttgttgcagctgctcacggcggccttgctcttgctcgccgccgctgactgttgctggaagcagctcttcctgtacgacctcaccggcggccacccgaccacttgagccctgcagggaggaggaggaggcagtcgccatgtcagaactcagaaccctagctagcttcatcgtaaaagtcaaagatgatctctggaaaagctagctactcacttggctaccggcggcgcggcctcgacggcgtcgtgctcgtcgtcgtcggcggcggcggcgttggcgttgttgtcctccgccgcggcggcgcgcttcttgcccctgggcgtggagggcaggtcgtcggctgtcccaggcaggcccagcctgagctcggtggccttgatgaggctgtcggcggcgtaccccacggcggcttccatttctcgcttcctctctagctagctagtcgtacgtacgtcggcttgccggagacgatcgatgtggttgtgagctcgagagccgatctatcgacgacgaagaaggaagacgatgcgttggctgtgatgagatgagggggtagggtttggaggagtgcaagttttatagctaggggggagagagagagagaacgccatggatggaggtcggggtgggcaggatgccgggtggggcggagacaggtggggcccgggcggcggcgacgcggatcccccggtcgccgggccacgccgcaccggggccgtcggatccggtggcagcccatgcgttttttcttagtgtggggcccacccaccacggcccaagccctatgctaggctgtagtaggatctcgcgttacgcgcttttccgggttcatattctattccccccgccgcgtggccacatgccaatgttaactggttatcggctatttacactgttttctttttctttttttaaaaaattaactttatccggcttgattataagggtgtggagtattttatttaaattattatgtcccatggaattggctttaataaattagtaatgtggaatttttgtgttcgatcaagcgaattagtcgaaataccacaccccgtcatagatagatccggtaacccggaaaattgttgatacagagacatagtgatcaggcatgtaggagaaagaaagaaaactagtgtgaaatgattagtaggatgagctatacatgaatgaatgatgattagggtaatgggggagcatctcttgcacattcggtgctgttccctttcggccctattgatcatatggaataatggagctacatatacatatagatagatagatatagtcatgagtggattgtgtgggcacgtatattgccggcccgttgcttgatttctggtgcaccctacctcttcttttcatttcattcttgagtgtattacacttgactcaatcgaacagtggatccatctatattttgttctgtgtctagggtttcaaacctatcggaaaaatagtgcaaaactcagtgccggcaaaattccgcaatacaatgtcgaattctttcagaaattttggacttgcagatattggcaaaatttagcaaggaggatattctctatggagggtatgtaagtggttcgcgggagggaattttgttctgaaacttcgagctcgagctattttgtgtcataaatatccatcactttaagcttttttttaatattgtaggtatccacatatatacataaggtgccacaaaaccacatgaaaaactactaattaagccaaaaaaaggttattaacaattttaattaacaaagcctccctatgatctacaaacaagatatttcaaaatgacaatggaggctttgctgaaatttttaataaactccatacatgcgggttttctatgtggtttataacactctggatatgtggtttataacactctgcaatcgatgcaggctagttcacttacaaacaaatataagtggtgcaatgggagaaaaagttgttgttatacaataatatctagttacatatatgtgataccgtcatgactctagaaggcgcctcacgatgaaaaaatcgaaaagaataaaaccaacaatgcaactttagacatatactccctccgtactcgtaaaggaagtcatttaggcaatgtttaatcaaatattgggaatataaattatgaataactctcaagttattgagtttgaaaatgtaaaagttatatgaataggtttgtcttgaaaaatacttttataaaagtatacatatatcacttttcaataaatatttttatagaaacaagaagttaaaattgtgttttggagaccgtgtcgctgtccaaaacgacttcctttacgagctgtacggagggagtatatataacataaaataaaatttgttgtacacataactatcattacttaattcctttcaaaaactatcattacttaagccctctcaatataatcccccgggccttgatctcctcctcaacaagttgtttcactttattcccctttccctctctccccactcactatgtgcatcgcattactaaatgagatacttctgtttggatgatcccttttgatcttgttcttgcttcttttggttgggaaagggtccaacaaaaactagtgggagttgtttgtttcaaaacctccacacaaagcattgatgcactgtgttacatcctaattaaaaaaagtgtgtattcacacatatgttagttaattgatgggaaccaaatggtcccccttgctacgtttttggctagctagctaattaactcagaagatatcatggaagttgcattgggacaagttggagcaagatatatcttttcaaagtcttgtttacctgacacattctagaaagctaaagtgcatgggatgctttcagactatattatgaaactcaaaaaaagaaaaagaaaggaaaccactttgccctgggtcaattctcctgcatattgccattaaacaacagttacagctaccaaacttgctagttacggaagatacttaaaaaaaatgtaatactacaaaagttacaaattcacgaatttagcgtagctcagctgcttagatttcttgtgatgaaacctgctcgtctagataagagttcaagttctaaatttgacatgagtacgctcatgtctgtagctattaattgttttagtggcaggtgatcgacgtgcctgttgatagcgagatgactgcggtgactttgtcaatattaaaatatgttggttaagtttctcggaggtgctcatacaagtaggattatgtgtacgtatttatagagtgtgtgcatccatgtacgtacatgagcatacgttagcgtttgtatactaaaaagagaaaaggtcctaaatccaataaaatggactaattaattagaaaaataaaattcataataaaattctagtggtgcttgcaaacagtgtccttccactatgtattttttacagtatttaagcaagtaccatgaagtactatgttacttatatatttctagtattaattaatttgtgaatgcatgagagttttcttttaaggcagcaaatcaaacactagcaatttgcatagtatgtgtacatcatcgaggagcatatgttgatgatcaacaataacaaatcaagcattgcagttgtagcatccagggatgtcaaagcagtgttttccattcgctttccaagacaatatcgattggctttcttagctagttcgtatactcaacaataatcaatttccccattggggttttgaaatgaaacttcttcattcactatatatatgcttaaaaatatgtatacattgtctgaatctcatatcaagaacatatacatatataaaagcctaacaacagttaattaaggtctaattgatgaagctaattatggagaagcaagacaccctatatatatggagctaataaccaatacatttatatatgagccatatatataggccttgacctagtatatacatgtatctaatctaacctcttctcttaattctttatatgctgagaacttgagatgttcctgccgatgtcgacacatagtaatatgctccatgatcaaaacaattaatttgctatttttgcatctgggtgtgtatgatatctttcctattgtcagcatcaatacagtccaatctagccaataagctactagtattttattggtggtaaacttcacccttgatctgataaacttgttcaacaaacgcgctagaatcaagcttgattccctgtcacaatgctatcgtccatacatgcatgattggttgcatcaatgcagagcttttttttttttgtcaatagctttgctatagcatttgactattgcgagataccttctgttcctgcaacctcctgcagacacaacctaaaataacaagccagtgcttgtgctgatcatgtacactcgagtttgtaaactatatatgtgtttttcaactgcttctctttttctttatggaatattgttgttgcctgatcaatgttcaagcttagcagtgagatgcattaatatgtgcatgtactaccgtccatgtcggcccacagaaaattaattcctcggattctagatatggtctgctatgcatatgagattattctgataagggcaccgactagctgtgcacggtgctttgtgctgatgcagtgcaatgcaattagacatgttgtgtttgatgtactaaatactacatgcatcttggttcccaaataaattagtgcatattatagcaagtttcaattcagttaatttgtatgctgtaacaagatcatgcatatgcatgatatgtgttgtagtgacctcctgctacatcacaagcatttgtatattataataaggatgttgtatcctctttgaaggccggctttgcatcaagatcatgctccatgctttgggtgtttggctgttgatactgatcttcataggaggtccgagccgcttgatcattacctagtgataagattagaaccaatggcttatgatggatctcggtatttgtgccgtcacaaccttttgtttttttttctcttcacatggtttttttttcctcgatgaaccatacagttgtaaaatttttggacccgattttctccataatcaaggttagttctttacttcttaattaaaagtgagaactcgctgccatttttagaggtactagttatatataggcccacgtgttgtaacgatttctttatttagtttagtgggaggatttagactaagtgggatttttttttacaatggttggttttttgataaatcagtttaaatttttttgggcggtttttatgggtggaaagagatttaggtggatgtggaggactccctcttttaagtagtagagatatatatctttgaaaaaactagtgcatttgcccataggaacttatatagttttgtttgtaatctagttcaaattaaataaaagtatgaattacccctaaactattgtggttgtctgaatctcccctaacaattgcggatttgtggtcgtccgaattaccccttgaactcaaataccatatatcttacatcctcaactattcaaag

SEQ ID NO: 75471 - DNA, 3938 bp, Oryza sativa
tgcgtgaaacgtacgtacaccgatcgatcgacaaactcatgcctttaattatcatcttgtcgatcagtcatcgggaaaaactagagctgattttttttttaaaacacagggcagagcatagaccgcttataagcatgcgtacactcacctctctctatatatatacacatgtacacgttaccctataagtttatttgaaaagtgatacatatcatgagattcacaaagttacaacatacgtcttcgctatcaacaagcatgtcgtctattattgaaaaataataattagttataaatacgagcatatacatgctaaatcatgaacttgaacccagatgaacaaattccaccatcagaaattaagctacgctcatttcgcaactgacacaaattaattaactacacaactaattgactcaatgaagctatttacttagctttcagccacagcttattttctttgttctttcaactatgcctcggtccaaaaccggttactaccggtccctcaaatatattagaagagatttgcttcggtctagtaaaaagtacttcaaattgccggtacctcacggtgctaaatcgttttcgaactttggaactaactaggtaggatgggcattggtagatccaacgatcggaaacgatttggcaccgtgatgtaccggcacttttagatactttttgttggaccggggcaaatctcatatcagaaacatttacatttcatccttgatgagggcaccacgtggtatcctagttatcaaattaaaattttgaaaaagaaatatatgaggtggaaataagaggaaaaaaggcgtgaagatgacacgtggattatactatatttttgttacttaattattattaattggtatagtagtatgtttgctatttgcccatgtacgtatactatatttgctattcagatcgaaaatcacctttacttgagtatatatagggatgaaatatgaagaaaaaattcgatatatagttgagaaaccaatagtaaacggatttactatggtaggaaaaccagaccaaggccatttttgagggaccaaaagtgaatgtaatcccaatttttaccagtgcttaattaattactattccgtcatgttaatttcatgaccctagctagctagattgggcctagtgacggatctactgttgggactgttggtgcgcaagccccacgtccatttcctatccctaattagccattaatgattctcattaagtttaattagtaattaatataaaattgggatcccgtgatgatagttgaagtgcttagtgcctaaaattgcaaaacactcagaatagactataccaatttatttgtagacttttaatacatatattaatgtagatacaaattaaagtggagaagataatatgtttattttataatgtgtatttggatttcatctgaaaatgctaagctgatattcctctgttcgtcaaccgtggaaacgtagggttgcgcccattcgctccacgccattttagaagaaataccaattaagccccggatcatgagatcaaagacaatgctatcccgctatggccgcctactcttccatatctctagtttgctttagcgccattttaatttacattctggattcgcggctgagagtgagagaggacctatttaagcatatactgctatattattcatcaccggccattccttaccatttcttctccctctgcatggtcagtgctcacaaacgaccaatcccccaaacgcagcaacaccaagcaaaagcaaaagctatagtccttcactagcttagctagccaagaatcgggagcttagctgaaacctgctgctgcattggagaagatcgaatatggctggcctcgggttcgacgagaccgagctccggctcggccttcccggcgccggcgagctggcagcgaggagctccggcaagaggggcttgccgagaccatcgacctcaagctcaagctgcagccggcggcgcctgctgccgtctctggggaagagggtgctcaggaggacaaggaagatgccgacgcggcggcggcggccgccgacgagaagatgtcgatgaagaggtcggcgagccagagcagcgtggtcaccgcggagcccgatcccgacaagccgcgcgcgcccaagtacgcactcgacctctcctctcctcgttaattaatctccatttttgttgttattttcatgaacttgtgtggtcttaattcttgtataaagacagtttaatccttgaagagtttatgtttgctctttgtttcatcttcttgaaggatattaaatccacatagtagataggactgataaatggaaagctagcgagtagcgattcaaaagtatattggcaagtgttttcaagaagagccattagttagccctgaaggaatgaagtaaataaatttctgcagttttgggaaaagactgtaatttgatatctaagttttttttttgaagaacaaatttgacatccaagttaaaacgaaatgaagtcggagaatttttcaagtggcagctaggcaggagctagtttttggtctctgtagttttgggaacagagacattaggatcccaagttggatactctggcaatgatggatacaatattcagtcaaaaaaagatgatggatacaataaacgaacaagaacaagctttccagtatgtagcagtagagtactatccccgttctgaaatattactacatagaatagtatttgactcatccaaaacaatgaatctggatagaagtaatccagattcattgttgtgagatatatgacgatagatcaaatctcatcctaactactccctccgtctcagaatatagcaatttagaatggaatgagatccattttaggataatgtatccgaacatcccatcctaagttgctatatcctaagtaatatttagggaaggagtaagttcacgatagcttccgtgcgtacacagaggagcagcagtagaaaaatggccatctgatctgaaaccaacaagccattggaacttggaaagccgtttttctaaagaaaaaacatttttcatttatgtagtgcacagtaactggcagagacatggcagtttgcttgtcgcactaatttacacaaagcttgcaaattaaaataaagcattgtacaaaatggagaaaaggtgtcagcttttctttttctatattttttttacgaggcgtagctacagatgcttcgtttatcattgaaagaaaaattagtcgtaataacatcctctggtgtgaaaggatagacgagtgttcaaagacagggagcttcacatccctcaactagcggcaaaaatcctgaatgaaatccatatttggatggcatgtggtgcaaagaatcttgcaagaatagcaccataacatcctctgctataattttttcttcttttttttctgctacccctgtcctcctgctcttcttcttaaatataaaactagctcggctggctcagtttttttaaaaaaataaaaatagtcgtaataagcatagtacttcaatccagattagatagatctcaccattaaaaacctaactagttgagcgacgatgatgtcaacttttcattgattaattaattaatcagaatgcatatatgtcgatcagggcgcaggtggtggggtggccgccggtccggtcgttcaggaagaacgtgctcgccgagaaatgcaaggcggcggcgctggtaaggtgagcatggacggcgcgccgtacctgaggaagatcgacgtcgccatgtacaagagctacccggagttgtccatggcgttccagaacatgttcacctccttcaccatcggtatatatatatatacactagctatatatatatattcaactatatatgcatgatcacacgatataataagtttctctttgtcactgtaatagaactaataaaatcaa

SEQ ID NO: 75472 - DNA, 19812 bp, Oryza sativa
cgggtgggccccacccgtcagcgagggtggcgggcgggcccgcccgtcaacggcgcgcgcgcggggagggaggccgaatgggccgcgggggagaggagagagagagagtgggggagagggagatgggccgagccggcccaaaggagggaagggggacttttagggtttttcttttttataaaacctttttaactttgtttatttcttcttaattatttttttttgtgctctgaaaattccactaaaatttatttacacattttaggcttttaggaaatatacaaaaatcctctaagccttgtttgacttttactttgcacattttaatttttggaggctttcacacggattttaattattctaggcataatttaaaggatatattttagggtcgttttgggacgtgacataacccctatgtattgcaacgaaaatcacgtcgttgcccaaaatttcgtggcattagcccgaaaaccttgtagtgaagcaacaagaggaccggcgcagcatgactggtctgaccggggaccatgatcggtctgaccggcctagtgtggccggtctgacccgatctcagcaaagagctggggggcatgagatgtttgatttagaggccgatatgactgtaaattcagacatttgtgcccaggagttggaaaaggattggataatccgtttaatagaatattcgaaagatcctagtcttagggttgatcgggaaattcagcggcaagcatttaaatatactttgcttgatggggagttatatcaccgaaatatagatggggtattactgaaatgcttagataatgatcggtccaagtttcccataagatgaattggttgcttaagagagtggggttttattggccgaaaatgattaatgattattttaggcattatacgggatgtgaagcttgtcaacagttcgttaatgttcaattggtgcccgccgcagtgttcaatcctattattaaaccatcgccgttccgaagttgggctttagatttcataggtcaaatttatccttcgtcatccaaaatgcatcagttcgtgccagttgtaatggattatttcaccaaatgggccaaactcatgctgctatgacttacacggaggtaattgactttattttaaaagcatattgctcataaatttggcattcctcaaacttttatgtctaaggaggtaagaagtttttccaaattttatggtattaaattgttaagttcatctctttactacgctcaggctaatggacaagccgagttgagtaataagatgtcgttgaaattagtcaagaaaaagatcgaagaacatccaaagaggtggcatgaggtgctttcggaagcattatgggatgataggatatctgaacatggtgctactaaagttactccttaattttgagtaggcttatggacaagaagccgttttaccgatagaggtgaatcatggctctcttagatacataaagcaagatgacttattggttgaagaatagaaaacatttatgggagacaatctttatgatgtgaccgataagtgtttgaaggctttggaagtgatagagaaggagaaaaggagagtagctaaatcctacaataaaagagtgaaagaaaaatctttcaagcaggagacttggtatggaagacgattttgcctttgggttctcgatttatggagttccgtaagtggtcacatagttgggaatgtccttattggatatgtggaatcgtttcagggaatgcatattttattttcttgagacgttacaagcagaacgatttcaaagagcaattaatgggaaatacttgaagaaatacttcccgagtgtttggcaagttcccaagtctttaggttcacgatgttcaccaaaaaggcagggggcatgtgtttacatccaaattttgcacctagtgtcgatttccttcacggagccggtctgaccgttatatgttggtcggtcataacgttgcttgtggaccggccggtcaaaccggcagaattcgatcctgagtatgtgtttcagaaaagtttcagaaagtatgtgtttttgtttttgtctttgttatatttttataattttggtacatattaatcagtttatcgcatatttaggtcatatcctaaccactggaaatcgttcttaatgccgctatttactttccataaaaatatatcaattctaccgtctatgtttttgttagaaacagtcttatagcaaataatacttataagatgcaattagtttagtcaaaatgaggatagatggggagttttgtcaggaattaatatattttgatgttagcatatagcactccaattgtagctctccatcagcctctttgttagttaatgtcccaaaactaacaagaatagttgtaactgttttatttatcaaaatccaggtttcaagctagcaatatcgttggatgatatctttttctcaaggtaattttgatctatgttgtactattacaatctcataaactcctgaaccaactgtagtggatgtttttttttttggcgtgtatgtgtgatgttaagaaggatggatgtgtcaattttagcacaactgactttacctacaattttgtatttcttacagcacaaatgttttgttattctcaaacggtttgctttttgaagcattggtcaaaaaagacatcactgagtgatcttaagtggcggagtagatagcaccagtatagtttctgatccccttgctctaccaaagtaggggaaacatggaagaacactctagctcttaatatgtatctgctctgaaatgctaattattatagttgcttctccgatatatatatatatatatatatatatatatatgtgtgtgtgcgcgcgcgcgcgcgcgcgcgcgtgtgtattgggtttgcgtactaatctgaaatgctgatgagtgttaagtaaataattgtggcttgatccttgaatgctgcaaatgcttggtagtacacacatatggccttctcttttcttcactttgttttctttatttctttccttatgtggcactgagcaacttcaattcaagtctgtcatgtggcactgagcaacctcaattcaagtctgggtgggttacgcagggacatgtagcaaacttgatattacgtgtcatggcttgtttgatttgtgacacatacatgttgtcttacgaatgcatgaatgagtgtgtctcttcttttaggacaggtttcacatgcattttcaagctcgtttgtttcatggccctttttaacggacaaaatacaaatggactggtgatacaattcgacatagaggaagcacgtgatgcgagtgaggcgcgcgcaccgcgtgcacgaggggaggcggctgatcctgacatgtgtacaatcctacagttacaaatcctgctgtaaacgcaataaaaaaaatcagccggctgtcacattgacagtcccaattctaaaataaacaaatcttatactatacgtgacatattataaaacaaagggagtaaacttgcattccatactggtttgtttatctctactattataaaaactagaaaaaaaataccagtgcgttacaacaggtgaaggctattttaatcttattattattatacgtttcagttaaggtgaaatctaatgtggtaaacgatgtacccatcgacaacaaggcgcctatggtgacttcgtcaatctcaaagatttgctagcccagtcttcgaatatgctcatatatatagatatatatatgtatatgtatgtatgtatacatatacatacatacatatatgtgtatatatatatatatatatatatatatatatatatatatatatatatatatatattctgagctgcaattaagagtctaatcgtctcaagttagtatgtgaatttttttaaagagatttcttatacaattctgtctgtatttccaaaagcgaacgaacttaaagaccgactgaaatacggatatgtatttcaaaaaacgaacaaacttaaaaaccgactcatgtacagatgacataccaaagtaccgacaaaaatatcctcaattttataaatagtagagaattgaagatgtttttgccggtattttgatatgtcatccatgtttgagtcggttttatgttcgctcgcttttgaaaatacagatccgtgtataagtcggatattaagttcgtttgcttttagaaaaacaaaatgagtcgtagaagaaatctcttaaagaaaactcacatagtaactttgagataaaagtcgaactcctaatttgcagctcatgattttctaagaaaaatgtatccaagcgaatttacgcagctaattttatcctagctaaatcgtataacaaattataataaccttaacccgttgtaacgtacatacatctttttctagtttggagacaaaaggagtaattcttttactctcacgaagtaagagcagatgcaatcccgtgtatgcacctgaaaagcggaaaatacggtagaggagggtgacgtgtaaaacgaaaaatacgaatatgggcatgtacaaaattagagtctaatatgagctctctatattaattactttctatattaattaatgtcactatagactatcctcctaccatagtagagaaataagatttctaaactattaatacactagataattttttattatagttctttccttttcccgtcctcatgcaacttttccttttcctgtcctcatgcaactttttattatagttttttccttttccccatcctcatacaacaaatttttagataatatagttctttccttttccccatcctcatgcaacaaatttttagataattttttactgtacttcttttcttttctccgtcctcatgcaacaaattttctggtaataaatttcttttctccatcctcatgtaatctggtaataaactatttttctaagagaccgttattagccaccattgtacatgtctaaggggagcgctggaaaacacgtttattaacactacgtaaaatttaaaaccatgactcaaatatatgtttagagaaaatatcgctgtccaaaacataaaaccgtaggaagcatcatttgattgagtcgtgatggctcttgttaagaacgggagataagcactaaatcgcatccatatctaaattcataaataaagtggatttccctctaaacggccgtcaaatgccaccgggagtgcaaaaccacgttacatgtggcgatccgaatgcaaattttgtcgttcatttcgagcaaaatagtgaaaaaaaaatgggcttcctagagtccctactggccggaaaggtccggtcacagtaatgaaatcataagaatttaaaatatcttaagtaccaacagttgagaaataacatatggaacattcttgtaagttgtaacaaccaataatttagcaaatcctggaataacttcttgcatgggattttaacattcagtagactattaggatcagcatgtgatcataaaatggtcggcccagtaacaagggagcaaaagatacataactttagctggaaacttgggatataaggaaatattcaaacaatacattcgcacagcctccagtagcaccatttattcctcctcctcggcctcctccagccatttaacaaaaggttccagtgctttgacgaaagattgcctgacattaaaatgcaaatattatagcagtttcaaacataactgaaactctacaacatctacatgaaacaaatattatccactagtgattgcaatctaaagttcgcattggtagttagtttctacttaacatgaagattgaagttagggcacggaaaacaagaaaaacaagaaagccattagcgtatgactaatcaagttataattattattataaacttgaaaaatggatttttctgatattttaaagcaacttttatatagaaagtttccacataaaatgcgttgtttaacagcttgaaatcgtattaacaaaaacctaggtaaaatcagtatcttgtacaaaagtggacctacgtaaggcaattacctgccctttgggtttgaacccttgcggaaccaaaggaggatggtatcttcagctaggacatcttggtcatacagcgttctgattatttcaggaaatagcttcatcagcttagcatcctcatagcactgtgtctgaactttgtatatgagttcgagttcaagcctgccacttgtgcagaatgcattcaaaaggccagcccatgctttcacctgtaaagggaatatttttagatataataaatgatacccatcataacaaagagaacctagaaagatcaaaatggtctttagaggttaatcctaatctccacaagcataactaatagaaggtgcttcttcctatttgggatctagacaacgcagcatctagagttttccctttcagcaaactgcaaaattaataatacacttattcatggatatcttcaagtaatttgtccaaaatagacccattccaaagtagagttaaagctcttaaattggatacctaatagacgatccatcattgggaaatgtgacacttccacaactttagtgaacatacataatgaaagcagccctcatttaccaatttatttgaatgcatcccaaactattagagttcacacattcaaatactcacacatcacctaagcagttaaaaggtaatcttcccatcaagaggatatactgtccagtgtagtaatagttggaattcgtacaaccaagggaccaccaagtggttaattgacatgcaaataattgatcaggattatactgataatctggtagtcatattaatacatatatatacatttgattatgatctcctttttcttttgtgaggatagttgtgaaattttagggtgcgttcggcaccccaagttcccaacccctctccctcgttttccgcgcacatgcttttcaaactgctaaacggtgcgttttttgtaaaaagtttctatgcgaaagttgcttaaaaaaatcaaattaatccatttttgaaaaaaaaatttagctaatacttaattaatcacgtgctaatggaccgcttcgttttccgtgcacactgtttgggttgggatccggctggagtgaacacagccttaatctattttagaggcaacttaagacattatattgtcatttcataaaaatacttgcaatattccccgggtttataccacagtagtttcgaagcatgtaatatcacatggtcgtagattagactctaaacttaactgtgactacgcaactgacacaaggacatgagtggcactataacttgttatctactggtactattgggcaggttgacggtgcactcaatgtggtagtagtaattgaaggagtaatcaggtaagaggaaatggccaaccaaatgtccaacatggtagatttggtgtttgcactcacaacagatctgattcactgatttgtgaaagttcgttcgccgcttacgactggccgtccaattatgtggcctgtgcaggcaactattaccaccctaatgccatctataacacggtaagtgacgctgactttaacctaatactgctctcatgtcacagataactgacattttgcatcaatcgccaaaattcaactgcaaaaaaatattactgcaatttttgtgaatacctcaagaaaatcctacccatatcatgtacatatcaatccaactatccaaatatgtattgacaaatgaagttgcaaagtttgttgcatttatttcaaagttaacaggcttcttgtccctaaattagaaagtggaaatgccatcaaatgccccatcttccaaacaagcaaccactcataatcattgctttaacctgcctttccattaaactgtagcttttgacaggcgatatcaatgttcattttccctcagtaattgatagcttttgcatatcatgggttaacataggccagttaaccccatgatatgcaaattcgtatacatttagctcctactatccataccagcaaacatcgttctactgttctatggatagaattttatttcttttgcctcccgagaaatgattggtcaagagaaagttctccagaggttacactgaggtagttttctatttaggtggagggcagacgatccactttactatgagaaaaataaggaacgagaggtataacaaaatagaaatatgatacaccacaaaacaatgttgtacacttgctgactatcctcacctatgctagtaggcaaaagtagaatttcagaagctgaactaagatatacacattccaagtatcccacaactgctttaaaatcaatgccaaaataaaaagatttacctgccgaagtgctgaattagaattttgttgctggttcttcccagaccactgaacagcctccatcagcacatcccatagcatgcgaacaacctctatatcaggaaatttagcatctttcacctgttgcttgacagcttctgtgacttcagatatttcagcctcttcattgatcattgttgtcagtgttaactttatctccttaagtttaacctcaaacatcttcttttcattgtactcaacaagacttgtcagaccttctttactgaagagagcataatgaaacactagaactcagaatatcatttaactacttctgttcagcaaaaaatcatgataacaacttacgtgaaatgttcagataaagcctcggaggttctttttgccgatgggaaaaattccagcaaattgtcctccattttgcctttcttcaaaagtgcaataagatcatctaaagtgttctccttcagatattctttgaaaaactcagtaatgaacgaaagcactatccctttggaaacaagattatccttgagcagtggctggaagacagtttcaggtggaagacctgataacttctgagaaaaggcaagtgctgtgaaaatggcaagtttcttcctctcattttcttcgaagaactccagtgactgaaggaatttgcgcataacattttcaagattctttatcaagaaaggcctcctgcgcaatgttttctgaatgtagagaacagaaggcaaaattgcttcacgctgcgctgcacaatcaagtacagaataggggtgacgctctccttcttcctcaggttttattgtgccaggctgagtgcgccctccaatgaatacaacctgcagtttttcaaatatttacatttaagtgttcgttgacaacaagggttattcaaggaaattgaaactccagtacttaattcattttgcacatctttcaaaggcacaatactatttgtagttttacttttgttcaaaataaacacaaaagaattaaatcacaaatagctcaaaaataactgtgtatctatactcttttaatcaggtagtggtggtggcacctactcccattttaaatgtttgcatgttacctcttcttgaacttcttaatattaaaaaggatcaaaactaaatggatagccacataaaaaaatagttcaagatgaatattccgtaacacattaatacattttgtttaatccattgcaaagcaccggcatttagctaatagtataaaaatagcttgacaaatggcagtttggtgccacagagtacagcatccaagcaagcaagcaagctaaaactccaaactaattacaatataagctagaagagaactgtaataatatcttagttaactataaatatagatgtagactattaaaggtcataaccacaaatgcaacatccaagagaattctacatacatataattctatggaaatacctcaaaaaaggtgtcaccgtaacgtgagaagttgagatccgaggactcgatacttttggcaacaagttcctgtcagtgaaaggtctttataagaattgattgcacaggataaaatacaagtaaaacatatgtatgtgaaggtcggcaagatagttttacatataaatataatgttagcttgtatgtcgatattctagcactccaaataatgttcaacatgattacaagaataaaaaaattaaaatttactatgaagtcataattgttgtatagcatgtaatgctttggattgaatacactaagagatgaaaatgataacattattcactaaatatgttgagtacggggctgaaatggcaatacatatctgtgaaataaattgatttatcagtgtaatgcgtaggttttatttttgttcaactgacctcttaaaaaaaagtactagcaaagaatgataggcagactgctaagaatattttcaagaataattgcatgtcccttatgagcaaaaagtatagacaacaataaatattttatcagaacacccaactgaagataaatgagacgaaagttaggtgacatgtcaaggatgtttacaagggctacccaggtctccagcattatccagataaatctggacaattgcatcagagaatgatgcagggtccaaaggagcagcaatattccgtttgcgggtcttaatccgctggcctctgcagtatagcataacaaaaaaaatcattaagatagccttactatatgatagttgcaaagaaagctgaaaacttcacacaatactatgaattgacacaacaaaccacatgacagctcattcccttactgtatgatcacacagtgcgtagttaaggtaataatgagaaaagacaagataaatatatcttaaaagcaagaacatcatgcaaaagaaacatgcaacattatctctactattgctaggtcagataagacagattacaaacacaatcataaggactaagtaagcaacacggactaacaaaatttaaagcacagcacttgaacaagtttgcgcctcatagatacttaaacaaggaaagctctatcaaaatgaaatcaaagttgaaattatgcccatacattttgtgagcttaagttgcagtacaagggcatttaggaaaagcatgtctatatgttactacttgcaatacgaacaaaacagaaaagttctacatatgactcaatcaaaatatctgtatgtgcagttgtgcatattgatctagcatacacaaatttataggagtaacatcagtgatagctctagctgtgcagattcattcgtaatgttgcattccaatatagtgcttaaatgatatgaacacccagtacaacagcaccagaagaaagtaaacaagaaatatctaaaagaactagctaatacccatgctttgctacggataaaaatgaattatatgtgggctaataatatttggaacaagttaattataaggtttttgggacaatttcatccctgattcgctgtagatgtatttgcgtgataaacctaaattctagagaaaaagtacaacagagttagtggctggcagattcactggcaccaccattgcgagaccaagagccttacccaagagtgggcttctccttcgagctgcagacaaaaaataggtaaaagagaaattggatcagacaacaagaaagcatcatctccaatttggatgaaattcaagtgatcatggcataaggcgtataaaatgttaaacaacaaagcagggactgctaataattcaataacccgttacccctgcatacttaaaatggatcaagtgtccctatgtgtctaaaacataagtcacctatcaaaagaaaattgaacttaaataggacaaaaggtaaaataatggtatgcactaaatggccaaaaaaaaaatcaaatgttttattgccattgttgcagaaatcacgaaaggttttttgtacgaggctccccatgctttatggtcctaacacattcatagaacccctcccttaaccagatgttattttattggcactggaaaaggccatcgggacattccaaaacatgtcaaaaaaaatgtgtaaggtaagtaaaaaaaatgtgtaaagaatgtgtaagtaaaaaagaacttggttatgatggagtatccagactctggccgagaaacctttatgcagctacagtcataaaacataacatactgatatgtggttttgtgaaactttctaaaaatatcgacggagaattccagaatcttcataaataacaacggacaactcaagaatcttcatgctcatctcagggtaaaattcacagaacttactaatcaagaaaaactcaaacatctgacaaccgccaaatctgtgaggaatcaaggaacctaactgactaaaagcagaaaaggcagctccatcaaacccatcaaatcattgaagatttaagaaaagactatcaaattacccaaacaacgaaaatattgacacgataaacgtctggataaacatagctaattccttataccatttcaatgagacgaacaaatcggacaaatctaccagtacgcaacgaatttgatagacctacaacgcaggaatcaaaccaaggcacatcaaagggaacctcgcttactcacagctaccagatccgatcatactgagcgctcggaatccccaagcttcaaccatcaaaactcgccggaaaatcgcacatccaagattacccaaatcaagagcgcgtcaccaagaatcaccaaacgaaaatccagcttccaaacaagaaagcagcaaacagcagctcgaaccccctcccactccgatccagcacccctacaaccgacagcccacagatccgccgccatacaggcaacaaagggaaggaagaaagcgagatctaaggctaccgcagaagcgggacgacggcaagtacctcataaacacaacgatctggcgcggagggggaggggggttgagtggatccggggcttcagggaaagttgcgcgcggccgccgacgcgagggagagtgaggagggtaaaaaacctagctcttctcagggtaggggttggtgcggcggtggcgatcggggaaagagggggtgataaagcgtgtgtgcggggcttcgggcggaaacggggaggcggcggcggagaacgagtggttgggatcgaccagaggtcccgtgtgggctgagtgatgggtcggccgaagttcgggcatgggctcaataagctggcgtctatctgtgggccgatacgtggccattggctgaaggaataagattcactttgactccctcgactgaccagctaatctaaatcgtattcctcaaccgcaataccagaaatcttaacccccgagctgttaaaaccggtacaaatttgactcccttggtgattttggatgacgattttgctgatgtggcgcacacgcagcagtgttgacttggtcttcgtcccacgtggcattgacaagacgactccggcggcgtaacaccgagctccaccaacctagatccagagctccgaatcggccacgacagacggctagaggacgagatgtggtagcagggcggcagcggcggcggctggagaccactcctcgctttgcgtcgccgcctcgaggccgagacgcgcccaccgccgccgcaaaatcggaggcggcgcgcagcatccgctctgcatccgcaagaaggagctgcttccgcgggagttaaattgggcccacatgtcagtgggcccacatttttttgtgtgtgtggatgacaaatggcccagcatatattttttaattttaatgccacataagcgccacttcaatgccacgtggaacgaagatcaagtcaacactgtcatgtgtgcaccaccacgtcagcgaaaccgtcctccaaaaccaccaagagagttaaattgtaccggtttagatagttcgggggttaagatttctagtattgtggttgagggatatgatttatattcggcggtcagttgagggagtcaaagtgatcttattccttggctgaattagtttttactagtagaagcagagagcaaggttaatagtacagctcgctagtggctataaaaataacacatcatcctgtttatagcttgtttcaaaagctaataaatacagtaatgatctctacatatttctcatgcacagcattttattttttttaatctcaaatagtatcctttgattgactgctaataaatgatgcacaaagttacacacatgcagggaaaaaaaactgggcctacagcacggggagccgcgtgcagcctggctgcaaaatagtagcccgcgtctctctctcctacccttctctctctttcaaccaggcaaaaatctgctatatgaaacattatagcatgctgatttagacttattgtacctgttctaagagatccatcggctgcctaaaaaataagctaaagcaaaatttaaattttaaaacaattttaacatattttcaacatagttttttttcagtgttaacttttaagtcactaaaaacacatatataaaagttttgcacacaaactattttttgtttaagttggcaacttttctagcaagaagacaatcacgatcaggacacctaaatgcgtggtggtgatttagagtcgccaaccacctcaacctagcaaaagctagatcaagatggttttgatatattaaaccgactagcagagccgatttagatggaacaagcgataaacacccgtcttgtgggtgaacggaaggtttacgggacaaacctacagagggatttcgcactctcgcgacgaaagtggatgatttacagtgcaaatcgataaagactgacaaactaagctagaactaggcgacaatactcttgactctacctgcaacaatgctctaccttctctcatatcaccagtcatcttgccaagtgaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaaattccttgtctttcaacccatccacttttccagcttgatagccacccccttttagtattgccgaaatcttgtttcgacagttgccgcgccaggtaggggtagcatcaagttcttcgccgactagtgcgatgggtttcgtctccggcattgacgacttcgtcttcccacctgggcaggcgtttcggtttggcagcctcgacttcatcaccaacgacttcggcaagatttctctcctcgactcggattcgaaccagtcgggaagaggccaggtccccgccccgttcggtatcccgaaatcggccgggatctaccccaagatcatctcagccgagttggccccaaaccactcggacgagatccaatctactccaacacgacccgatcaagatgatggagcctatccgctaatcctgatgaaactccgcgatgacttggctgccgtcttcaccaaaagggcgtcctctccccgtaggtctaggcgggatccggccccgtccccgatccagtctagttccagggaagtcggcgtcatactccagcctctcggcacggtctcgacggaacaattggacggctacctcagctctcccagtgtcgactcacgactgacggagatcgtagagtacgacgacttcggctaccgctacgactaccgcaacctcgacgacttcgacgaaggctatgaagataactacacgcccctttacttcggcattttcatggccaacaacgagacggaagaacagtgtcaagcccgacaagcagaagaacagcgcgtgcgacaagaagccgaacgtcgccgactggaggaggagcgccaagcacaagagtgagaaaggctgcagcgtgagcaacaggagcgcgagcgggctgcaaaggaggctgaggaccggtgacagcgcgccttggaggctgggcgacgagcacgagaactcatcgggcagcaagatgtcgaggggacggcggtttttcacatccctttacagaacgcggttgcagcgatcaccctcctcgacaccctccttaagggagacgcactcaatcaggccaatcacgtcgtcaacatcttgaacaagaccaagaccatgatcgcagcttcggtcccggttaattccgcaagcgtccgcacgccgactggcagccgagttcctcctcttcgatctcaagactatcaccatccaagcctcagcatcgtcggcgctgggtcaagtcgcaagagcagggatcacggcaaacgatctgtctactcgcctcctcaccggcaaagggagcgtcgagctaaacgtccccactccccacatcataggcgtcccatcgatcttcgcgagaccattaaccagcgcgcgcggcgagaggctacattccccaccattcaccagatcgctacgacgacgacgtggatggagttgctgccttcacaagtgacctgcgtcgagtggattggccagccagcttcaagctgactggaatcgagaagtatgactgctccaccaaccctgagtcttagctcaccgtctacagtctcgcaattcgcgcaccaggaggagacagcaaagctatggcaaattatctgcccgtggccctagcggattctgcccggtcctagcttcacgggctaccccgtggcacaatcgaatcttgggcggaacttcgcgaccacttcatcgctaatttctagggtacctttgaacgccctagcacccagtttgatctttacaacgttgtccagaagtccggagaatcccttcgagattagatctgacgtttttccgagcaacgcaacaagatctccgacatcatcgacgacgtcatcatcaccgccttcaccaagggcattcgccacgatctcttagtcggcaagtttggacgcaagcctcccaggatagtcaagcagatgttcgaaaaagccaatgagtacgccaaagccgaagatgccgtcaccgcatccaagcagtcgggcaccacttggaagccgaagaaagatacgccgactacagggggagtggaagtaccaatcacaaggatcgcaagcgtaagcccgaagaacttgtggcaaccactacaccatgctcccgacaacgttcacgcgtcaacacttttgacaagatcatgaactcccaatgttcgcatcatccaaattccaatcacgcagccaaagattgcttcgtctacaaacagttcgtagagcaatacgctaagaactcacgcaagacgactaacggagatcaaagcacgtcaaagaagaaggatgacgaagatgatgccccgactggttttcaagaccatcgcaaggaactcaaccacatctttggcggacccctagcttatgaatccaagcgaaagcaaaagctgattgaacgggagatcaatgctgttcagcccgacacaccccaatatcttcggtggtcagagacagctatcaagtttgaccactcggatcatcctgaccgagtggtctacccgggacggtaccccctggtactagacccagtggttcgcaacgtcaagctccgaagatccctcatcgatggtggtagcgcactcaacatccttttcgccaagatgctggacgacatgcagatccctcgcacggaattgaagccgagtaatgcgccctttcacggagtcatccccgggctgtcttctactccactcagccagatcactctgccggttgctttcggcactcgggagaattttcgcacagagaatatttgcttcgaagttgttgatttcgagacagcgtaccatgccatactcggacgaccggcattagccaagttcatggctgtcccgtactacacctacatgatgatgaagatgccaggtccccgaggagtcatatccctgcggagcgatattaagcaagccgtcacttgcgacaaggaaagctgcgagatggctcagacccgcgagatcacgctcgcccgagaagaaatccgactagctgcgtccacagcaaccgaaggagaagtgcctgcgaccaagatgacaaagagcggagaaagcaacgccaagaccaagaaaattcctctagatccttccgatcctactaagactgttgtaataggcgctgagttagtgtaacatcctaaaaattcctgacaataaaaatcactaaaatttcgaactttttaaaacttttgcatcatgctggttgttatgattgctattgcttgccaaaccataaatgatcacaaagaaagtaaagaaaagatcgacatttaagcaatagatataatttacgagaatatattattgttaaccctaccaatatttatgcacaagatagtaaagtcaaatattaatttctattataaattaaaaatcagatattaaatattcgaaccatgagtgatagcttgatgtcacaattagctaaagaaatagtaagattaaatctaatttatttggatctactctcatatgaaatataagtacacatgaaataatgaacacatcaatggccccatctataatagagtatctcactagaatatataattaatatttgaaacaccttatcaagctcctcataacatgaaaatcactcatataaaataatggtcatataaataaattaagctttatatataaataagattatgtgagttttaattaaacaattagattaatattgtaccgagtctcaatttactatttatagaataaatggattaaacctatctgtgtaaaatatattgctatacaaataaactcgaccaatctaccattgtattattaaggacacatcgttatattaaatataatattacccccaaagtcttcaaaaatatataagttcactttagggccaataatttaaattaatctaaaaagaatttatttgtgtgataaataaataaatatgggtggtaataattttggataaattttcatgaggagttagtgcttaaatttagttaacatttaactaagtaaaattagggcttataggattaaaattgtataggagataggctaagaaatgaataataggaaaggacagtgttcattgcccctaagtgctcgaccttgtcccaccgcggcacctagccttcccgtgccgctgccttgcgccttgtccccccgcacgccatggtgtcgccgtcgcggtcgtttaaacgcgcctcgcccggtcgtttcgctttgggcacgcagctgtcgtgccccctcgggtcccatcgtcccacgcgcggtcccggtggcgtcgcaataacaataccggtcgcgctgccacgcagtagagccccgcgccctgtcgctgccgcgccgctcgaccgtcgccgtcggcct

SEQ ID NO: 75473 - DNA, 68363 bp, Oryza sativa
  unsure (1)..(68363): unsure at all n locations
ggggtggtgagtggtggtggtgcgagaggaggaagaagaggtagtcgttggaggggaagaggcggaggtgggggatgctttatcttcttcctcctttccgcgctcttttgctgtggactcggtgcacaactccacttcgccacttcatcaaagcggctcactactacagtgtacgtaatactccctctgtcctaaatgaaactaaaactgtatgtaatattttctattataatatagagtctattatgatacattatacttgaaaacgtcccatccaattttatattctaatattttagaataggtagtaatgatttttcgaggttttgacacgaataacgtttccgttccgtgtcgaaacctcgaaaaatttgtaagatggttttcgcctaagcaccggatcctgatccatgtggatataacggtttttgtcaatttttttataacttttcgtttaattttggtcaaattgactgtttcagatttgaaccattctaaatttcagtcataacactatcaaaacctcgaatttttgcggttttcaattggtttttatcgaaaacatgaatcctaatgtctacacttctgttcacttcagttcgattttagtgaaaagcctccttggggacaaaaataaattttgaaggaccttcgtatacaggaattacactgatctatgcagaaaccatttgaaaaaaaaaatgtatttcaaagaaaccccgagtatttcgcaaccaacctttttggcatattttttctttaaacatgcactatattcagattcaacgatgcaatcgtaatttcattacaatcataccctacatatcagttttctgaacgttattatcattttttttctaaacccattttgacaattgggtatagatcgaccaaatgtaaggccccgtttgaaacacgtgaactgtttccctgattcttgtgaatattttgtgtttcaaactttcagaatgtgaaatacaaactgaattgtgcagcattgaacaaagaccgcaccggtaatagtactactttgacagcacggtaacagatggtcaatgtctgctagtaacagcctggtttctgaatgatcggcccgggtgagaagagattgtttgcctgaagaaaatcgagtgtggtcaagggactatctgaagaattcgcgaacattgtatcagtgaaaaattattcaccattcgtcagaaagaaagaaaagcacacgacaaacaatgaaacaaacatcactggggttcagactttcagaacagaagctgtgattgtttcacgaccacacacaaccatcggtctcaagcacattacgctcctttctccatggctacacaaactacagaactcgtgagaagcaggccacggtagcatggctcattgctggccacacgcaagcccgaaaatatcatttgctacagtccaggtgaaaaaaagatctttgcttcaccatagcatccaggaaaggtgcaatttactgtagcaaaaaaaaaaaaaacagaaattttgatcacttcaattcaggattcagcaaacgggttcaccaaacggaattcgcataggagcatatcgatcatgaagttagtacagcaatgggatcgagtttttggtttcagttgaaagcgatccagccagtagtattgtagtacagcacattgaaatgattaagacagcgattacaaacaattgctgaaattgacaacacagttccgaacttctagtcgtaagtagctgtcgacattattatggagtaatgaaccgttgaacttgatcatcagatatatatacagaattttaactttgccatgttccatagaaatcaagatctccaatatagtggtgctagtgtaaaaagtacaggggagaatcaacaaagtggtaacttttttgcctaaatcaccaacactactgagaaaggaatttcagctaaatgtttagcagcaaaatatccatggcatcacttgttactttcctgcatatcatggcatgacacaggaagatctaaagactaaactgttttctgttctatgataaaagaagatcgttttcaccaaggtgtgggggcctcatgcaaacctggacttcatgctcttcgggtccaactcggtgcttggggaccatgatttccagtccagtgccagtctcgtcataatacgcttcgagctttgcatcttctggaatccttgtagccaaaggtatctctctcacaaattctccaggagggcagtgctcagggaaaggatcagtcaacttgaatgtcctgtcatgtctcttaacaaagggcattcgagcagtgctcacacacgatatcttcacaatgccatgtgtcaatgtgttcctccaagagaccttgacactgtgaggatcagagaagagcatgctcaccatgattaagtagccttcatcgtcctcatatattgtcttggcagccgtaacaggtccacttgcatgttttgctacaccagtgaactcatgcatccatgacggctcacctgtgtgaacttctatctcttgctctctgtcagaacaagaattatttgccatcacgcaatcctcatctgcaccatgagcaaagaagtccttccgtcgcttggcgcattttggtgaaaggtccatcccatcgtctgatgatggtggcgtagaaaggttaagacctgaaccattcagtgcctttttgtgactgtgagagccatgtgtaatctttgatgacagtggcagtggcctatcaagttcgaaatcagtgcttggaagattcctccatgattcaaagtcacttgcttcaggaggaattgagaaattaagttctcttcctgtaagttccgcccaccttttcatttcagcttcaggaacagctgacagatttggtgaactcacaatctctatcccatgaaggcattgtgggttggacagccctcgatagtgctttcgttgcatgcggtgtgaccttgcaaagcccttatctgcactgaatggaaaggatggctcaccatgcttggaatgcccattcatgaagctccggagctgcatcttcccgagggcattgtcaggccgttccttaaaaacccacatgtacatgttctccatgtcatgctgcaccaggaagacatcaaggcgaagatcagacttctcaaagcccgaaacgctcccagaagagtcccgtgtcaccttgcccttcggcttttccacaagtgcaggtttgaagtagtgattgaagaagaaccatgcaccccaaatgctgtcccccctcttggcacacttcctcgcaccgacgccaaccgcagtgttgccattgccagtcaactttggaagcgtgagcgcaacctcagactcataagtctgcgtgccgagaccgacatcaagcatgtcgaactggtcgataccccacgacggcggatgcggcggcggtggtggtgaggggtctgcagaaaggggcaggttaatgtccggtggtcctggatgcgcagattcacgccgcggaatgatgaacaattccctgtcaccaccgccaccaccaccaccaccaccggcaccggtgctgccgccacctccaccgccaccggaggagtcacccgaggccgcgtgcgacccggcgggatccatggagaggcgggtgcagggatggctgttggtgttctccatggacagggtggggaggaggggctctcccanggagagctccctcctctccttatccttcgtccttcctattctcacctacttctcttcgcttccacctcttgctcctcctctatctactgcctcttcacctcttgccccatgggaggagaactccatgggagcatcaaggatttcgcatagccttgccccataaaagatggagttttcaacccaccaaatccacccacagatcaagatttgcgatgggggatccttcctttggagcaaaattaagatcttcggagccaatccagcgctgcaagcctagaaaaatccagagacaaaaaaaaagaaaagcaatttatcagacttactaccaaattaacagcatgttgatgcacacatacctcgaaatacagatcaagtaaaaaaaaacacttcctttcgctaaaaaggccactcgatttccccacaatacctcactaaatttcgtcacgaaaacaacaatattttctccaatcaagccgtaccacacctcgaaaatcccattaaacacacaaagaatcctcgctggaaggtggaaacgaagacaaacgaggaagaaagaaagaagaaagagcagctgcccttgctctgatctaacctttgggggaggaagcagcaaggttctagaaggccccttgtcccttcggtgaggagctctcctgaaggttctggaggcttcgcctcgccggagcttctcgccggaagcgaggaggagaggggagagaaggggaggaggggaacaatggaggaagagagagaggagagaggagggcccaaagaaaagcgaaaacaggggtcgcgggtgtcaacgggttacggatccaaaagtcgtttgcgggtcgcagaatgcaaccgtgtccagtaattttagagatattggggtagtgtattggatccagggagttaactttagtccctatatttagacactaatttaaagtattaaatatagattacttacaaaactaattatataaatgaaagctaattcgtgagacaaatattttaagcctaattaatccataattagagattgtttaatgtagcatcacataagctaatcatggattaattaggctcaatagattcgtctcgcgaattagtccaagattatggatgtgttttattaatagtctacgtttaatatttataattagtgtccaaatatccgatgtgataggacttaaaagttttagtgccatctatacagggtctgaactactcccttcttccctaaatctctaaatgttcgacgccgttgacttttttaaacatgtttggccgtttggccgttcgtcttacttaaaaacttttgtgaaatgtgtaaaactatatgtatacataaaagtacatttaacaataaatcaaatgatagaaaaataattaataattacttaatttttttaaataagacgaacggtcaaacatttttaaaaaagtacggcgtcaaacattttaggatggagaaagtatatgccacttttagatgaactatttgccactgtaaccacatgttatagacacatgtggacccacatgtcattgagataggtgtggcaaatagttaattgctaaatctaaaagtggcaaataattaaaagccccgtaattttagcttcccttgggaaggggtttgtatgtaggtgtacttatgttttcgacgaaaaccgatcaaaattcgtgaaattttgatgtttcaacgttgaacgaaagaagatactaattgaaatgccaaaatggtctttcgagaattcaagtttgaaatagtggattcgacccaaattacttgaaatttgtcggaaaccgtaataccgttaggatttggatccgacgctcaatcagagaggtaaaccttgcttgagataatatttgtttgtttggaaacttttttgggaggaggggagcattggggggtttggtttactccacattatttttcttgacgtttaggctacaatggagacccacgatttagcttggttggtgagcaaattcaggtgccagaagctctccttctaatgaactttctttaaaaaaacaattggttggtgcaattatcttgagaggatctttaaaacacatgaattttataatatttttataggatttagctcaaatcatacacaagtcctgtaaaatcactccattcaaaagccaagttttacaatccggtgctatggactcactcaacccacaaaaccgcactcatttagacccacaattgagttaacaatagacaaaaccatagtattaatttgtacaaactcacactattttaaaatcgccacttagctagatctgccgccagtttctaggctaacattggaatagaactcgagtaaataataaataataaacagatcattacgtttccaaagggtcgtttgcaacaacgtattgagcatcgactagaaagattattctaagcatggagcattaggaaattacgatgaaatgcgaccaaagcaagaagccaaattatccgacgactacttgccgtttggaacggccaaggttgcaattattactagtattcttttctttcttttttttttcttaagacaggttgcaattattcaagagaagattccctcgtcaagtggtcaatcagatcccttttgttttcccatttcaaaggtttagccgtacatgcaatgaagcaaaaaacgatagatattggtctcttactacttcacacatatactctccgttccttaatataagagattttgacattttgcctgtttgactattcatcttatttaaaaaaaattgaaattattatttattttatttgtgatttatttttttatccaaagtactttaagcacaccttttcattttttatatttgtataattttttttaataagacgagtagttaaacgttacaagaaaatagtgaatatcccttatattagggggatagaggtagtatatattctagatattcttctaaaaattcaattcttctctaatgctaagaggatggttggaggtgccgtttccattgtcggaagaagggaccgaggggctgacagagtggtggagataagtctggctagttcttcgaacgggctacagggacgccttcgacttgttgtatatgcttgtttgccgggtgatttagaaagaaaggaacaccaggatcttcgagcacaaaaactacacggcagcacaagtttaaagggctatccgagaggaagtcctggtttagagagaagactgttttcaaacaacgggagtaaagcttcaggaaggtttttttttttttttcgttttcgcttgaggcttttggctctcagctgatcgatccgtctccactgtttaaatttgagttcttctctatctccatttcacatttgtttagcgactgcatacatacttagttacataggatttttgtcaagcacaaaaatagacaattagacagtttaaaaagataacagaagataccatgaatcaatcaaaatatcacacaaatggtgataacacttagagactcaaacaaagaaaaggtaaaacaaacaaacaaataaacaaaatactccagtataattcaccagtcagcatgtcacgcgtaaagtgtaaacagaacagaagataagtatagtgataatagctgttaggatgatgcacacatactgccagttgagaaagcatgtggcatcaatgtaattatggtgccactaactagatggcgaggacaatctggaaaggcaacacggagctgatgagagaaaagtacaccaggcgaaaaagaaaagcatcactttggcaacttttcagcaactggatggactgatgaaagggagaggtggaagaaaggcacagcttaccaactgcagagggcaaaatctaggtatggagagatgcaattggcttattggctccctttcaactgatcttcctctcacttcatgtcatcctttttcagatgagaacagtaactacacatcgacctaaagcaaatgacggtactagtatccttctgggttcttgacaagcacaacatcgaaatataaaagatcacccagagtttaagtacaagaccagtacattttatgttaggaacggagaagctagtcattggtacaacatactattagcaagccattagctgcatccagaaacaacactagataatggataatcggatctacaaagctcatgagcatattatgcaatttttgcttttgagaaggccttcttcctttgggccacaatatagcagaacatcagaacatcaggccatggaaatcctgcagtcattcaaatagaacaacaacatggtgtcttcaatcttatcaaattttatgttatatacgctagtatatattataattattagtgtgttatactatacaagctaatttttaggctattaggtgtatgaacaatttttttttacccctgtcatttcgaatatacaagttcaaaaagctaggcccacaatttagaagttcaaaaagctgaacccgccatttagaagttcgggaagcatgcacattcatccatttatccgtttaagtgttaagcagaaaagaacagggccatctgcatactcgtattatataaaaacataaggggcattatttgcatacttctttattgtgagagaacagggggcacaatgccccgataacagatctattgtgtcccaataacagatctacattcttcagacaagatatgatgcttcattgcttttgctgctatacatcggaaggccaatctcatgcaacaaccaactatatctttgacaatctgcaaaggcttaaacattttagcatttggatgattcacgatatcaatgtgacaatgtcagatgcaattggctcctttcattgatccacccctactttcatgaaataatattcagaaacagttacagggcaccaacatgaatcaaatggtgatagtaaccttcttcatccttgaaaagcagaaaatctacacatcattttttggcatcgatacggagtgcaattttatttacatatggaaaagccaaagtttggtacaacacaccattaattagcaaatcatgaaaatggtactcgtgtacatttttatttaccaagggaaaagatagtccatgtatttcggcatttccattctaatacacttttacttatttgctgaagaaacggtagcaacctgagctgtagctgcgagcagaaatcagattagatagctcttcagtagttatgtggttttgcttttgccaaggccttcttccgcagggcgatcaagtagcgaaacaagactggatatactgcactcatccaaatgaaacaacactgcagtgtgttaacaaatcctacttgttttcctttataaaattcctacaactaccttttcttaaaaaaaaaaactaggttatagcatcgattactaaatgaagtacaatcccatggaaatactacctgtggcaaacgaagccatgaaaaagagattggcatagaagtagttgaaggagaaactccatttgtcggatttctcagatgcctgatattgttgagcctgatattgctcatgcaaaagaaaagagcatttaaacaagattcattatgaaatggaggcgttgatcttcctttctaagttattcaagttaccttcatctccatgaaaggaagagcaatgtagattaggacaacctcacaaaccataccaacaggaaagcatactatgaaggtgctgtacctgcaaagaaatcagtacggaagtaacagcaacatatttttaagagaattcgctgatcagataacgagtttcatttgaagtttatgctacatattatgatttgtttacgactagaaccaacctaagccaaaagagccaggaaggtgtaaatccaaatgactccttcatgccatggaaagaatatctggtaacctgcaaggaattaataattcacttcactctccgaagtgaagaaaatttcataatatttgttcaactaagctcaacacaggaactttcaaagttttttttgggaatacgcaaggagcacattttttccattaagagaaataaaggttatttacaatgaaatgaagagcagcaggggactgaaacaggactcaaagtacaaaatcaaaggtttatctctcacggtctgttttggctaccgaagtcccttctgaggatcagagcagggatggctgaattcgcttggcgccagagtgccgtctctgccgccattcccttcacgatgtccacccaggtcctttgttgctgattgaaaacccggccgttgcattctttccaaatcgtccatgccactagcgtgaccaccgtgtcaaaaccccgacgcaatggctctcgaatgatcattcggctgctgcatagccattggtgaaatgagagttcatttactgacagacactcaggatgtccaattgcccccaacgtccaccaccatagctattagctgcctggactccagacaaccaacaagaagaagcgccgactgttttctctgatgaagcttctttgcagattggcgaacaagcatgaaattgtcatggatgcaccgttttttgatgaacgagctctggttctgtgcgaccaaggagttcagaatgggggctagccggcgggagaggatcttcgtaaatagtttcgcaacgctatgcaccagactgatggggtgaaaatccttcaatttcctggcgtcttgtgttttaggcaacaacgtgaggagagccgtgttcacctttccaaaactggacccgtccatgcgatggagctgctgcaacgctgccataacatcctcgcagatgatcaactagcaggtttggtagaattgtcctgtgaaaccatccggccccggcgctttgtcacgcgatgtatcttttacagcaacccacacttcctcatctgagaacggggcttccaactggggtagaggtttccccctctcgactagaaaatcaaggatgagagcaaaggatcttgaaggagaggagtcgagcaaatgcaagaaccagcacggccttctcgtcaggtgaggttgctacctgaccgttgtgttctagttgttggatgaagttgcgccgtcgatgggacgtcgcatgctggtgaaagaagcgtgtacatgttggcatcaccttcctgcagccacgaaatccgagagtgctgacgggccatcgttcgctccaaggaggccagcgcaaggtatttcaactttaagctcttgtgaaagtatctctccgaaggggacagggcaaacattcctctactctatcaaatctgccaatcagttctcttgccatttccatttgcaatttcatatttccgacctttttgtcgctccaactccttagttttttggccgttgttctcagcttgctgtcaagcctgctgatcgggtcggcaatgtggcaaggcaatgaccaggcatcttgtataacctcatggaatttaatccttcaagcgtgcaccaaaaactctcaaagtggaaccgacctcctctagggtgcgaaagggaaggtggatagaaaaagcgggcaatgatccgagaccgtggacgggagagctttaaggaagcattggggaaatacatcctcctagtcggttgtgtagaacaccctgtcaaggcgttccagcgttgggttcaaccaaccattcgaccaggtgaaggagcgaccattcgggtgaagctcatggagagatagatcattgatggccctgcgaaaatgacccatcaaacgcctgtttaagtttgcattgctcttgtcctgatcttggtaaatcaggttaaagtctccgaccaccacccacggtcccgaatggctgcttcggattgatcgtaactctagtaggaaccgcagtttgtcggcctcgagttaccagtaaggaaatagagtgcgagctaccatcaataaaagaaagatgtgcagtaagggagaattctcccatcgtggggctgtcacaactgacgaccgagctgtcccacgcaaatagagaaagtctgatagattagcacttaggaattaattgtgtagcatcaagttcagacacacgaccgaacaacgagcatctacaatcaccgaccgaacagcatcccggtgtgcgcggtcgtttaaacccatgcacattccagacaaggaagttgaagttgaaactcgtcatgggacgcgattgatgcgacctgacaacgaagctctcaagcggcctgcaccacggacgccggcgccatcagcgcgctagctggcctgcgggccccggcaagctgatgtctaagagatggtcgatactgagctcattgtcaaagatctccgtatactgctggagtgcattattggtcggctgtggaggaagaggcggtacatcgtctgcatcaacctcaagctttttcgccaaaaccacctggcaccttgacattaatattgttggagctccatggagtgcttgaaccacctgccgctcactccggcgaggcgtgaagggggtagcaggcatgaccgatgcaggcggcgttggcagcggcgggagaagtggggcagggatcgccttctaatcttggtgcgcctagagaaggtgatcaatggatccggttgcggagagcccggcggggttggcgtcgcagcgacttgatcagggggcgcctcggtggttggcacgtgaacaccaccatgctgggccggctccagtgcgacttgtcatccgagcaggccgcctccaaccgctggcccaaaggaaggaacgaccacttcatgctgggctggttcagaggcctcagccgcttggtccagtagggtgttgggctgtcccgagcccaaatcatcctggactggtgaactgggcctgactgggctaggcacaaccactggagaaaggcgatctggcccggcccagaccgcatctcccttggaagccttagcctcgactagggatggcaattgtgcccatttgcccgtttacctgtgggtaaaaaccctattagggttgggtttgttctccattttatacccgtgggtatcttattgggtcaaaagttatgcccgatgggtaaatgggcatgggtataggtaatcactacccatgcccgctttgcccgtttacccgcgaaatctaacttacatgtaggctaggagcaaaatccactagaatatataagccacgttctttgttttctacggtttcccttttattccccttattatttctctccccttactctatcgccgccagaggagagacccgacaccgaggcggagaatatttgatgttttaagttcgattcgaacttagaagcttgtagactttttgttccactgcttttgttgtggcgggtaaacaggcacgcccgcgggcataaggcgcccgcgggcaatgggaataggcaaccatccttacccgtcatgtagtaatgggtatacccacgggcacaaataatctcacgggcatgggtatgggtaggcactacccgtgcccgtcacgcccgattgccatccctagcctcgacgccatcccagcgcgtagcctcatcccacatcggaacatgtgcaccggatgggggcacatgctccgcctgccagcacagctcaaaagaagcatctcgacaggggctagctttgcaggggctttgaagcgaatcagaagacggttgtgatctgaacaggggccccacagaagaggccaccgcatcaacatcggtgactgagttgagggaagagacaaggattttggtggtgtttggatcagggactaaactagtccctgtcatatcggatgaatttgaagtattaaatatagactacttataaaactaattacataaatgagagctaattcgcgtgacaaattttttaagcctaagggcatctccaatgtttataatcataagtagcattaaggtgggtcccactattcttatggttattaccacaatgtttgaagtaagagtaaactttaagatgggtcccacaatgtactattctagtacttcttttatcagccatgcaaatttttcatcctcacattcattttaccctattattttattgcttgtggtcaagccataagcttaaagctttcttttgcatttaatgccttatggctttgtttcacaatgtatatggtcactataaaaccttatggcctcttcttatagccacattgtggctgccctaattaatccataattagcgtatgtttactgtagcatcacataggctaattatggattaattaggctcaatagattcgtctcgcgaattagtctagggttatagaataggtttttattaatagtctacgttaaatatttataattagtgtccaaacatctgatgtgataggactaacaagttttagtcccatctaaacagggtctttgtctcccaaactctctcctctgtcgggggaagggacagctgcacaggaggcagctgacgcgaccaggaattttctttcaagaatttcaacaactactgtcatttcaagaagcagaactataataaaattgcatccgaaattcatgatcttccaagtgagtaatttggtgaaaggttttagggagtagcgtatacctcagtgatgcaccagcatatgatcaaggaggtaacaaggatatgagagtgtgtctgcaaaacatgtggacagtgattcaccgatattgtttataaacaaaacaatcctctgattgattagaagataaaatacatggaataggaaactaggatgcagaagaaaagagcactattttgtccttatccatgatgtaattaattgcaacagcttcattacttaagcaatttcagcagcttcggtttatccaatgcctactagagccattatgaccataaatgaaagtatgggatatgctcttatagctgcaacattacctaacatcaatgttttgtcattctaagaagtgctttctaatccagaacttgtttttaagatataaaccttcttataacttggagtaaggtcctgatattacctcagggaagctccacaagatgccccagatcatgaacaaccttccagtaacttgtagaacagtagaaggcactggagacctcaccaaacctttttaacaactcagatacagtaataagcaataatttttttgggggaaataattgagtctaacaggacacttcctttctctctttaggaagaagttaacaagacgattttctcaaaactgaaacttctcttgatttatttaaattccaggctattgtttttgaaacgagccacacaagacagtgcgagtttcatgtattgataaagcaggagaaaaatacaatctatagtcctagaagaccacagacaaaaaaagaaaatacaaccacaccgcgcgtctacaacaaaacccactgcatgagcaaaactgaaggtcttcgagacgacaccttcaagaagggtacgacaccaaaagtgccgctgtcgcctgtcccggagggccaggacaaggttttcacctgaagaaagtaattgggagagacaagaaaagcggcaacaccccaagaggaaaaaacggcacccacaggcgtcgttgttgccggctcgaaggcagagctttcgcccaaaatttgtctctcccaagaactgaactcctacacgctccgcagccaccaccagcgaaaaccttcgacgcatggccaccgcaccggcaccacgccgccagtcaatcgccatggggaagctcgaacctcgacacacaccggctccatccacgcagttgggttggatggggagagggtgagagagaagaatggatgccctctcccccacactagcccgcacgacgtggccaacttttgccgacaaagtcgccgtcgcaagaggacatatgtctaggaaggtgcacgtcgagaggaccgcggctccccctgacagagtaaccgccggctccgccacgaatccgttgtccatgtcacctcggaccaccagaccgttacaccggcgccatgccaccctccgcaccgtgctgttgacccctccgccacagtgcacccgccgtccaaaatgacgcggcactagaacgtccaccgaagcacgatgctctcgccccaaatccggtggaggggatcggatcttgcccgggggaagccagacgcccagctgtcgcgcggcgttggctgcccaccgcagcttgggctccgccgccgccatcaccaccaagctccaccgccgccaccactcagccccgccaccagcccccaccccgccgccagcaccgccaccgtgccctgccaccatctcccaccccgcctccagcatcaccggatctcgcgcgcgtcgcgccatgcacgccgtcgccggtcccgccgaccagccgctgccgccgcctacgcgtctccgtcggctgctgttgccgccctctcgactccgtcggtcgccgtcgccgccctcgcttctccgtcggtcgccgtcgccactgccttccgccgcaaacctcctcggcgtcggccacctccgcctgccggccgcagccatccggggggactggatctgccgccagagtggccggatccgtcgtcccccccaccaacggtcgcggtcgccgcctcccacgccgcctcctgccaggagcggcatgcccctcccgatctggccgcgacagggccagatccacctccggcggagccggatccgccgcatttggcccagatggcgccggacactgtcgccgccgtccgcttcgctcgggtcccgccggtgccccagccgcgcttctcgagagagggagaaggccccgccgccgccatccttgccgccgcacggctttgccggcggctgctcgggcggcggcgaggcggaggggaggaggagaagtttgtggcggcgcgcgcggtgtcgccgcccgtgtcgccctagggcgagtgacgcgggcgttgtactgtcaatttttttgacgctgctctgagatggatatgtaatgtttccaggctattgttggtatcataatgatttcaagtgaatgaaaaagaggctagaggatacatattacactgcacaaatgtgaaagtatagaattttattgtgcgcataccctacgttgtgcagataccagaaattaccatctaccactatctaattcagtatgaaaaatgtatatactttcagtttcagatatgctgtagttttgataaatgtatattctgaacagcatatcttttgttgtgcacacaccagaaactaccatctaccacgatctaattcagtatgaaaaactaagaaacaatatcaaggtagcccttaggcctaatgtgtttgcatgactaacaatttccaccatgaagagcccccagattcttattaggcttttaggctcaatcacgtatcatttttaatcccttctttttgcagtaaaaggttcaaaatgaaatttaatgtggtaccccttgttgaaaatacaacgtattggaaagaaaataagacttattttctttataaagagacaaagtatatctcacctacaatggaatgaagaatctgcgctaccagcatcaccatcaccaggcaaacagcagaacataaaaagtttagcacctctcaatctccatgagcaatgaaacaaaatggttgtacaactgcattcaaatttacagttttactacaataaaggcaacaagagaaaaaaagaaacaaacctccatgattgcagcagtctgcgcgaacagcagatgctgctctacggcagcatacacggcctcatatccgttcttcagcaatgccaatatcatgaaccacgacacctgaaccctgcatgatccaaatcaaagagccttgatcaaaacaacaccctgtacaatccaaaagaattggccagcaaacaaagatgttactccctccgttattttatcttttttttctagtcaaacttttttttagatttgaccaagtttatataaaaatttagtaacatctatcacactaaattagtttcattaaatacaatattgaatatattttaatagtatgtttgttttgtgttgaaaatgttactatatttttctctaagcttgatcaaacttaaaaatgtttgactaaaaaaagtcaaaactaacggatggagtagaagtgagatcgatattcatgcataagtcaggctgtgtttagttcacatcaaaattgaaagtttggttgaaattggaacgatgtgacgaaaaaattaaaagtttgtttgtgtaggaaagttttgatgtgatagaaaaactgaaagtttaaaaaaatattttggaactaaacatggcgtcaacaagttaccatccgatgaagacaatccagttgtagagagagaggtagagcctccgcacccctgacgcattccctgccattgcaggaaatatgcgagatggaagaaaacgtcgagatggctgatggctttgaccgggatactctactcctccaagatgtacaagcatcacactatcgcaacatcagaagcaccaagatacaagtttgagcatcttaccggttggggattatgtatttatggggctatgggatttgattaataaccacataatttggatcaaatcagattagcagcggacagttggcagttaatgctactaaaactgccagctaccccgccaatttcgtccatgtgatcaaaacatttcgggtgtgtttggataatgggaaatgtggggtgggattgagattgagaaatgaatgaagggttagtattaaatagaagagggagaatgaatggttaagatttaaagatgtcttttagtgggtgggaaattatttccctatcccattagccaaatagggccttcgtcacaacaaacaagaacagaacataataaatactagttggcaccccgcacaaatcaatgctttaaatgattagatgtaactctgtgtatatacaaaatagattataatgcggctttttatatagcttctgttataacaatacaattcatgttttattttttgaaacatcattgtgtattgttatgatatatgaaagttattttcatgtacaatttggatatcgtcacaataaggttgtgtagcacttatctgcttcatctcaagcatgtttcaaaaatgagtttggattaatgatatctaattattgtatgttatccaattgtttataacaaaacaaagctcacatcttatataataattggagttgtattttttttttgaaaaagagtagtattatctttgaggatttggatgtgcacactggataacaatgtcacgcgcgattatgagctaaagggaggtgaatggatgaataatcaatgattaaattagatggatgagtagctagcttcttgatccaacggttgataactctatactaatgcgatccaatagcttaaaattattgatgatgtggctacttgcatgtctttctttataggagtaaatgtttcttagtgggtactaactctatatatatatatatatatagaaagataggatatcatctgttgtttctcattgtgccttttcttttctcattttcattttcaccggtgtaaatgtaagccatattatactcataactaggtggcaggaaaagttcgttaacaagcttgattcaaaggtcatgttctttctttttgacggaagaaggtagagctggctctactttatagccatttcatctatagaaatgaggtggtacaaagttaaaaaagaaaaagaacaaatagaaaggaggagaaaataaattacaaaaattacaagtggcatttacatattaaggatctaattgtaggagttgacaccaagactcaatcttagacttggtaattcctttagctcgatgagtccatagttcgagggagctctgtatttgctgcagcaagaggtgtagcgaagtgtgaagcttgtcgaaaaccctgctgttgcgtgctttccataaggtgtatgcacaaaccgcgaaccagactggtccaataccgtgagttgacaagtttacctggtttgccttgattatttctttccataaggtgtatataaggtcatgttcttttaatcagtcctcggaaaagaagttcctttactatattctcaagaacagataaaaacatgtatagatatgttcgaaaaggaaaaagtataaagaagcagctcaatagcatgtatgaatcgaggtccagttaacatcaacaaccatcgtaagtggtaacatacatagacatgtactacttctgaagaacagttcacattaacaactccccaacatcgaactgctaatactgtttatctaattcatgtgttaagtgttaaaaaatggcttcaacttagaccttgtttggtaggactccaaactccaactctcaactccaatggaatagaaagtgtctggctagattggttagctccactccaccacatcccttgttgtcattttaccgaacacctggtaggcgtcgcagctgctgctcagcccatgctccaccgatgccgccgcctgtcccaccgtcggcggtctgctcgccggtcgccgctgccgccgaccccgcacgcgtgccgaccgcgcgccgccgccgccacagcacgcgcgccggccgcgcgccgccgccgccacagcacgcgcgccggccgcgcgccgccgccgccacagcacgcgcgccggccgcgcgccgccgaccctgcgccaccgctcgcgcgcagccgccgccgccgctgctcagcccgcgccccgtcgccgctgcttgaggccgatgcgtcgccgcccgccccgcagccagccgccgccactgccaccgcacgagcgctgccgccgcgccacccacccgccgctgccgacgccgacgccgacgccgccgccgccgccgccggcctcgaccgaggaaggaggatgaggagagagaacgggaggagatggggtaggaactaggaaggggtagttcaatggcattttggtgtaaatacactgaaattttaaagggtagtgggtcttttggggtggagtagagttgtagagcagcaaaaacccagctccacccccatagtacaattttgtggagcagctctgccaactccgctcctaaaaatagagaatctggactgtttggcacagctccggctctagataagttgtagttgggagctgagctagagcttggctctgattatggaaaacatgtgcgtttccctccttcaaaactatccagcagacaagcaacaccagagtgtcgaaagcgcccttgtagctggtccgaagtccttgccgcgtttcagccggcagttggaagccaattccagcccaacccttgatcatagggcaggaaacaaaaagatgctcacagtcctcatcgctgctcatgcaaagtgagcaaactcgctggtgcaatcatccgcgcttactcaggttgtcagccgtcagacaacggcctttctccgccaactacataaaaaacttaactttgacggcgctctcgtatgccaaataagtttaccacaacacgccaaaatgagcttagctttaacgtgaaccaattgaggctttaacagttgactagaatcccagattcctcagccaattgatgtacacgcatcagaagctcttaaatactatcagcatcttgatagtgactagctcggatcgggattggagtcaagttagtcactgtccaaattgatttggcattgcagtggagatagaattcaacatcttggtagtgacttgctcggattgggattgtagcaatcaatttgtagccacagttcaaattgatttggcattcagtggagatttaactggacagatggttgagcagcgcacagttgaacttattgccactgcaactgctcgccaaactgccaatatgattcatgtgaatatgtgatcagaaaattgatttggcattgcagtggagatagatttcaacatcttggtaatgacttgctcggattgggattgtagcaatcaatttgtagccacagttcaaattgatttggcattcaatggagattgaactggacagatggttgagcagcgcacggttgaacttaggccctgtttagttccaaagtttttttttccaaactttcaacttttccatcacatcaaaacttttctacacacataaacttctaacttttccgtcacatgacacatcgtcccaatttcaatcaaacttccaatttcagtgtgaacaaacacagcctattcccactgcaactgctcgccaaactgccgatatgattcatgtgaatatgtgatcaggaaatttcattgcaacagcgaaaagatagcacgtgattacaagtatacaacttctctttctcattcagcttcgttttttccctgttcttcttcacctgtacatggagtacaattttttggcatcatctaagcatcatttttcggcattgatatggagtacaatttttttcttcagataggaaaaatgcttatgtttggtacaacacaccattagcaagtcattcttttctttaccaagggaaaagataatccgtgtattttagcatttccattctagtagtaacctttacttctttattcaggaaatggtagcaacctgagccgtagcttcgataagaaatcagattccatagctcttgagtagttatgtggtttttgcctttgacaaggccttcttccgctgcgcgatcatatcatatggtgaaacaagtatggaaccactgcattcacgaaatgaaacagcaaggcagtgtgccgtcaaatcctagtttgacaacaaccaactacttcgtccgtttcatattataagactttctagcattgcttatatatatatatatatagagagagagagagagatatatgtgtgtttagatttattaacatctatgtaaatgtgggtaatgctagaaagtcttataacctgaaacagaggtagtgtttctttgacaatctgtaaaggcttaaacatttcagcatttggatgatccacgatatcagtgtgacaatgtcagatgcaattggctcctttcactgatccacccctactttcatgaaataatatccagaaacagttacagggcaccaatatgaatcaaatggtgatagcaaccttcttcatccttgaaaagcagaaaatctacacatcattttttggcatcgatatggagtgcaattttatttacatatggaaaagccaaagtttggtacaacacaccattaacaaatcatgaaaatagtactcatgtccatttttatttaccaagggaaaagatagtctgtgtagttcggcatttccattctaatacatttttacttctttgttcaagaagtggtagcaacctgagctgtagctgcgagcagaaaccagattagatagctcttgagtagttatgtggtttttgattttgccaaggccttcttccgctggacgatcaaatagtggaacaagtgcgggtatactgcactcatccaaatgaaacaacaaggcactgacagtgagttagcaaatcctacttgatttcctttcagaaaatcctacagctaactttctttaagaaaaactactaggttatataatcaattactaaatgaagtataattgaagggaaatactacctggggcatacaaagccatgaaaaagacagaggcatagaagtatttgatggagaaattccatttgttgggcatcctaaggcagtatttctcagatgcctgatattgctcatccaaaagaaaatagtttctaaacaagattgttatcaaatggaggcggagctcttcctttctactaagttattcaaattaccttcatgaaaggaacaacaatgtagactaggccaacctcactaaccataccaataggaaagcatactatgaaggtgctgtacctgcaaagaaatcagtatgaaaataataagtacttatttttaagagaattcacagataatgagtttcatttgaagtttgcgctacatattatgatctgtttacagctagaaccaacctaagccataagagccaggaaggtgtaaatccaaatgactccttcatgccattgaaagaatatctggtaacctgcaaggaataagtttttttttctacaaagtcatgctctgtagtgaagaaattttcataatctttgttcagctaagctcaaaacaggaactttcaaagcttggcattttctttcaggaaaacaactactatcattttaagaagcagaattataataaaattgcatccaaaattcatggtcttccaagtgagtaatttggtcaaaagttttagggagtaacatacctcagtgatgcaccagcttatgagcaaggaggtaacaaaaatatgagtgtgtatctgcaaaacatgtggacagtgattcaccgatattgtttataaacaaaacaattacttgatgagaagttaaaatacaggaaataggaaactaggatgctgcggaaggaaaggacactattttatccttctccacaatgtgattgcatcagcttcattacttatgcaatttctgccgctttggtttgaccaatgcctactcagagtcattacgaaagtatgggatatgttctaatagctgaaacattacctaacatatagtatgttttgtcattttaagaagtgctttctaatccagaacttgttttgaagatagaaactatctaataacttgggagtaaggtcctgatattacctcagggaagctccgcaagatgccccagatcatgaacaaccttgcagtaatttgtggaagagtagaagacactggagacctcaccaacccttctcaacaattaaggttacagtaataagaaaatattttttgggggggaactaattgagtctaacaggacacttcctttctctccttaggaagaagctaacaagatgattttctcaacattgaaacttctctagatgtattcaaattccagactattgctactatcataatgatttcaaatgattgaaaaagaggctagaggctacatattacaccacacaaatgtgaaagttagaatgtttaaaaatatatatcattattttaatggaaaatcgtagaaatattgttcagttgtcaaaaatcatagaaatagaagcatgacggtcttgggttgtttgatagggaccttctaggggaggccgacaagcccatatcagacacatgtggaccggaaagtctgtcagcctaactccacatagtcccatcaaccagctacaaaacgacaggacctgccacgccacctatcgatcagctgcagactgacctggccaccacaaaacatatcggcaaccgcaggtctacatggcacatgcatggaggcctgtcgtccactgggaagccgattggtccacatgagggcctgtgcatttaaaccgtgtatgcagctagtttcaactccctgaggccatccccaaccctccatgtcatatcgtgtccatagcattaaggccatgtttgattcagcttaggattattataatctggattattaggaataagctaaaacaaacatatagctcattatgatagattattacaatctataagccatattactataatctagtaatccactctaaaggtgcttttttagattattgggtggctaacaactaaaaaacaacttataatccagggaaacaaacagctcgcagcttattctatggcggcttattataattcagcttatagtaatatggttcaataatctagattacaataatcttaagctgaaacaatcaggacctaaatacattgtcacataagcaaaaatttgatgtggcaagagagttaatgaggaaagaggtaaaaagatgaagaaaccatttctcatgcaaaaaaccatctctacacaagaatcaagaatgaaaacaagaggataggtggataaaaggagagagaagagcgatgattggatgagaatttaatttgaagacaccatctattggatatatagtttctatacatagtatctatatgacatggtaagtatggaaactacttaatagtttctgggttggggatggcctgacacatgcttgaatcaggtaggctagatacttcctccgtgccaaaatgtaagtattattgaggttgtcacaggtataacgaaagtaggtgagaataattatagaaagtgtgtgattggttgagaagagaaagtagatgaaacataatggttgtgattggttgagatgaggaggtaggtggggaaatagttttattttgggacaaggcactgtgcaagaaatagctacatttaggatggaggtagtagcattttaatccatgagtgcatttaatccgagtgtgctagcagaccgctccaccacgtcacttttttgaattggcatagggcctgcattatttttggaaggtcgcctactcccgacgagggagtatcgatcagctgtgggacgacgaatctttgctgttcttcggtgggacgacaagctacaatttccaccatgcagagccaccagattcatgtaaactataaagtgtttacatgacttggatttttctcacgccagctaagcctgtcggcctcccccagttcgacaagtcacctattgagcaactataattcaatagggttctatttttgtgacttccaccaatcgagcaatatttctgtgattttcctttaaaataatattatttttaaattatgcatgttttaataaaaaaaatatgaaagtctatatacattcatcaaaactacagcatatcttttgttgtgcacataccagtaattaccatctaccacgatctaattcattatgaaaaaccaaaaaacaacatcaaggtaacccttagacctaaagtgtttgcatgattaacaatttccactctgaagagcccccagattcttatgtatcttttaggctcaatcacatatcatttttaatcccttcgtttgcagtaaaaagtcaaaaatgaaatttaatgtggtaccccatgttgaagttttgtcatcgacatattatatgtttttctgcaaaaaaaaagacaatgtattgggaagaaaataagacttattttctttataaagagaaaggatatctcacctacaatggaatgaagaatctgcactaccagtatcaccatcaccaggcaaacagcaaaacaaaaaaagtttagcacctctcaatctccatgagcaatgaaacaaaaaagttgtacagctgcatccaaatttacagttttactactataaaggcaacaagagaaaaaacaaacctccatgatggcagcagtctgcgcgaacagcagatgctgctctacagcagcgtagacggcctcatatctcttctccaacaatgccaatatcatggaccacgacacctgaaccctgcaagatccaaatcaaagagccttgatcaaaacaacaccctgtacaatccaagaattgaccagcaaacaaagatgctggaagtgagatcgatattcatgcacaactcaacaaacagcaggcaatagaactgaccatccgatgaagacaatccagttgtagacagagaggtagagcctccgcaagactgacgccatcccctgccattgcagagatatgtgagatggaggaagacatcgagattgctaatggctttgaccaggatactctactccaccaatcgatgtacaagcatcacactatcacagcatcagaagcaccaaaatacaagtttgagcatcttacagcagcttcttcgggcatggttggggattatggggctatgggatttgattaataaccatataatttggatcaaataagattagcagcacacagttggcagttaatgctactgcaactgccagctaccctgccaattccgtccttgtgatcaagatactttgtcacaacaaagaagggcagaacataataaatcatcagccgttgtttcttattgtgccttttcttttctcattttcattttcacctgtgtaaatgtaagccatattatactcataactaggtggcaggaaaagttcgttatctgagaggccacaagcttgattcaaaggtcatgtttttttaatcagtcttcagaaaagaagttcctttactatattctcaagaacagataaaacatatatagatttgttcgaaaaggaaatggttgagcagcacacagttgaacttattgccactgaaactgcctgccaaactgccgatatgattcatgtgaacatgtgatcaggaaatttcattgcaacagcgaaaagatagcacgtgattacaagtatacaacttctctttctcattcagcttcgttcttttcctgttcttcttcacctgtacatgtaagccatttcataagtatgctttatgcgtgaaagacatgtatagatgcctaagagctaactcaaacagctgaacagcttatactggatacacatcgatggcctgttaacatcaacacagttatcagttatgagaattaggaagaggagcaccatcgacaatttttcaagtgataggacaattgccaaatgtcgacaatgagttcaacaaacgggacagaaggccttcatccccagccggagaaacacaccgaaaacaacacagatccactaatttcatgcagaaattgattcacggagccttcatctgcatgttcatgcttgcactgtactggaataaatatttccctctaaaaacctccacgaattaactagattcagtagacgaaccaactgaagattcagtagtaagaacggtaccctcttaccccaccacatcggagccgccggccgcggccatcctcgccagtggcctggcctccgaatgcgtttcgaactcgtcggccggagactacgggcaagagctcctcgtcctcccgccacaatccactccgcgcgtcggtagccatggatggactacggagccattggctcgaacaggagaggaggagggagggggtgggggcagcacggctgcgcgagcgagagtctctcgccggcgcgccatggaggatactggctcgggaagccagagacggagaagaggaggggattgcgacggcgagcggcggcggcggcggcggcgggtctgccaacccatgaggctgacgtgtgggccccaccgcgccatggcccacctgtcagtaataccgacaatgggctccacgagacgttcgatcacagatgtgcggcacagatgacaaatttgactccacaccaatatgggctgtgggccgcgtgcgactggaagcccaagttatgggcctaaattctgtatgggccaggaatgctactgccgtatttgggcctaatgctgacgataggtagggtaattaggggcttgtttactttgatgtcaaaaaaaaccttaccaaaatttggcattgttgctaaaattttggcaacttaccaaaattttggcaggatttcttatgtagttaccaaaatttggtagcaaactaaatgtaaccattttttttttgtaactttactaaaatttggtaaggttgaaaatagcatctaagtgaacaggccctaggtttcttttgtacggagtatttattattttcttttcaaaaaggtgttcttttaagaaaattacttcaccgggtattttgagtgcacaaatagaacatgtatgctatgataaaaataaaagtggcattgtttgcatactccttccatcctaaaattgagcatcacggtactagagtagacccattaacaatagttgtgtctaatgtagtactattagattaatatatttaaagacggaggaaatactttattagtattacttatgagagcatagggggcacaatgctccaacagtttttcaaacaaaagatatgcttcactgcccttatctgctatcgacatcagccgtaccgtgttgaccgaaagtcattgatttttaccaattttggatcggttttcagtaaactagcgaggaacaattttcactttaaaaacgaaaaggtaaaccctgtctatacattggaaggccattctcattcaacagccaactatggcttaacaatctgcaaaaaaaaaaaaaaaaaaaaaaaaaaaaaaggctttacacatttgagcaatcggatgggtccatggataagagtaggaagaaatcaagaatgatcagacgcaattggctcctttcactgacagttactgcacatcaatgtaaatcaaatggtgacacttcttcttcatccttgaaaagccgaacatctaaacatcatttttcggcattgatatagagtagtacaattttttttctccggccgggagtacatatttttccttcagatgggaaaaaaaaaagcttatgtttggtacaacacaccattagcaagtcattcttttttaccaagggaaaagataatccgtgtattttagcatttccattctagtagtaacctttacttctttattcaggaaatggtagcaacctgagccgtagcttcgataagaaatcagattccatagctcttgagtagttattgttaaagggtatatgtgtcttttcatctcttgtatacattatatgtggtccttgaccctaagtcaatagtacacagcaaattccccaaatttatctatcactggtatcagagctcatgggctgaaccctatgtcacaccctgaagtttccccccttttcttgctttaaaaattggttaaataaattgcccgaagaaattatcttaattaacctagagctaaatccctagttaataaatgcaattaataatcggaaatagcgtggtggaatttttcttgagttccccatgctccaatgcattaataagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgcgttcagcctccttcctttgggccggcccgtttccctttcccctctctccgggacgctgacaggtgtcgtccccttcctccagccgcccgccccacgacggcaaccgccgccgaaaccgtccgcgccgccgccttctccgctccacgccgcgcccccactccgcgtccccacgtcgccgccctccccgccattcccgcccgcacgcgcgcccgcaaatgggcgggattcgatttgaatcccccccactctctctctctcccccacgtcaccggccaaatcgagggggtttcccggccatgtccgcccctctcgagcccctataaagcttccccgtatctccctctcccttttccccttttcgccgcgctctcccgtgcctcctaccgccgccgcgccgctcgccactagagccgccgcttgccgccacctccagtcgcgcgccgcagccgctagagccgccgccgcgccaagccgccgccgccattagcattgccgccgcgtgagccacctcggccgccgctcggtttccgctaaaccccaccggagcccggttctcctcgcacaccggtgagctatccattctccttcgtctccggccaacaatggtggccgccgtggtcactctctctactcctaatccttctcaactccctccgtaggtgccgccgccgcccgtccgcccctcctcatcgccaggtcgtcgccgccaccttcatcctccgctccggccgccatactcgccggtgaggatcccctcctcctccctcttcccctctctctcgtttgcgccgcctctctccacgcgctcgccatcgccttcggtcgatgccgccgtcctgtaccccgtccgccgtcgcttcccgcgccgccgattgccgtcgccggcgaccgtgcgcgtcgccgccggttgccatggccggccggccggttttgaagccgagccgagccgtgcctagccgccgctgtgccgtccgatcggcctcccggccgatctggaccgtcggtcccgtggaccggccgtggaccacccgcgtggtcccggtccacggtagaccggccaccttgagccactgcccgtggggcccacatgccggcgcccccttcctctcccctttgagccgctgacccgtgggccccgcctgtcggcgccgccccccccccccccttggatgacgtcagccctgggtattattgcgcaataattaattaaggactttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgtggtttctcgaagacgttgctgaggtctcatcagttcgagagcaaggcaagtcatgcaatacgtttgatcatattgtacccaatttaccaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactattggcataactttagattggtgccaccgcaagggtgtcagttaattaaaatattctgaatggcgggctgtgagtgtatggttttgctggtcgcacccatggcagttaaggaccggttcacgggaaaccctgggagacttaccgtgcttaccacaagcgggagtaggtaactgcttgatctgaagtatagctcgaccctttcctaggcaccggtggcgagggtaggcgtgatggagttgggtcggccgaggtgttcggttgtccagctgccggattcaccgcggcgcaagaggggaccgcccactgccttttgaggggtgggggtgaaatcttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcagttatgggcgatcaaccagattcaccgtgattagtctcacccctagtttagcttaatgaactggtgtagttcaggtggttggttgggcctgttgcaacgtggtgtagcgttggacagtgattggttaatattgattaattactacaactgttttactgctttcaactactgctttgaaatgcctgctttatgcaaaagaacccctagcttcctttggttatatcctgcatcatacctcatcttccggtatgacttgctgagtacagtgggtagtactcagtcttgctctcttttcccccataccagagttgaagttcttctcagttggagccgtctcagagaggttggtttcgtcgctgccgtcaaggtttgcctgtggagtggagttgcccgctgctgaagtcaagcttcccggtttagctcgcttttatctttcccgctgcatttgtaatcttttatatttttgtaagacgtgggtctgtatgtcaacaattgtcgtttatgtaccctggctggtcctggatagggatttaatgcacattcagcttagaaattctggttcgagaatttctgggtgtgacaccctagccctcgatccccgtcgtccgccggcgctccggcttgccggcggcggctccctatcgggcaaatcttcttcacgtcctcctcatccggatcagcagcgggattcacagcaagtcagtgtgattcgtccatcacgcgtgagtgtatcgctcattgcagccgctcgtcacgcggttcctccgctcagccgttgttgctgctcttccactactgctgccgctgtgtgctgctggtgctaattcaggagacaatacatcaagtcttgcaagcaagtctctgtccagtcaatttgtcaaattttcttctgctggtcttgatggcaacatccgacccctttcttggaggtggagctttgctctccacggacattaagctaaatggtcaaaattatcaagaatgggaactttcagctcgtatgcttttgaggtcgattggtcaagcatctcacctcacagatgatcctcctgatgagaaaacggatgcaactaaaattaaggcgtggaaaacagcagatgatcgtgttatgggattcatattcatgagtgtagaggtgcctattcggatgagtttcagggatcactcaaccgctaaagagatgtgggactacctcaaacagaggtacactcaagaaagcggagctttgcgtttttccttgctgcagaatttgcacaacttacaacaacaagatcagtccattgaagaattttataatgcctttactcggttgtctggacagcttgaggcacagactccaaaaggtgcttcaggttgtgcacaatgcaaggcgagagagaagcatgatcaagaaaatctagtgtatcaatttgtcatgagactttcctctcaatttgagtccattcgagttcagttgcttggacgtcctacacgtcctactatggcggaggctcttgcagatctaatcgctgaggagacacgtctttgttccttggacactactcctactcctgtggttactcacaatgtcatggcagcacctcagcgtgttggagctcctatgggcgggatccctgaattcagttccatcgccaaaagtgatcgtatttgctctcattgcaagaaggttggacatatttccgatgattgcttctatcttcatccagagaagttggctgattatcgagctaggcgtgcagcggtcccccgtcctcgtgcgacggctagtgctcctgttttcttggatatcactgctgctggtccttctagtaccagtgctggtggcagtgcctctagcgccgtctcatgtgctcctcagtcattggttgcaagaccgtcttaccaagccagtgattggtcatggccatcaccatagttggtccccaaggcctctgtcacgccccgaactagtaccgaccggaactagcccgtgacgctccaaattaacctgttaatcgataccagtcccaggaaacagtgctggtatcacaggaagacggatcatcacagcaatagaggtctctttattatagagtagaggtacagtcatgttgggctgcggacagatcccgagctcacaactgcattacaaaagggaaacggaagccaggacttggaccaaacaacacaggcgcgacttgggaactaggcagaaaccctaaaactcatcgtagtcggcttgctcctggaagaactcctcattagcaggttccgcttcatcttcttcagcaactgggggagggattatttatatagagcaagggtgagtacgggagtactcagcaagccatgggaaataagtgtttaatataggtttcaaggaaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgaaacaaggttggcacccggccaacaacttttcaaacggccacccgggccaacaactttcaaacggccacccgggcctagctgatcccatcagctgcagatctttcaaacatcgaacccctttccacaacagcaatttcacaagcaagagtcaaacaagactacgctaggaatcacctcacatccgcccatgaccgtgggcacggctgttcgaacagtttgttaacctctgcagagggggtacactttacccacacgacattactaacccggatcacccagcccgtggggattagccacgtcgggagacctccaagctttcatgacaaggcatttccaaagccaacacaggtttatcatatgccgacgagaggggtcccagaccaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagttgttattcagattttaagtttggaggcgtccgtcgatacttgcacaggatgcacgaatatcgagacgcaactagatggttacaaggggacatgacataacaattaacaaggaaggatcaaatgcaacaaattaggtaggtccgccaatctgccttgcagacgggacaacagattaagtgcgatcctatcaatgcataatatttttcaagtaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcatgccattagatagatctcgagatttgatgaattttggaagttgaacggagtcaaacggatttacggttgggaagatattgaatttctaagattattggatttttggtctaaaggaaaaggatttaattaaatcctttttgaaaaaaaagaaaagaaaagaaaagagggagggaaaatagacttttcctcgggcggctagggcgcggcccaagggaaatggagcggaccggcccaaggcggcccaagcgcgcgcgcgggggaggggaggagggagagggccggtggaccgggctcaccacgcgtggtcccaggtgggagccgcttgtcggtgacacggttcaccgtgcggagcgagcacgcggcgcacgcgcgtgggcggggaagggatgtggtgcacgcgcgtggttcgcggtggaatggatgcggcgggcccacgcgcagcctcacggctcgcggtggaacgcgcgcatgggaggggctgaccggggtcggcccgacccgattttggccgagctggcgccgacgtggcgcctacgtggctgccacgcgggctggcgggaggaagacgaaggcgccggccgcgaatggacggcgggcggcggcggtttctccggggcgtcttgcgacgatgaggggtgacggggcgtacaccgggatgacgagggagaatgagagggagcgagccaacggcttggattcgccggagggagtccgtcggcggcggattgcggcggcggtaaccggcggagagcaaaaggggaaaacggcgacgaggtcacgaggggccaattcccggtggtgagagcatctacgcggctacgggaatccgttgctagcgtcggattgagcggagctacgccgagcgaggccggcgacgagcgggtgctacggagcacgggcggcgacggcggcgagcacacggcgagcggcggcaatggtcggggcggcgccggcttgctacggggaggctactcgtgctactaccgaaaactaagggggagagatggagcgaggagggagaacgaagggaggcactaccgagatgaggaggggcgctgtgacgagaggccgacggctcgggagtaatctctccggcctcgggccggggaagaggaaggagacgagcgcccggagtccccttccgcgtcctcgctcgtgccggctcctccgacgcgcgcaacgacgaacggcgacggcgaaacagaggggcggcaacaatggagtggaggcgatgggacaacgagagaagaagagagggagggcgcccggggctttaaagggcggcaatgtcggtttggaaaccgactttgggcggtcaaggcgcgagctggcgctcggcgctcgcgtccaaatcggcgacagggcggagggaggatgacgccggcgggaggaaaaaggggaaaatgagggagagaaagggggcttgcctccttgccgctttgggaaaaggaggaggggagcgggggcgtcgcggcagagggaggagggctctgcctccgtcccttggcggcttgcgcgcggagtggcggggctgaggcgatgacgacggcgatgacggcggggcggtgtggagcggagcggcgacacgggcgacaggcgcgggcaggcgctgacgacggcggcgaccaagcggtcggccaccacggcacgcgcgcgcggcttgcaacgggagacgcggcggtttgagtggcgcggctcgggcacgcgcgctggctgcggggccgagcggctgcaggcgcggcagggcagcggggccgggcggcgcagacggcgcaggcgcgacgcgggcgacgaccacgcgggcgcgtgcgcgaacaacggcgcgcgggggccgggttcgcgggcgggcagctcgccagggatgggcacaaggagagcgagggggagggggcgctcgcgcacgcgcgggcagagcgaggggaagggagcgcgctcggcgcgagcggtcacgcgcacgcgcgcgggcagagcggaggaggagggagagagagagggagagagagagagagagcgccgggagggaggggggaggtgggccgagagagattcggcccatcgaccccgggggaggcaaaatagacttttgtggagggatttgatttggaaggatttggattcgggattgaactcgacgatagatcggggatttgagatctgagatggcatggacactagacaacaagcaaggaaacaatttcgcaattagggtttttaagagataatttttccgctaggcgccacgacggaacgggcgctacagcctctaagtgtgaggtcatcttcgcctaccacttttgctgccatctcctacttgttgcttttgcttgctgtttggagaaaaaggttgttgctgctatagtatatatctgtccttcagttcagttcaagtcttctgttatccgtcaaatctatccaagtcaatttcatatcttcaatttgtctaagtgtatgagtcttttatatcatcaccaacaacaacagcagctcccaccggagctggattgtctcaacctactccaaatctttgaagagccgaagaacaatttgtgaaggcttcatggtaccaagggctgaagaacagtttgtgaaagcctcgaggtccacttcattgaggaggggatgcatctttcctacttaatcatcaagacttacatgcttcgacaatatctttaagcttatattttggttttagtttagttgtaccttccaaatgtattgttgtatacacattgcatttgagtgggggtgttaaagggtatatgtgtcttttcatctcttgtatacattatatgtagtccttgaccctaagtcaatagtacacagtaaattccccaaatttatctatcactgtaagagttatgtggtttttgcctttgacaaggccttcttccgctgggcgatcatatggtgaaacaagtatggaaccactgcattcatgaaatgaaacagcaaggcagtgtgccgtcaaatcctagtttttttttaaaaaaaaaagatacttgattatatcatcaattactaaatgaagtacaattgcaggaaataaaatactacctgggacataaaaagccatgaaaaagacattggcatagaagtagttgaaggagaaattccatttgttgggcatcctaaggcagtatttctcagacgcctgatattgctcatgcaaaagaaaagagcatttgaacaagattgttatcaaatgcaaccggagctcttcctttctaagttattcaaagttaccttcatgaaaggaagaacagtgtaggctaggcaaatctcactaaccacaccaacaggaaagcatgctatgaaggtgctgtacctgcgaagaaatcagtacgaaaataataagaattacttttaagagaattcaatgatcagataatgagtttcatttgaagtttatgctacatattagtatggtttgtttacaaccagaaccaacctaagccataagagccaggaaggtgtaaatccaaatgactccttcatgccatagaaagaatatctggtaacctgcaaggaatcagtaattcacttcattctctgaagtgaagaaaatttcataatacttgttcaactaagctcaacacaggaacttccaaaagcttgggattttctttcaggaacttcaacaactactgtcatttcaagaagcagaattattccttatcatcttataataaaatttcatctgaaactcatcgtcttccaagcgagtaatttggtgaaaagttttagggagtaacatatacctcaatgatgcaccagcatatgagcaaggaggtaacaaaaatataagactgtgtctgcaaaacatatgtggacagtgattcaccgatattgttcataaacaaaacaattacttgattatagaagttaaaatataggaagtaggaaagtaggacgcagaaggaaagagcactgttttatccttttccacgatgtagttgcatcagctttattacttatgccatttctgccgctttggtttgtccaatgcttactcagaggattatgatcataaatgaaagtatggatatttctaatagctgcaacatcacctaacatctacttcccccttttcatattataaaactttctagcattgcccacattcatatagatgttaatgaatctagacatattgcccacattcatatagatgttaatgaatctagacacatgtgggcagtgctagaaagtcttataacctgaaaagatagtatgttttattattttaagaagtgctttctagtccaggacttgtttttaagataaaaactatctaataacttggagtaaggtcctgatattacctcagggaagctccacaagatgccccaggtaatgaacaaccttccagtaatttgtgggagagtagaagacactggagacctcaccaacccttttcaacaattcagattacagtgataagcaatattttttggggtaaataattgtgtctaataggacatttcctttctctcctaggaagaagctaacaatatgatcttctcaaagttgaggcttctcttgattttattcaaattctagattattgcttgtatcataatgatctcaaatgattgaaaaggaggctagaggtaagctgagctacatattatactgcacaaatgtgaaagtagacacattcaccaaaattacagcatatcttttatcgtgcacataccagaacttaccatctaccacgatctaattcagcatgaacaactaaaacacaacatcaaggtagtaaaccttaggccgcctaacaatgaagagctaccagatggtaattagccttttaggctcaatcagaaatcctttttagtccctttcttttgtagtacaattttaaaaataataataatagaatgcggtagcccatgttgaagttttgtcatctaggcattgaacatatcagtatgctctacaatccagattaagggttggaagcctgtttccataaagtttgcacaggacagacataccaagcaggaaactacacttctcagttggcaaagatgacaaaaaacaacattcagagaagggggaaaaaacaagtctcttttcaacgaaggaaaagaaaaaaagatttctcacctacaatggaatgaagaatctgtaccaccagcaacaacatcatcaggcaaacaacagaacacaaaaaaattttagcacacctctcaatctccaattctccctgataaataaaggtaaagaactaggaaaaaccaggacctccaagatggcagcagtctgcgtgaacagcagaggtcgctcgatggcagcatagacggcctcatgtcccttatccagcaatgccaaggtcatgtagcacaacacctgagccctgcattgatccaaatcaaattcagaaccccgataaaaaacaacaccctggctgtccagcccatgaaatggccagcaaacaaagatgctagagggcaatgttttcactctcgcggcagtgtgttattgtagacgcgtggtgtggttgtttttctttcctgactatagatttgtatttttctcctgctatatcaatatatgaaactcaaaataaaaaatcgatatccatccagaaactcaacaaacagtaggcagttgaactgaccatccgatgaaggcgacccaattgtagatagagaggtagagcctccgcaccattgaaccatccgctgccattgcagagctgcgagagatggaggaggaagaagacttcgagatggtgcttggcttttaacatgatggattcatggctaatggctttgaccaggataatctcaatatctcatccatccaccagtcgacgtgcagtcaaatcgcactactaccacaccatcaggaattcaggacatataaatttgtgcatgatctgaccacccaaaagaacacactgagaacgaagagatcttcaactaagatcaacgcaagatttgtgtgcatatcacccgcatgttgcacgcagattctgcaagattcgagacgcgggcttacccagatccgatgggaggcccctcgacctgcttcatgagaggagcaggagatgtggtggcggtcgccggccatggaaaccgccaatttttttaaaaatatatatatacttttttttcacaccagttttacataataaatatacatgtttgaaaataatagcaaaaaaaaagagaatgcggtctggtgaattaattgatggaataattgttaattaattgctaataatggtaattaaacaaaaataatgataagttaattaatcctacaaggttgcgtactcaccgcacgaactcgtgatgacatcacaaacacgttacgagtttgcacactcatcacgtgaactcgtggcaaattcgcaccaccccactgtgataatggtatatttctgctaattcattttaaacatgtatatttccataaaatcaagtgaaaaaaatgtatatttttaatttttttttatggagacaacaagatcagactggtgattctgtgccgtgcactgttgtttgggggtttctcatagccgtttggatgatttttttttaggattgaggctcttgtttttttcacaagaattttagttcaccttaattgcaaaccagtaaatatgtcattttatagcactcaatgcaggtgtgcaactcagaagatataacacagcccaacaagccaacattcgacttgggatggttcgccacaagggagaagattgtttcccgagaggatacgacatgttggtcatcctagtcgcttctagcttgaatgttatgaaaggagcatctatactccttataaaaaggaatagtgatggtggtggttctgccaccaccccactaccaactctaactttttttaagaaaaataaatgacatgtggggttagagggtcacatatcgactactcccatcaactctttattttttgtgggaaggaaaaaaaatattgtgagcttaaaaaaagtccatatgtgagtaataaatatgtacaacaaattaaacaaattaagagatggtaataacatgttaatgataattttctttaattaaaattccattacaatacacgagcaatatgctggtaacaatagagttttcaaccggaaaggcaaggactggacattgctcatcgtggctattcgcgaggaggctaggctctaggtaaaagctagagcgaggatgacactctctaatttaccttttgtaatctaaggtaattgttgaccattgtggctaggcatgatgtaacataagttaatcttcttttaagagcattgcttcggtccttctttttgtaccgcaaggtactagtactgtgaggtactaaaatcctgtccgttggtgatgcccgatcgaatggtcacgattgcatggtacctcgaggtcctagcttggtcgtggggtgggtagctctagttagcaacggtggaagggtataatcgtattttcgcgtttgcaaggatgtttggatcggaggaaggtttagtcgagttggggaagggccgcagagtagcaaaaccctaggcttgttcccgacggcggcgcgtggcggaaaatacgacggcggcggcggcatccattttttggctgcgccgcatctattagccttgagtctcgaccccgacgtcttcccctgttgtttttccctttgcggcgatgacacctacgaccacggtgacgactcatgcagcggcagtgcttccgagatgattgcagatggggtcggccttgctgcgtgcctgcaaccggtgcggtggatggggtcgccctcctccttgagtttttctcccgtgtcgtgcggcggccccacctagcgtgagatgcagaagggttagcgcacgggatagagaagggatagcgagatagagatggatagcggaccacacgcgaaagcgcctcatgcccatcgtacccctcagcaatcaacagctggatgaagaccggtaccagaaagaaggacggaagaaaatctcgctatggtgatattttaggcctgatgctgccggtcacttgagcaatttttctttttgtattatactattttctttttaaaaaaatgatttgtctaatgatttcacctagtattttgagtgcacaactagaggaacatttacgataaaaatatactaaatgacattgtctgcatacttctttattgtgagagcacaggggccaaaatgctccaagaacagatctacagttcttcagacaatttgtttttttgccaggtcggccaaaggctggccgaccaatttcattaagagtggggatgaatcttcagacaacatatatgatcctcctttgcttctgctgctatacatcggaaggccattatcattcaacagccaactagtactatatggcttagacaatctgtgaaaatgatacacatttcagcagttggatggatcgatggataagagtaaggaagaaatcaagaatgactcatctaaaaaataataatcaagaatgatcggatgcagttgtctccattcattgatctggccccatttcatcacatccaatatggtaaatcaaatggtgacagtagccttcttcatccttgaaaagcagaacatctaaatatcatttttcagcatccatatggactatggagtacaattttatttacagatggaaacgcccatatttggtacaacacaccattagcaagccatgagaatggtacttgcatacattctaatttaccaagggaaaagataatccttgtataattgtattttagcatttccattctagtaacctttgcttctttgttccagaaatggtagcatcctgagccatggttgtgatcagaaatcagaaatcaaatttcgcgagtaatcgccatgactgtccgcggggtttagccctgctttcatttctcgttcttggttggttggggtccttccctggctaccgtggcattgtaatgccgttgtaacattttactgtattttcccccaaaatcttaatgaaattggtcggctaacctttggccgacccagcaaaaaataactcttgagtagttatgtggtttttgcctttgacaaggctttcttccgctgggcaaccatatggcgcaacaagtatggaaatactgcattcatgaaatgaaacaaggtagtatgccatcaaatcttacttagtttcctttcagaaaatcctattgaaaaaaacctagtacatgatcgtagcatcaattaataaatgaagtacaattgcatggaatactacctggaacgtacaaagccatcaaaaaagtagagaaatagaagtagtcgaaggagaaattccatttgttgggcatcccaatgcagtatttctcagatgcctgacattgatcatccaaaacaaaagagcatttaaacaagattgttgtcacttatcaaatggaggtagagctcttcctttctaagttattcaggttaccttcatgaaagggaaggcaatatagattaggccaacctcactaaccataccaacaggatagcatactataaaggtgctgtacctgcgaagaaatcagtatgaaaacagtgaagcaattttttttaagataatttactaataagataatgagcaatttttcgaagcttatgctaatacatattgtgatatgtttacaactagaaccaacctaagccataagagccaggaaggtgtaaatccaaatgattcctttatgccaaagaaggaatatctgatgacctgcaaggaattatagtaaattttccacgaagttatgctctgaaatgaagaaaaaaaaatcataatctatgttcgactaaggcaacaacttcaataactaccgtcatttcaagaagcagagttgttgtttaactactgtcatttcaaaaagaagaattgttgtttatcatcttataataaaattgcatctgaaattcatggtctaccaagcgagtaatttggtgactagttttgggggcaacacatacctcggtgatggaccagcttatgatcaagggggtaacaagaatatgagaatgcgtctgcaaaacaaatgcacacagtaactcaccaatattgtctacaaacaatggttacttgattagaagtttaaatacagaaaatagaaaacttggggtgcagaacggaagagaactatcttatccttcacgatgtaatggcatcaattactcgtgcaatttctgcaacttaggtttgtccagtgcttactcagagtcattatgatcataaatgaaagtataaaattagttctaatagcagaaacattacctaacatacttttttttttcattttagcaagtgttttctaatccaaaacttattttcaagacaaaaactatcaaataacttgagtaaggtctgatattacctcaggaaagctccacaagatgccccaggtaatgaacaaccttccagtaatttgtggaagagtagaagacactggagacctcaccaatccttttcaacaattcataatacagtgataagcaatattgttgtaggaaatagttcaatctaacaggaactacattagtattttctacattccagattgagggttagccagaaagtctgttaacataaagtttgaacaagacagccatacctagcaggtaactacaattcacagttgacaaggataacaaaaagaacatattaggaagaagaaaatgacttcttctcttttttttttacaaagaaaaaagggggggggggacttcgtacctagaatggaatgaagaatctgcactaccagcaataccatcaccagccaagcagcaaaacacaaaaaagtttagcacctctcaatctccatgtggaatgaaataaataaattgcagagctgcattcacagttttgcaatgataataaagctaaaagtgaggaaaaccagacctccatgatggcagcagtctgtgcaaacagcagatgccgctcgatagcagcatagacggcctcatgcccgtcatccaacaacgccaagatcatggacaatgacacctgagccctgcatgatccaaaaccaaagaaccctgatcagaacaacaccctgagtgtccaatccaagaaataccagcagacaaagatgctagaagtgaccatccgatgaagacaacccagttgtagacagagaagtagagcctccggagcactgaaccatccgctgccattgcagagctgcgagatggaggaggaagacgtcgaggagatgggtttggctttaacgtcatggctaatggctttgaccaggataatctaatcaacaaatccgatgtgcatgcaaatcacactatcatagcatcagaagcactaaaatattagagtcctgattgacaggcagcagcttcctcagacatggatgggattaagggaataaggctaaccactgttccaattgattaataagcatcagatcgggggatcaaatcggataaataaatagttggcagcacaaagtgacagtcattgctactgcaactgtccgccacccaaccaattcatccatgtgatcaacacatttcgccacaacaaagaagggaagaagacagatacatcagctgcttcattttcccttttttctcttttcatcttcacctgtgtaaatgtaagccatgtcatattaataaatcataactaggtggtagaaagagtttgttatccaagagatcacaagcttgattcaaaggtcatgttttttttatcaggcttcagaaaagaagtatctttactttattcctaagaacaggtaacacgtgtatagattcctcaaagagcatgactgacgcatctcaaaaacatgtaatgtatgcatcgaggtccagttaacatcaacaaccaatagcaatcagccatcgtggatagcaagaatgtagctacgaggaacagggagagggagagatcagcaactctccgaattccaattgataatactgtttcaacaagctcatgtgttgagttagtgccacaaattgcctcaacgaactggaaacaaggcagctgatgtaacaggggtaatatctgcgcatgatctgaatctgaacacaccgggaaactacccgagaccaactgaatccgcgcatgatccatgccatcagccacattttcgcacgcagattttgcgagattcgctgcaggggacttacccagatccgcgtcggcgtcgcgtccccgatcccgaactgcccccatccacgccactcgctgcgcctcggatcccatcagatggattcaaagccacagcagcgccacgacctgctcgaggacgacatggccatggactacagattactgaagagaagcgtcggatagtacgggggaggcgtgtgcggcggcgggttaatcaactgcgcatgaaattattttttgggggatttttcatagcgttttcgatggtttttgtaaggttgaaatttggctccttttttttcaaaagaaatttagctaactacttcaaatcatacggccttatcgtttgcctttatgtttatgtttactcgaaccgcttattagcaatttaaaaataattatgcataaaaacttttatattcgtgctcttagtgattcaaaagcaaatgttgtaaaataagctgtgaagagaaaatcacaaaatcaatttatttataagcataagtgaaacaatgggactcataattgcaaaccagtaaatatgcaaatatgccaattctctatagcacgcagtgcaaagtgtgcaacatacagcataacaggctaacagcaaacgcaaaaagagtgcaatttgaaacaagctggtaaattttggatcaatcattcaataatttaaccaggtaaaatctagaattcttggtagaagactacagttacaacaaatgatgggcagtgtaatagtagttctttccaacatgtcctcatctacagacttctactaaaagagtagcaaatgtgagctatttaggcagatccttaagccacaagtgacaaattcaagaaagctcttgagcatcaccattatgcagccttagcctttgccaatgccttcttccgttgggcaagcatgtaggtgaacatgtgaggcgatcctgcaacgcagtgttcttgtcagaacctatcaaatcccagttactaagaaacaacaattgcaattataaaaataatttcaatcactgaataaaggacgactgcaaggcaggaggggataccgggcacgtagacggcgagagaaagaatggatgcataggagaaatcaaaggagaagttccatttgttgggcatcctaaggcaatatttctctgttgcctgcatagcagtcacaggaaaggagcagttaaatacgcattacgcattatgcaatgagcctgaacaacatggagatcttcatttctgaagttcattcttgttaccttcatgtaaggcaaggcaatgtagattaaaccgacctcactgctgataccagtaggatacaataccataaaggtgctatacctgtacaaaatcagcaccaggtttaagaaaagaagttatgaaagaaaaagaaaagcattctctctaaatttatgctaaataatgatgtatcttctttactaacctcagccataagagccaggaaggggcaaatccgaatgtctccttcatgccaaagaaggaatatctaatgatctacaaggaaccacaaatatttccatcacgttatgctatcaaatgcacaatattttaaatattggtgtgaataagcttagcccaggagaaatcaaaattataatttggaaaatgtcgtgtctctttaagaagtgagtcttcaaaatatacctcagtgatggaccagcttatgaccaaggaagtaacaaggatatgtgaatgtgtctgcaagacaaatgtacaaagggatcaatcaatatatatgtcatgaaaccatgtgttaagctacactacaagcatacaactaacagaaaactagggatgcaaaagtaaagacactgcatttgcatatcagtaccagtagttatgccatttagtaacttgtacaatcatcaccattatttacttgatccacaaccagacataaaacagacaaactacctagtgtccagccctcatataaaaatcaaattatatgatccgtattttctatttagacaatgctttaaacccaaaattatgtcatgtttcaatgtctcggcgaaacagtaaatgcttaggagaagtagcatgaacgtagcatgtcaacacttattagtgatagtcgatgatacctctggaaagctccacaggatgccccaggtaagaaacaaccttgatccaatttgtggaagagttgcagagactggagacctcaccaaacctttaaaacaaagtcagcatgttatacaggtgataaaaatgagaagtgtcataaaagtgaatttataaggtacaattgtttctctaatctaacaggacacttcctgtaaattgaaatatgtctttggcatgctttctaacgagaaagtctattactctatttccatggagtttgcgtgctgcacgctatagataggaaccgtacaattccaaatgatgaccaggatagtgaaaataacataagtagaagagaagaacaacttcttacctacaagcccatgaagaatctgagccaccagcaacgccatcgccaaacaaacacaaaaatgctcagtacctcacaaaacacaatttgcaaagaaatgaaatatacatcggtcggcattcttcgccatcccggcgaaaaaaacaaagaaatgaaataaacatggaatgttcgttcattctatgttcaccgcggactcgttcagccgctccgtgcaaagaatataaatgcttccttatctagggaactacaaggaatataacacaaagtactgctagggcagcagaaatttttcttttctttttagcagaattatcgggggagaggatccccaccatcaggcagcagaaacataacaatgaagttgaattaattgcagtatattttgctataacactggtaatatttctctcaggctaaatgtttggttgatttttagaacgcaaaaggggattaatttttttttccctctgtgccattgctcaacaggtagcaaccctaattgggtagacggaaaattcaaaatgaagtcagagctgcccaaattatacaagctcgagctaaaacctactccctccattaaaaaaaaaaagacaaaccctggattttcgtgtccaacgtttgaccgtccgtcttatttaaaaaaattatgaaaaaaatttaaaaaataagtcacgcataagtattaatcatgttttattatcgaacaacaataaaaatactaattataaaaaatttcatataagactgacacagtcgaacgttggacacggaaacccaggtatgtcttttttttttttggacggagggagtacagttttactcgattaaaattcagaaataagtcagagcgcacagactagcagaaaaaccagacctccaagaaggcggcggtctgcgcgaactgcagcggccgctcgacggcggcgtagacggcctcatggccgctctccagcagcgtcgtgaccgcgtagtacagcacctgcgccctgcaagatccaagaaacccccccaaatcaagccaagaaaacgagagatccaaacaccagcaggcggcggcggcgcgaggcggcggagtaccatccgaagaagacggcccagttgtagacggagaggtagagccgccgcaccgccgacccgacgcccgtcatcgccgagcactcagcagcagctagcaaggaggaggaggaaccgaggaacgcgaggcctggacaaagatggacaaggacagtggcttggctttaatgggcgcgtggactgaatctactacgctgttgattactgctcgcattcgcatcagcagatcagatcagaggatgcaatcgcaatcagtaggctgcttgctccgatttgagaattccggtggatgggaggctggccaaccgaccaaccactgatcaaactgaattcgcaatgaatcggagtggatgtgggggtggcggtggcagttatggcagctgcagctgactgagccggctctcccgccaatatcatccatgtgatctgctgcaaattcagttcagtactgcaactttcaattttatcttcagaagagttcagacacgcaggttcagtaaaaaaaaatctctcatttctctctctgttctcaatcacaagtattatgctgttaacctgatggcctgtcaaaagaaaagaaattgtgtgtctgtgtgtgtatatcagcatctacaactaccagaattaatcagtgatacataggaagcacatcaagaaacagaataaagatgataattttgttcagctgttacatgagttgttttcaatagctttccaagtgatagaactgctcagccaactcaactgtctatcagaatatcagttagttcgactaactgaaaatgaaatagcctttacagaatgctcctctgtacttcacaatcatattatccaagacaatgttgcatgacctgcctacccaaacaaacaaacgaactctatagattacttgcattcttttcagctgtatgttgtattagattacaagaatggactttaaagaacaccataacttgactgaatacagaagatgaacaatcaattccaagctacaatgcagcagagaggatccccagttcggtgcagagtggctccagcccttcctcttccagcaaggaaagagcggcaagtccatagtaagaatggtagatatccgggaattgatcgtacaaaaactttgtaaaacctccatactgttgcaatggtaaacaagggcatacatgatcagtaaagatgcaacttgatcaatgtgagaaattaagctgattagagaggaagtcattacaggtgattggcaatagagcaaaaaacttcgcaaagcaccatgatcaatgaagcggtatgcaccgatgatctttaggacacctccaatcctgcagagtgttgattggcagcaagacagattacccaagtttgctatttgattgtcaggcaattagtatatataactctgaatggtgtatttaccaaaatgcatagcatgtgtcactggatttgttccttcttccttgaaaacctccgtctgccgcttgtctctatatgataatagtgaaaacagttaagattccctactagtaaagtcgtcctagtccttattaatcatttctaactaaatccgtttatgattcacattttttttactctacataagggagattttaaaaacaactggatggtgtggtgtcattgagcaagctgcacttctccatcatgaataaatgaaaattgaatggttgatgcatatatctactaaattagaaacatttaaaacgggttggtgtactgcatatagtgtctgtccagttttggaaatatatgttagtcctataaatcacatcaaagggcagattttgatggtaatagcagatatatatggttgagcagaatttaacctgaagacaccactccaggagcaagcgtacatcaattgatgatggttcttgtaaatttgatgccaaatcaacttgaatgaaacccatcaggcacaaagctgcaacagcacagaatgtccctccacctgactcactaacacaaagacaaacaatgagtacccataaccgactccaaaaaaataaaacaaaaatttagctgaattattgcattctgaaactctgaagaaaactgccacatgaaatgacaaactcagtaggacaagaagcacatcaaaggttaaaagaagctgtaccatgagattctgaaccaggaaccaagccaaagccaccatcgtatgactgcatgtggtagaaacaagaattaaggattttaaatagcatggtgcaaaacactggtgtctcaaaaccaagtgcatcaggaattgttgtaagccaacctggcaactaagaatgtattgcttggccttttccttgtccattcctgtccaatcttttagcatcgagcagattgcagctgagaagacaacacaagtgtgtcaagttatttcaaacaaagataaaattgaaagcatactaaatataaatgacagtgcaacccacctgcacagtatacaaagcgtaggtctgtttccgcaccaatatgagtaggcatgaagctaaaaaaaaaatgcttctcaagttggccaataagataatgcatttaagcggtgcgtggagtttagttgtttgcagaatggaaccatggaagccatcttagtgaaatcaatgaaatgctcacaggcaagcaagattgcattgcacatgcacaaacacctctatcacatgcatgcagttaggatcacagcacattaattaacattctgattgaacaagcttgaagactgaccaacaatacagagatataccagaaaggaggtatttaccaatatcaagtttgtcgaacgacatggcatgactaaattcatgcagagaaaacatatgcaaatggaaaggtagcaatcaacacatacaaaaaataatcaaggaggtgggccaactatggggtattatgaaatcttaagacagaatgtgagttggctgaaactcttttggtggtacagttaaaactaaacacaggtagcagatgtaaatgcatagatatttttggaggataattacaagaataattagcatggagaccaaaactaaaatgcataccttccatctggctgttggaggtttctcattgaggacaaaagaaccttgttatcaatgtttgctaaatcataacctacaatcttcaggatagcaagggcagaataagtgcttgcaagatgactaccattgtggcaagggtcctgaggaagggcatgaattcatatttcaaactgtcagaatgtaaaaattaaatgacaaattgatatgtgtgaaaaaaaaaagggttgacttgagaattagccacatctaccttcatgttagttgagggaaactgagttgttctagagccacagaatccataaaattgtcctaaaaacatataaattgtcatataatgaatatattgcatctgaaaaatatgaattagctatcttgagagctttattacataagtactgaggaaaactcaccattatctaattcattgtctgtcttaggatgtacttgaaaagacaaaatccatttggctatttgatccttgttaacctaaagaaagtataaaagggcaaacaagtacacaactcatcaaattactactcagtcaactcagtatattacttcttcctgaagagtcaactcagtcaaggcacaaagtgaacttaaattcccacaataaatatttcagctagcaaccaggcatggttacttgttttaatacataatacatacaggtacaattttcatgataagactggtaaaaaaatatttgcatgaggctataagtttttttagaagttactagtaatttgagaatggagatatcaggaggctatcatgtttttgttgtttacatgagcaaggcatcaagtatgatgaacttaaatcataaccaactaggcggctcctaactgtgcagagcattaaggcaactgcccatggacaagacaaagacgaatggaatttagaccgaattaagggacgtggaccaattcgttgctacagaaacatcacatgggcccctttcctcttagtttggctagaaatcgaaagcgaatgtagttatgtgatattgtgatctagttgccggacagatgcaaattgcctaaccgcaataatctctaactgctttgagtagactggttactggtcagtgaccacttatgggctaaagtgcttaaaccttgcagctagtagttgttctttacaggaattccaaaaaaaaaaaaattgaaaagacccttccacacttggcattctgctatccacaaactttggatccctgtgtttgtcacaataaagatcaattgcaactcccattatggatacagcaactaatttatctctgaatatactaccaatagccatccttgaggtttcaaaatacttcatggtaccataagtgcaccaaatctgctgattgattttattcctacagatgcaactttgcttccactaaatgcaagcaaagcgaccacacaaggtaaagtaaagatccaagctttgcacacgggcacatctagtctagactagagttcaacaaataactaaaaaaaaacgaatttacgcgtaattcaggaaacggatcgagaggataaccgctagggcagatcaggcggagagcggggatcttacactgtcgagctcacgaaggagagataggccggcgacggcgaagtaggcgagggtgaggtggttgacctcctgcgaggcgtagtccgcggggagctccgacgccatagcctccagaaacagcacgtgccgctcgcgcgcgaactccggctgctccggctccgccatcgccggccctcgctcgctcgccggggaaccctcgtctctcgtgccggagagaataaccgagccgctagtgcggatctggcggaggaggagagctcggcacggcgacggcggcggcggcggcgggcgctgctggtgctgggaatttgggatgcggacgggtggagggaagaggaggtttttttttccttacttaatatagggtgagaggttgacaggtgggcccaagggtgtatatataatatattgttttactccaaggtccttgatgtaaaactttgtaagatttgttggcaggagttgagcattacacaaggacttaaatacaaacaaatattcatggagatgcattgcacattagagcaggtacaatagcatgctataagccatctataacctcatatcgagaagaaaagagaagagagagaagaaagcgggttacatatttgtagccagctgcaacacggactctaagacgttatatgtgaatgagaggtaggactgaatattaatgatgtagtatatttttatagctaactattatattaattggctattagattagctataaatgaattggagccaatagttggctaacaatcaaataagcatacgagaatgactaattttcgtcttaccctcttcttattctagaccagcttctcaacaatgtgttcgtggaaaataatatataaattttcgcataataacttgttaaatatctgattgattttgtaggagagccataaaaagatcaaactatttatttaatccatcaattttaactatctcaaataaacatgaattattgttatttatgatgcaggtaaaatgaaccctgaattttccacacgagcatctgctgaatgctgatagttatgtactccaccttcctactggtaacagtctccattgatggattcttgatccgaactgatcgtgatggatcggccattgctggcattccgaaatctcacaattcacaagaaaaaaatgtctcgctattcagggaattttttgcatcacagattcagagtttcagacagcacggaagattttgcaggcggcgttggtgcccgttgggcgacctacctcccaactgcaatccttaactccttccctgacgcagcctccatgcatcgtaccgacatctttctctgaagaaccatgtccatacaccacctcaagtttttttactgacatgactggccctatcaattactagtaaccactgctttcagagtgttattgcaagttcttaagcagatgatcaacacaaatgatggtgtattatgataagaatggtgatcctaattcctaattcctagtagcatttcctgcacgaagttcctgcttttatgttgttcttttttaggtcttgcttagttccaaagttttttttttacaaactttcaacttgtcatcacatcaaatctttcatacacataacttttctatcacatcgtaccaatttcaaccaaattttcaaactttagtgtgaactaggcgtggaggaggtaattacagagtctcaccgatggtacaaagagcgtgtgcttcaggaatgcgtgccacactctttgcacattttggtcagcacatgtatccatgtggaagaatatatgcctagttgtgaacttgtgattgaacaatcaatttagactaaacgaacgatcatgctattgtgatcaggaagatatccaaatctgttaaagaaaacaagagatttacgcaaatctcagtcatgactagcacgatctagatacgcaaaaccccaaatttcgacaaaaccgaaagcaatcggtgatcaaacggtgtgtttttgcacactgaattttacttttgggggtccatggaccgggtccatacaatcaagagggccggatacgtcgcataactccggtgggtccaacggcccagcggcccgtgggccccacaccttcttgcccccgcgggatcaaatacacctcctccggccactccccgatccccacctcgtctccaccgcacgagcagcagcagcagcagcggcggccgcagcgcgagctctctctctctctctcgcggtgggcggcgggatgaaggtgtccgtcgtgtcccggagcggccgggaggtggtcaggggcggcgtcgagctcaaggactcggtatgtcgtctccattcgttccgttttttttttttgagctcgtcaggttcttgattgagaaatttggtgcggattatgggttttggtgttgcagccttgtaggggggagggtttggagttttggttcttgggtggggggggggggttaagatctcgtggaaaggtttgaggttgaggtttgattcgtgggttcttgttttcttttcttttgcaggctaaggtcgcggatctgcaggatgccatctatgccaagagtaagtgcaatgatcccgtcaaaatttcccgttttatggttgtgtttgttgatgtgttaaaggagtagtacttgtagtggctctcctgcacttcgttatcttctcattctttggaagggtttggtcgtatttacatgttgaaaaagataggaatatatgcatatgagtgggtttgcattcaattcaagctaaaggcctttttaaggcaaatatgtttttttatgtagttagactacgactgccttttttaatacatcctacagttctaaattttggaagcgtcgattgagtttggccagtatgtccaaatctgacattttgggagttaattagtatggtcatcaggagtaatcactgttgcacttatttaattcattaaaagagagttaaagaaaggattttctgcacttccattaatccaagagcgtttcaccccggggtactgttgatgctttgactcaaacttgcgagtgttagccatcagagaagtctgatttatggtgtatatcagtacatggaccatgttggtttgggagttgcagataataattgatatttaggctagtatttataagctgaaaaggtaaacaactgactgaatattatgttcgtaccgaacctagtgcttggaacatgaaaacagtacatcgatataataattgtgttcgcccttggttcattttgattggttgactagagcttgccactttgccagtactggcaaggattcttttggttgctgcagcctacaggttgttaggatctgcttaggtaggatggagttggctatcaacctctactcgctcacaagctttgtgtgtgcactttttaatattcgtttacctttgcagagtgaaagaaatcttaaaaaggatagattacatggaatgatggaaacaggaaacgtggttgaactaacttggcaatatactattgactgtatgccaaaatgattttaggaagacctgtatgttgaaaatagcttccaatctttcataaacaaagggcgatagttagttgatatactgtagccagctaatattcgttatgttgaaaactgcctaatttgaaatatgcacacatggtttactgaaataaacaacaaatgtaatactaaaagttcacactttttactaagactgtctctgtcatatgtacggcacaagcattgagtataatatgctattgttgaagaaattggaagtgtttttactgtctgcatttgttttctgtatcatgttcaaatttgcttgtgataaagcctatcttgagtgtttcatgatatttggtgctgtgccttaccctgatgaaggggtcatgctgattcgagcaactagttgtcttatttctgtaaaaccatttctatttcagccctgtctgctgatggttcttcctttttgagccttgaatcaggaagctaattcccctgtcattttgtgtgctcctgtcagtcactcttaagtcaccacctagtgtccgttttaactcacaacctatgctgatgtagcattatcaatgacagacaacgtaatttactgcttgaatttatcaaactttagctaagctggctatcaagaacctctattctatgtcattatggtatttattgtcacaattataagcaccatcttcttgcttgtgccagactggcgcatttgcatgttagtctattaagttgccataatgttatcctgaggtgatgttcacaaggaatttattattcatgttggaccctcaagagtaaagaagaggtcctgcaatgtggtagagatgtagtagagcgagaagatacatcatgatatatggttataagtactgtttaaaatcttcctaagtagttttatttcctatcactgccctcaagtgcatgttagtacaccaaacatgcaccgtaatagatgaaccaaagtgtggaatccaagtacatctagtgattactgaccagtgcaagattgcaaatgcaaactaatcttattctaactgaaagattgcagcattagttgctaatgtagatcataatctttgatcttacatatacagaaaactcagtttgattactttgggtgaatcatgaatgggctagcgggatgtttaaaaaaaaactattttattataccttgcttctcttagaatgcatgctttcaatgtgttctatgagttgctaacctcttggttttacaccatgcagctaagaagtattaccctgctaggcagcggctcaccctccctatccaacctggaaaatcaggaaagccagttgtccttagtgcaaaggccagcctatcagaatactgcgaaaagggttctggatccctgacagtggtctttaaggatttaggcccacaggtcttctacagcacgctgttcttctttgaatacttgggtcctcttcttatctaccccatgttctattacttgcctgtctacaaatatttcggatacgagggagagcgggtcatgcatcctgtccagacttacgccatgtactattggtgtttccactacttcaagaggatcatggagacgttctttgttcaccgcttcagccacgcgacttctcctgtatcaaatgtcttcaggaactgtgcctactactggacctttggagcttacattgcttactactgcaaccacccgctttacacccctgtgagtgaattgcagatgaagattgggtttggatttgggattctctgccaaattgcaaacttttattgccatatcctgctgaggaacctcagaagtccgagtggtaacggtggctatcagattcctcgtggcttcctgttcaacatagtgacatgcgcaaactataccactgagatctaccaatggcttgggttcaacattgccacacagactgtggcaggttacatcttccttgttgtggcagcgagtatcatgaccaactgggcacttggaaagcaccgccgtctaaagaaggcaagcacggtttcttttttctcctgcgctgaagtgctgaacaatgttatcattgcacagatttactgatatttcttattttgcagttgttcgatggcaaggaagggaggccgaagtatcctcggcgatgggtgattcttccaccattcctgtaaggagttggtgtcagcacgatggccacatgggattgaatctttggtctggtctcagtgttcggaagttgaagccttcagtgtaccacttctattctatgatctaaaatatctagtccacaatggaatccctcttagctattgttgaacttctctttgagtttgcattggccctgttgtaatggttaaatacaatacaagtttcatctgatatcagcttattgacttcttgtccatttgtccaagcagtagtaatgcgatcataatttcattttgacgcctggaattgctgtcctattctgtccttctcagctgaagcctgccattttcatgcttgacattgttgcctgttgtcctctgaaaaaccttaccagaagtcgtcgatttgattacaaagtatatactagcttcgtggtgtacattggtgctgtttcctttttcttgcttccctgggtgacagtcacatactcacatgcatattttgtaccaagaactttactcgtgagtttgtcatcagttatcactgttctggacgtgtttttaaggacatgtttggaacaaaggaacggagaacacatgaacaggaaaaacataggaacaagaaagagcgtaaagtggaaaaattacggaattgaaaacacatgtaactgtaaaatatgtggtgatgaaacatgagtgtttggatctaatcctaagcaaattcctaaaaaatcccatgttccaaactgggcctaaggaatcctgtacaaaattctcctatgtggacttcttgcagatcacctttttttttcttgcaaaaagactgaccgcattttgttttactctgaccgttagtctccatgagactatgactactgtaatttggccaaagaataatgagcagcagaatccaagttcatagtaacaactcaaacaattccttctcaaaatcatgttctgacctcatttttgtcgaaatgaagttgtgtaatcgaactgtgagctggagctcggccaatcaagtactacgatctcatccgagattcgttcagtgacctgcaaatattttaaagaggccgtatgtttcatatgaaatgtacgaagacctacagtcccagtagccggtttgaccacaagagttcatgctgaccatcactttcgtatgctctattttgttcaaaaattaagtaaactaaatcaatatggtgtcttgttgtcgccgatgatctgtagttgcatggtcagctagtacaagccacaagttgcagagcacagtaggtagtactagcaactggtaaccagtcaattgcaatgcttccagatagaatcatccggtcaattccaacttgttttggtagatttttctgcaccatttgaataaaaatagtcagtttcatctcaacaaatttacagccatttggtcgctacatgacagctggtcaattgcatttgatggagatctgtgagcacacgaatttagcagcagaattatcaactgggagatctgtttgtaactaaggaattttacctgaatttatcaaattcatgcaacaatcagggaaaaaaaagaggaaaaaaatccatatttcaaacgaggcttggaatctatcatgtattcagcaaatccaaagttgactttttactccaaagttggtagttgactttgtagttagtgctcaaaagatttaagtatttttactctgaagatgatgcagcatgcaggtctcaaattagtcatgataaagtgagacaattcttcatggcattgcagcgcagcaatcctagtgatgactagaagcaatcatgggcgatagcattctggaggcagtaattaagtaaagattaagccagtcactttcattaacaatgaacatgtggtggaagaaaaggctggtcttgattttgatatcttgattagcgatgcgatgtgtactagtaatactctgttgttataactactggcctagaaggctagaacaagtcagcacaaggtcgcacatctttactctttcctatcacttatgttttcatctaaaattattttccttttgcaggtcttttttttattttctctctatttatacgatggagaagttccatacgtcaaagataactagcaaaaggaataaaatgatatgatttccactgaagatggcatgccaagtttgattggagctgcatgtactaccctgagcattgagcaggtcaacatagaccaagagaaaattcatagatatcacaaatacatcttttcaataaatgaatcttttattaatatcaagataattataccaaggtgatacaaatacaaccattttaaaatcgctcttggcctttgcaatgtttgaatagctaggatacaatctaaattttacaatgtatttttggtaaacatagcaaacacactaatgactatcagtccacggacacttatgtggctgcttaaaaaactcctgaccacgattattcttctctcaaatattcactgagatcttacaaaatatccatgaagaggacaacttcacaatttcacacacacaaaagagatccatggagtggtcaaattcataccaacttttttttcctagggtccaccacaatacaaacaagcacacagtgtgtttgaggttggtctggcaaaaaggagtacagaattaaggaggatttggaggctttcgaaacaaaagccaaaaatacttaaaaagttcaggcaataatgaccatgctggacgaaaacgcggttctatgtactgtctccatactttgcattgattctataatttataaaattgctggtgcacttaatatctgacaaggacagccatctcatcttttcctgtaaccttttgccagttcattcatatgtgaattctcagctgcaactcgatcacgataggaaagagatgcaattccagccattttattaaaaccttgccaatgaaagaagaaaaaaatcatgtatttttataaacatatcagaaaagaaaaaaatatttttaagcaagaaaaatacaaacacatgtatatcttcatccattaatgaaatattccaataccaaaaaagctcagtgaaaatctgcgtgctattaattttacatatggacaataataaccagataaaccacaaactcaactctgagtgtgtgtggacacgcgtgtggtgtatctgcgtgtgcgcgtccaacttgtactcgaaaaaaataaccagcttaccataaaacaaaaatactttttttcttattaaaagaaaaaagaaaaagagaggagatcaaactgataactgccaaaagagaatggaagttttcaactaccagcacccgccattcaggcaggcagctacggaccggaatttatcagaaaaccccctcaaatttcccattcctcgcacttgcgatcctttcctcttcctcctcccgttcttattcggggaattcgcgtttcctccaactttccatttcaccaactccctccttgcggcaaaagcaccaccaaaccctcgaatcggacaccaaatccctttttttctgggttgcgtcggctgcaggcgtcatctgaaatcgaaggttcgtttgcagaaataaaaggaggtttctttgcggccggttttgtgggttcttgatggcagcggcgtgcgtttaatctgtttgtggaaaggcgtgagtcggtttatgtttcggtttttttttggataagctggagctggagggtttgtgaggcttcatctcggatctcaggtggtctctcgcatacgtttctgtttggtttctttgtttttttttctttttttttttgtttgggggagaaaaggagatggtttgttcatcgttttgtttggattagtaaaagggagtgtttaacgacgtccgttttgatgatttgcgaatggttttgtgatgccaatctcactctttgccccatccggccttgattgatttctttcctccgttaatccgtacatgcagtttcctccggattcatccggccttggatttattccttttcgtcggattaatccgtaaagtttgtttccaaaaagatttatctgaaccccacgccctacgtaggttctcctatgtgattctgtttaatttgaaattttaattacctgtccatggtcattttcttttcttattttctcaataaaatactgaaaacaatgtctgttgctttatagtatgtgagatttccctgtgcttgttcaccatgtttccttagaagcttcctttgtcttctttattttgcgcagtgtggaaacatttccacacggtttaaatacgttgtccgtgggaatcagtgtttttcttcactgaagtgcctgcccctgtgaagatttcattttcttgtcacctaattattgattaggaattgaaattctaactaacaaggatatgtatggatatatggtttaattggtgtcttaagaaatggtttagttgctgttggtgggtgtttgtctgcatgttttcagaaagaggtgcttgtgtcagcatcatttctgtttctttgtctgaaaggcagcaaagggccttctcaacttgttttctattagctttgttcattgattatggtttatgtgtttcctcatgattaacatctgcctttggctagccgattttatggatacttggttggagaacatcttttttctgtattaaatttgtttggctgcacttttccagagttccagtttgctattcaggcaataatttatttgtacttgaaatgatattatgcgtgttattcgctaagttgttaatcggtggtcagtctgttcatgacaggtttaaagaaaagttgaggaattgttccttattctgcaaaggtggtgcttataaggaaccactcctcctacctttgttgacgggctaacaccaaatggcccagctgttgcaccatcaggactccgcgttttatgggaaggaactccatgggcgccgatggagcattcttcagttctttggcttccgtcgccgcctgcgatccactaagatgatctctgacaagaaacagagtcagggaaaaggcagtggtggtaagtttactgcttcatttttttgttacctgctagttgctataggaccttgaatactatggtgcaacagagtgtagttgaataatacaactgtgcaaattcatgtggttggaaaggttttttgcttgaaaaaaaaacacacacaagacaccaaggagaaacgctggacactaaagaggaacttggtgtcaattaattaagaagaaatgcgagcgtgcactagagtcgaacacgggacttcggggttgaatccgcatacctctgccactgcgctagcaagcgcttctcttccatttgatatttaggcgaattatgtaacttatgagaaatattaccataaaaaacccattggatatgagaggaggggctctcatataagaaattattaagaggagtgaggctcgaacccggaccggctagcccactaccttgtggtgctagccggaataccccaggggccttctcatgagcaatattactaaaacagtgtgaaatttactatttgactcttagtggtagtacagtagatacttaattccttgttatgtaaaacttaccaaaacagtgttctgctttgattatgatttttattataaattattctccttgcacgattataatttgcattagatgaaaaaataattgtaggaagtagacgccgaggttcatatgttccactgaaagatgaagacactagtgtcatggacgatgacaaacacactgaggtacatacaagttgcttcatcctgttcaagcaagcattcaaacacttcttttttttacattttggttataatttcttaaacttcttggttgtgtatatccctcgtggatatagaggccggattaatgaaaatccattatctaaaaaaaattccttaaacttcttcagactacagtgcatactatgagcatctagtttcagtagtttattacaatatttctagaacttttttggatcagaaattatttataagcataatatacgtataggaaatttccacgacattacataatccacataggaaatttccataagtattacttcctccgtttcaggttataagactttctagcatgtgcctagattcattaacatctatatgaatgtgg

SEQ ID NO: 75474 - DNA, 5679 bp, Oryza sativa
cctgccaccctatacttgggcggcaagctgacgtggcagccggcggcagacggcgccgcattttgcatttaggtccttgcctgcaaaatgcgcagagccaacaaagcattggctagggttttttttgcatctcagtcccttacagctgagatgcaaaaaaccgagccaaaattgtattgataacactttaaaaaatatttattggtaaaaattgttaataataatttataaattgtattaaagttggttgtttcgcaatttcatattttaggtaagagttcatgttgtattccctctgtactcctaaaggaagtcatttaggataatgtttaagttaaaccttaggaatataaatcatgaataactcttaaattgttgagtttgaaaatgtaaaagttatatgaatagatttgtttaggctttatggaacgaagaacctgacaacgatcaccgcctccgcattttggacgggattcccatggagggagtgccgtagttagcacctgtcagtcgcactattattcacgacgttatcgttcgtaagctgcttttctctgcaagtattgctcagtactttcggatgagaaataccagtgtcgtttcttgtaaacaagtggttaggacgagaacgggattttctgtatggacccactcgatgtattcacaagccgtagcgcaggtctgacgaatagagtgggagggtgaaaaataaacaatcgctcgtacaaactgaataagcatatgcagataataaaatacctcacgattatagttagggcacctaaaaaagcgtcttcctcgaatgccaggattcatcaaagccattagttggcatcggtcaccacaaaggtagagaggccgctgacaccaaggtggtagtaggtatgcacaaggatcgctacgccagttcggatcctcaacaccccggcgtctagccattgccgaaaggtggtgggatttacaataaaactagtgaggacgagagtattgaatgtgacttatgaaagtttttgccgcatcgctcattacgggggcttatgtaggcacggaaatcacaatgataatcttgacatgtctacatcatggggcatggtgggtcgcactgattggcgccgaaagttagattggacgtatgcggatgtatatcctgccgccctgtatatgggcggaataaggccttccgccttttagagagcggcatggcgccgaaagtaagattgggcgtatgcagatgtgacatgtaagattggacgttttggaagaataagggcgtgagaaggcattccgcagttgtatcgcactcgaataaaggaggctgcatcaatgcgaccgaaagtactcgtgcatgcgccgaaaggtatcgtgctttcgcaaaaagtaacagcgaagtttaaggatgcgaaaactgaatagcaacaaccagagttcattgtacaaccaaatagtactacatgtaaagtaaataaacaaagagaagcctgctctactggctctgccccatgccacgaccccgcttggtcctctgggcatgcgctcgcacgtgatcctaggagtacatgaagcgattcggtggcatagcacgggtagcacgaggctctagcagcaggggggagggcgactggtcctgcgtctgcacgggcacacctcccagctatgagggaccaatgatgtccgctgtggtatcctggaagtcgaagtcgctgatgtcgaagtgcatggcggaagcccacccgtgctccggcgatgtcccggcagggtccaaggtttggtggaccctgctgtgacatgctggctgcctgtgacgaagtcccggcatcctgccagaactgcgcagagtgcgaggccgacgcagctgactaggacgctaaccgtgacgcctgcgagaagtgagcggcctatgtcgtcccgaatggagcaaagcctacacatggacgacgagacccttgtaagctaacacataaattgcatatcaattgattgtcgatatagtgttattttttttaagtacctatgtggggcccaaaaggaggcgtacctgtggaaggcggggtggtgaatggcgcacaaaaccctgaagcaatcggaacaattaattaacatgtagtacgtacctccgtagggagggggagccggcctaggaatgtgcgcagctggacgaggaccagtcggtcgaggtggctgctgtggtgttgcgtttgcctgagcgacgtcggtagcacgacaggtgagcgcacggagaaccgagtgcatcgagcgtgtacgtcgtcaggtgctcgtctacgggtaccgcaatccccgtgcctaaatgttggatcgtcgttgaagcgtcaacgacgaccctgttgcactcaacgacctgcacgattaatttgtacgtaaataaccgtaaatatttgtaacatttgaccaagagaaagggttaggaggcgatggtgcgatgaagagtactcacagcatgagcaaagtcttggtcgcggtgcctggcgtagaggtctctagtgctcgcggtgtgggcctgttgctccatgggagcgaaggtgaccctagtacgggtgcgtggctggtaccagtgtaggtaggcctggtacgcctcctcggtgtgtgccactcccacatggtccacgacctcctcggttgcgagcaaccagtcctcgacaaaaggccccaacttggcgggccagtcgccagctaactgctgacccttccgcgagtacctgcaaattaatgtatcatattagtttgaattcacatatgaagcaaaatattgtggagaggtggatgttaatgcaacaaatgaaagcgtagtgaaatctcttaccagtgaatggcagctgggacgctcgtcggaaacggtacttgaaaggactaacggaagccgaactgccgcatcacgcggtaaggtgcgtgaggctcaacacagatgtcgatggccatcggaaccgtagtcatccagtacgcctggtcccttgtgcagagtgtggacaggcccaacggcgcacgactgtgggtagccgcggcaccggaggggatgcagcagcggcagcgctggacttgtttgttttttcttttttttagaatttgtgattcattggatctgatatgagatatataatgtgtgatgtatttgatttgtgttgtatttttttttgagaatttgtgatgtgaatctatgatctgtgatgctactttgatttgtggatgatttagggatatgtagggagcaactcgatttggaaaagcaaaatgtagtgagcaaagaaacaataaaaaaagaaaaaaaatagtgaccaaccgggactgccgctatcatctttatctttagtcccagactaaagatgaatttttagtccaataatccgagactaaagatgggtatctttagtcctggttgtataaccgggactgcaggggttatgaactgtgggtaaaaaccctttctcgagtagtgtaaagaggggggtggatgggtttgcattctgtttggacgcagacagaaactaaggtcctgatagcttcatactccaaatctatgctagatttatagtttgtaagaattttacatttggtataaaataagaacagtaattcaccttgcagaaaaaaagaacaaaataattcttttaaatattgttaaaagatagtgcaaacgtagacgcacgcaatgtacgaacgctcatccatagttgcttatattattttgtacgctaattaatgaaccgtgttctaacagtagttgattaaaatttggaagcatttttatccatttttacaatgtgcttgaatgaagaaaaaccccattctcaacaactgcgccaagcaaccaaacattttctcatgatactacatccgtatacttttaaaataatattaccatttatcttaaaaaatagtataaatatactatattcatactttaaatttttttaatgataaagcaggttcacgtaaaaatagatagtaatatttatataaatattttaataaaacgaatcattaatgatcaaaagtcaaacacaccatctattttaaaaaatgtaaacggatggagtaacccgtctaggaactaaggacaacgtgagccgttggatctaaaagaaaaaatgggctggggatgcgtagtacatcaagctgggctgggccgaagatcggtagcctaccatgccctcgcggtcgcggacacgcggcggcgacggcgacggcgacggcgacggtttgccggcgggagatttgaagccgggtgtcatccggaacctgcccaccttttcccgcctgctaatcaacaaatggcctcctgtgttccgccaacgattttcttatccattcaggtaatcatcagttcatcatcctattcgcattccttctctcctttgttttctgtatcgacatttttttcccgcttcctcgtatgcaactagaaatctctgtaattaatccattaagtagaagttcgccaataccaaacctgcgatcgtacaagtgaatgtaatgcagtctgcgccactgatctatgtcggccgccaactgttcgacgaaatggcaaagccaaagagctgaaaagttcgacaatatgtctgaaaagttgatgtcagttgtttcttccctgagacggccaagatctggcgtaggataactgaaggctgttccctgaagttttctatggatgtttgttttctaccaagagatgttctttgagctgcttttagaggtgcttttgcttagtttcgttttgtctcctgttgtctgtaatcttttggggtctcaaaccttgtgttagtctgtttcgttccccagtatgggtgttgtccttaaactgtaaatgggtatcccaataacctgccgcttttggctttctataaaagccgggcccgagtgcctaagttctaaaaaacaaagccaaagagctacagtaatccttcataggtaacctcctagatgaacacaccgttggtttcttgcctcagaatgtcaatacatcaattacatcgtgatgtggtttgcgttccagattgacgcattttgcatgttatgaagtgagaataacccgtttggaaaagcaagggactgacccttctccaccaaatatttttagcacacccagaatcattgttccagtcctaaccagaaatggattgtttggatgtgctccaagcctaaaacgtgtgaggggtattctgccgaacctaatgaacatatctgctccagctactgtagcagtgtggcttggatttccctatcacctcagctggctcagcatatttaaacaaggttcgagtctttgctcttgggaacctgaactctacagtcgcatcacagggcgtgtccaccagaaactctcggtcgctgatgtgttagccaacaaccgatggatccgcgaccttcgtggctccttgggcgttcaagcaattttgcaatacctgcaggtttggtcgatggtgaggtcaatgattctctctgagggccagcctgattccttcatctggaggtgggaaaactcggggtcgtattccacccgctcggcctaactcgccctcctctcaggaaggattccatttcagcatctacctatctggcgttctctcacccctcctcgatgtcgctacctcctgtggttgatcgctcatcgccgttgctggacgattgactgcttggagaagcgaggcttaccgcaccctacctgtt

SEQ ID NO: 75475 - DNA, 638 bp, Oryza sativa
aaatttagagtctgttacaggattgcagtgtagttgttggaaagcgcgcataaaacctaaaatatatatgtagtaaatatttcctaatcccgggagcgccaggactcccctcactttccggcagtaggtaggttggtgtgccggtgtgcaatgggggctcatagtccttggagcgggtgctgaaaagcaagaacgactgaaaagtcgggctgtggcgcatctcatgtgttgggactgggctcttgtgttgggcaagtcacggagtgcgggattaaaagcgtacatccactgcagtgagtaaaccaatatatttgaatagccatgctcgtggttaataagcgtctggacttgtactactcttgactagactcatagattttgatactgcttagtttagatatgagaaggcatgagtaaccttgcctgatgtgcgggaaggttagtatgatagagttggtgtaaaatggaatgcaagggtaaaccgaaccaagcgaggcttgggaaggtggatgaaccctcgattaatgataacttcaacattaacattaaaactgctaagtcataggattgtgaaatgaattgtgaaaactagctttatgcaaataaaccaagccattctttaaccccctgtgagcacc

SEQ ID NO: 75476 - DNA, 1113 bp, Oryza sativa
ttaaaatttaaatgaagaaattcgcaaatatacatttaaagagcatataaacttcaaatggccatatcttggccatttgaactcggaattggaccgttcaagtctctaatttttccttaagaagtcaagaacccatttttgtgctttgtttctgcttgttatatggagtttagtagattaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattggtattatttctttgttcaccctagattaaacaaaacccgaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgta

SEQ ID NO: 75477 - DNA, 1118 bp, Oryza sativa
atataagatatatgataactcgtcgaattacataaacaagattaaagtatcatgaagatggaagcactaatcccgagaacgcaagccaccataacaagttttacctcttgttgaagatcgaaacctatgcagctcaacctgaaagcaagaactcgtcgaaacaaaatgaaaataaaagagtggcgatgcgccgagattgtattgaacgtgtgttagtttgattacatggggctcggatctatttatacccgagaattacaaaatatgttcatatcggacacgactcttatctctaacaaactctaagataccataagtctttgcaacagacttttacctaaacatatctctaaggaaattacataaaatatactaactaatagatacaattgccttctcaggactctatccatgcgtggcaatcgtcatgaagcacgtcaacctaaaccgacaacatatgttgtgtcatattgtcggattcggctcaatcggctaaccccgtccgactcgaactctgctgatcttagtcgtagccgattcggacttcagccgatcttcactctgtttccgggacaatctctatctcgattcctccttcacatccgatcctccttcacttttggatatcactaaattacttcttagacatacaaaagtaaattcaataaagtctaaatgtaatttacatatattatagaagtacctttagacaaaacgaaagtaactttgtcataccattaggggtaattccattgtagggataaaaacataactctatctataaactaaattaattagcacaaactatggaattgactaaaccaataataggtagtcacctctagcattatgaatgtataggaagtaatttaattaaatctaaaattatgaatgtataggaagtaatttaattaaatctaaaagtactctaaaagtaatttaatcaacactaaaagaaacctttaagtgtggcgggctggcgggccggggagcacgccacgtcggattttgcaaagaaactctcatatttgttcgtaattccgtataggtctctcagtaacgtatttggagaggagaaatcgcggataggaacctatatgtaaaaagtgaaaataata

SEQ ID NO: 75478 - DNA, 3525 bp, Oryza sativa
acatccctccccgataagcattggatattcccatggcgccactcaaaagtagcatcggccattgcaacctcggccgatgtatccgcttgaataatttcaacatcatcgccgtcccattgaattaaacattgatgcaaggtagaaggcacacaacaattggcatgaatccaacaacgacccaaaataacattgtagttaccttgcacatcgacgatgaagaaagcggttggtagcgtcttgtttcccacggtgagctctgccgaaaagataccctttgcctccgttggttcaccattgaaaccattgagaatcatgttggtcttcttcaactcatcatcctcacgccccaacttcttgaataatgagtacggcatcaagttcaccgcggcacctccatccactagtatcctagagatcggcttcccatcaacatggcctttgagatagagagggttcatgtgacggtttgactcatcgggcttctcaaaaaccgtgtctttaggacctaatgagaattgagcaacctcggcttcatccatagcacaaaactgcataggcaacatacataccatgttcatattcatgtcttcttttggagatgattcacctttatcaaccgattgttcctccttctcctctacaacaaccggtttttccttctctatggacttatgcctccataccggtggtggtcgcaactcattgaaccttttatctctttgctcttcggcttttttctctcttatctcttgagcccgaagacgttgcaaccttctcttttgagtagccgtcaaatccttaggcatccacctaggatccggctctgttccaggaggtaaataatgccctctattaaccttgtttgaagacgatgaagccctcacatcgccctttgcaaaccttctatcaaaccggcgctggagccgggtcagaccggacgtagaccaccggtcagaacgggcagatgcccccggcaaaacgacatttgggcgcccggcagacaaccttgaggggtcggtcggaccgctgtcgggtcggcggtcagaccggcctgatggcccgatcagaccggctgtatggctgcggtcagaccggccaaaaggcctggtcagaccatccgactgcgatgagctggtaccggcctcggattttttccttgaagactctccaacttcatctccagaaggtattgacacatcatgagaccccactttgatggtaattacttccgaagtccttacctccaccttgatgcgctttctttccctcttttcttcattagcccgattcttaccatataaccggccgttgttcggtgaaaataaacgctcatgaattggcctcctcggtcctccccacccttggttgaattgcattggagggcatgtaataaggataaggataacccggcggtggccattggataagaaccccatgacatatcttgtggatgatgatatggaggtgaatgcgactgtcttggtgaatgaccaaatcgctccctaggaagtgatcttggtctttttcctttgttgcgaaccctctcaccaccttgcttctcatacttttccaaaagcatatcaaaagtcactttggtctttctaggggctttagaagttgaagctccactcctattttccttccaaacgccaacctccggtttctttggcactatcattttaggccttgcttcaccaatgattactccttttcctttagtagattcggcttgctccggccgaatcaacaccttcttatcattgaaattaatcgcattcaccggaaaaggatcatgatcaagattcatcttggagccatcagtgaacttcaatcgtccttcatctatggccgattgaacctatcgtcgaaacacattgcaatcattagtagaatgagaatgagaatcatgccatttacaatatgctcgatgtaatcattagtagaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaagggtttagggttgcagtaaacagcatttaaagatatttagttgctcagggctattttgtaaacacgattctagaactaaacaatattatttatcaaggtcgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgcttggcaacagaggcccgaagaccggtccttatatggccgaggtgctactatcaaaaccatacaccccgagcctagcctaaaaccattttgaggattttgaatagagggggaggtgtgaatccaattccacaataatccaaccattccatagtgtccaggtgatatgaatatcccaaagtctagagttgtaaaaccacctaatgttacctaattaagcggcgaagcatctacctaaattcatactagtggtaccatgagtagagtgtccactagttggggttttgtttattctagggtgaacaaagaaataataacaataacaataataaggtcataacaaaggtaaataggcatggctagataaaacagtgataacgcaggaatttaagtaaagcgatagtgcaataatttaaatcaaaataattttataaactgggattcaatatgctcaaggatgatatgacttgccttgctcgcttttccaaacgtcggcttcaacctccacgaagagcggatcttccga

SEQ ID NO: 75479 - DNA, 15770 bp, Oryza sativa
cgcgccgccgcctctcttatgaagccgcgtcgtgccggcgacggtttctctccctccgccgccttcgctgcctatataaggccggcgacccctcccattttgcccgatccatctgagctccaagctctccctctctctctctctatctccctcccccactctccaatccacaccggctgccactttccctttgcttctccaccgttggccgccgtccttgcctccccactgtcggctgccgccaaccgccatcgctgccgctgacgagtgccaaccgccgggccgccgccctctgcctccactcccttgtccctctgtgctgcgcaaagaagaagaaagaagaagagaagaggtagaagaagggatgggaagagacactgacagtgggccccaccttttaaagtaacctctttttattttatttcattttaacctttgggcatccatatctttttcttatttatttatttactttctaatttcaaaattattttaaataatattttcaaaaccattttattttattcaaatacctttttatattgtaaatttatttaatttatcttaaatatatttaaatttaaatatctttgatttatttgaaaaccctttttaaattcaagtttctttaaatgactctttttatttctaaaccattcctatacaatcctttagccaccaaaaagctgctgtgggaaatttcataccttccatggggacgctcgtatggtccaaggacctcgacgttgaatcgagggtcgtgaaacccagcataacctaaacccaaggtcgaagtgttgctgttcacaccccacgcttcgacgcgtacagtggccgaagctttactactctttcgacctccacaacacgctgcacactagtccttgggctatgtccaaccctagccactctgctatcactcacgactgtagagtagcactgttcatctccaaataaaattcccaactcactagtcattgtgctacttgactgtagcatcgactagaacgagccaatattcagccggcatgctacccaaccttagcatcggctaaccaacccaaataattagccgttatgccttagcatcggctaaccaactccaaatatctagccatcgtgctactctactctagcaccgactagaaaaccaaatccaccgaataaacctcacctatccaaaattatcctttctttgattttattcaatttccaacctataaaaaccatcacctctcttttattcttcaaattaaaagtttaatttaaaacccattcctttttcctctcgcctcgctccaattttatttattccttggctttatcgtttcttgtagcaatttttcttataggctttatttgccatctttttcgtattcgtacgttagaccgtacaggaagttttatcagcatccaaggaactgacatggacccagatggctacgctgaagccacgggaaatctcgaggtgcaaggcaagacataactaaaattttgatcatatagaaaccttgatataatcttcagatttaaatttgatgcatgatatttactcttttaacatctcatgggtagatgttatactttagaataacattgtggtaattggtaatgctttcaagaattattgcatgagcctataaaaggaagcattggttatcattttatgtgatttactattccaaacaactttacaaacttaggaatccggttaaaatgggcatttatgagttgagattatgaatattgaggtttatgaatgttgatatatgatgaagtttgttggtgtggggagtttggaaagttttggggtggtttaaccggattatatttacccccttataccatggaaatgacatagttgcgtccatccacacgatcaagtaattggacttagactagtacattatcccactatatgaaagagtgttggttggctcactaggagaaggattggggtgaatgcatgtgtaaggaggttgggggcatggtttacaacggtggaacccgtgaaagcagcgaccatgtagccttgcctaggcctagcaagtgcccgactgctaggatggatcaatatcccactcgtgcagtaactagtagtaaatgggaccttcgaacggctctggtgtcctcaaccttgcaaactgttgacatcgtgtgggtaaagctggacagtctctgcagaggtgaattaaatcattcgaatgtgccgtactcccggttttggagttgtgtcatcagggtgattcctactcctgaagtataagtagttttaaaaattaaaatgttgaggataaagatgatttatgatttttattacttctttactttattattgtttaatctattcatatctatttacacctaattatttataatatgtcttgctgagtacgtacataagtactcatccttgcataatttgacatatagttaagctaacaagaagactggaaggaagcaagatctacggcaacgacaagtttttcttctaggctagtctacactcgagcttttgcctgtggagttctttggagtttattagttgaagtttaatagtttaatactttggattttccttgtattttacaataaggatattttagtttggatcttttcaacctttaacagttgtataattagcttgtataaacaaatttgtgtaaataatcgaaagctattatgtgtatcaatatgtgcgtgatcgaaatcctggacgatcacgagtggatatttggggcaccaggcctaaattgggtgtccccacaaaaaggatatcagcttctaagcaaaatcactgggaagagatgggaatagcccaatgcttagctctatccttagccgatttcaagaaagatgaactaatgctgccagcagccaactacttttggtccaatactttcaatagttttttattcaatcatggaccaatgactccaactttgttagacataaagatgctgactggctcggatatcacaacttccatcaacccctttgccttaaatatcaggtgcactcataagttaaaaaccaaaaatattggaggttcgtctgggtacatcaatgagcacatggggacagggccgatttctgacagagaacacatagccttccccaccatgtggcttgaaagaagcatcttatgtggatcaacttgtggcccaacttcaaatttccaacattttgcccaagctctagtagaaaagaaaaaattccctttgggcaaatatgtgcaaggttcaatataccaaatgatgcattcagttgtcagcgatattttgatagactcaacaatcagctatggaggtccttggtggctaattcagatatggctcaatgtacacactaccatatatagttgccgatatagctgctctgtcagtgtcatcctttccagcaatctatgccaatgatgaaaatcccagcactcgtaggtgtatgtcctttggagaggtagcatcaccttacccaggcactaactcattggctaattcattcaaagtctggttcaaccgattactgttcaactatttggaaccatgcatcacaattatacaaatatttgagtcatgccactacacgtcccttcgctgcattttttaattctttgggaccaaattgcctccatcttgttttttcatcctctcctctctactattcatcttctccacaatgggagctagatttggggcaccttgcctcaatccctccacacagtgatgaaatccacgagactgagacgagaaaacctcacctctccaacatctcgacgtcgtcctctttgctgctccaccaatatcttcgtcttcagcttgaactccctctcatcgcaatgcttattcctcttgccaatggcgtttcttcctccagcaaaatggctgtgctctgctctccctcgccattgctcaccacttccatcctgctgccttgctgctcttccccaccagatgcaaggactggcaccaccgttccacgacaccccatcggtgaggctgggttcgtcggtgcgaagccaccacggcgttcctcttcgccctcagccgccctgcttccccactggccatagggcccttgcaccaccacgcctcaaagctccgccaatgtccccatccgcgcgcctcaaaccagaaccaattagtaatggcatggatccaattaacccgtgaaaaaatgtctgccctggccaatttagtaaacttgttttcttcgcggtaatttcgtctctacatctttcaagtattgctgaatcatagatgtgttctgaatttctgcatgtttctttatcctgacttttgctttcttatacttgcatggtgaaatattttatggcccactctactagcccattccaaaaggaacaaagaaaaggaaacacaagttaactagctttatccggcaccgccgtcaaatgcttgcacgatggggctgtgccgcgttgccccgtctatctcgccatcgccaaccagtctcgcttgccctgtgccgtatccgagccactggagcatcacatttgtttcccctcccataaaagccactattgcttccaacttcaaactagaaactgccacaataatgggtagactagaggccatgcatggttaatctcatttactctcttcataaccctccttccatttctcaaatattttggatagtcatggctttatctttttgcttatgcttattgttgacagctgttaagtatcaaagtctcgccgtcaatcactgcataaaactgaaagtataaaacatccaacatagtgggggtatatttccaacaatttccacgagtgttggtgtatatttggatgcaagtgacaaactacctaagttgagaggaaatatacatgaaggaggagaatcaaactcatatccaaacttatagagttttggacccaaaaacccaattaaacacctctaaatgggcccaaccaccatgccactggactgagggcccacatatcagtgtccaggaggaaaagcggggccaacggagatggccagggttcggccgaaccctgagttcgccaaaccctgacagaggcctaggttgcattcggtagtaactgcttctcaatgacggtttctaccgtctctggcgctccaaccgtcatccaaatggacacttggcatgaggagagtgaagatgctcataagattccatggaggatatgcacactcccaaggcacctccacctataaatacccctcatcatccttcattccaacacacagcaagcatgagttgaattacaagagggggagagagtaagagagaaagagttggaggaatcccggagttattggtactttcctctgctttaatagataatatctttatcgagtaatttgagatttactttgtgatgattatctcttagttagttcctattagcgtactggaatattgtgcactagagacagtgtttactttaatgtttgatcgacattagactagtattaaaatagtgtagacgtggttgaagcatctaagcccccgttgttaattttggtaattaatgacaagcgctaattgtggactaaccgttgtctttgagataattatattgagttaggttcacatcatgagtatgtatggatgattattgatggattaaagttgacggcgcaaagcaaaaggatagatgacggtaaactagtggttgaattctaaattgatcgaggtgttgggcaatcaaaattgtgctagtttatttatagctttgccgtactattaagaggggtaatgaccgagctaagagatgatttaaattgccacattaggtcatttgcatattcacttgtcctcacatttcaaatcacattttatttctttgtgcattcactgagattggcctgaccagggccagtctaaccgcttgctccaagccggtctaaccgcaggtcagaggccggtctgactggccacctagtggcggtctaaccagcatgactggccggtctgaccggcggcacttgtgcggtcagaccggccccctggaggccgggatggtgttgctctggtttgggcgatatagagccgacggagccgtattcggtctgaccgagccgaggccggtctgaccggccagggcaatggggcccaatgacagggctacaatggttagaaaactagccgttgtagagtagcacggtctgaccggccacacacctccggtcagaccggcagagcactgagttgggggatttcgcccccaacggctagttttggtgggtgggagtataaatactcccccaccagcagcaaggggtctctcttggcacccaattcaattgcatacaccccttgcacctctctcacacacatttgagcttagtgtttatccattgtagtggttgaggttgttctagccaagagtcaagtgcattgcttccattgtagagctagtgtggcacttaatcatctccgagccgcgtcatcgcttgttactcttggaggttgccgccttctagacggtttgtggaggagttgcctggtgacctctccgagaagattatggaggaggcccggtgctggtttgtgagtggtttgaagttcactaccttcggagtgaaggaaaaactaccccgagtgatcgaggcttgggtagtcctctccggtgggccggctcccgccttgcccaccccttgacgaagggggcgtgcggtggcttcgtggttgagcggtggagttgggctcgcctcaacggggagtaggaaaccggtgagtttcagaacctcggtgaaaaatctcgtctccttgtttcatttacttgttgcatttacatttgtgcaatttacattcctagagatatactagagatcatatcaccctaggattgctaaactagacttaggaagtgtgatttactttcctagtgatatacttgagccactttcaccctaggattgcaaaacataacttagttgcttagttagacttgtccctcaccgagcctagcaacttatgttagttttgattagatgtcatgtaattttaaatcacctattcacacccctctagtcgacatctcgatcctacagtggtgtctatattatttaataccagtatttgatgtgtatcccatagttcgttagaggtaggtgtagaggtggtgacagccctcgagattacttaagtcctccctatctaggtacagagtagaacacgttctggtagcagcgagcaagccagtggctgaagtattgtgataggattaaattaagctttctgtagacacggttcctccctaggtaatcctctctaccctttgcctatttttgctttgtatccttggatgaacttgaagaggaattgaatacacacattttcttggaaaatcgataccttggaataatcccgggtgaagtgctacatcggtatctccatgcgcttgtggattttatctatgaccgtaagaaatatcaacacttatatatgctttatccgacacagccgtcaaatgctcgcacgatagggttgtgacgctcccgttgccccatctatctcgccatcgccaaccagtctcactcgccctgtgccgcatccgagccactagagcgtcgcgctcgtttccccttccataaaagccaccattgctagcagcttcaaactagaaactgccacaataatgggtagactagaggccatgcatggttaatctcatctactctcttcgtaaccctccttccatttctcaaatattttgtatagtaatggtctcatcttttcgcttatacttatacttatcagtcaaaatttgaattttcaaccttaaatttggagttgattttaggatttttttttcatcgtagtttattttttagcatttgcttttagattatcaacaacatgtatataaaagttgtattcacaaattatttttcggttgtgaatatgttgttgggcttattccatgatggggctgtcagtcatcacgcaccgtcctccatcttaggagcaggcgtattgcctccatatataccttcctgcttaacagctcaaaaaacatccgttgcactacctagaatgctccattggttcacttcctagaatgatttattagttctgttcccttatttcccttgcatgaatacattttcttaccgtatattgcaaattttaagctatccgtccgtccagtttcatctaacttactaatctgcgtgctatttacatatacaggaacaagtttgatgataaacgaggcacacaattgtgccaaacgaggcgcacaaccactcatggtaacttcttatcctaggcacaaaacatgaaaacatgctgatcgcttaatatttgcttcattttattttttttgcaccgcttgcaatccagtgtttctttttctctatctctgatctctataatagaataaggtttcttatattggtctttatcaactaagaatcctagatgatgtcccgcgctttgctacgggatatatgttagataatggagaaatgatgaaatgatttagattgaaatattatgaaaataatttgagaatgatgatttagtatgtgtatgtttagttttaaaatcaaataaattgtagatacaattattatatgcttgcatgttgagctttgtatacttaataggttgatgtggcatgtttgcatgtagattttaggctcttttttttgacaaattggcccttttgaaaaacttatttcaaaactagcccctgccaaaaacttaaaccaaaaataggccgtcagctcagcgccaagccccttggcgctgaggttgtgcatggaagctccaacgggcctggcgctgacctcgtggcagcgtggcggtcaaggagatcacccagcagatatgtcagggatgtcagcgccgaagcggttggcgctgagatggctaagctcagtgccagatacattggcgctgaggtagcggcatatatgccgctgccgcgccgccccagcccgacgccctgttttgttctgctgtgaagttagggttcatcggccccctgcgtcgccctctctcctcccctccaaaaatctccccaaatccccctcaaatcgaagctccttagtgggcgttgcgttggatattgatttgcaaggtaaatctcctccaaaaaccctaccctaatttcctcaatgttttcctcattgtttgtagagttttttggttgaaatcgtgggttgttaaatgtggctcaggctgtggtgtggattagggaatgtgggtaagtatgcgacgttatagttgtatattgatgttagtatagaggattcatatatactttttgtaagttatgcactattttgctaagagtgaagttgagacttgagagggatgtgtattgtaaatattttggggatttatattgattaattttgatgttgataggcatagatattaggaacattgtgaccggtggttgtaaattcaatatgcattagaattgttccattgacttttaagcaagcacaaaaaggatgtttttaagcaaatctcatataagacttctatatgttgattcatcgggcatgcatccatgcgttgaggaccttaaagagatattggtgtattatgtaggcaattgtcagtaccatgtaacagaagtaatggagaacattagttgagcaataactttgagtgaaaagttagttctttcactactttagatttttttttcttgtaataaattccttactcatttttaattgttccatttacttgttgtcataattttattatgttccaattgtatcaattacagatgatttgatattgaattgcaggatggagtactttccagggttggaggatttctacgaggagaagcaccgggctcccaagatagcgagcggagaggttagccccaaaatgtcatatttcaattttttgcacaacttatgtgtatcccatgaattttggaaggtaaacgataaggaagtgaggtacagtacagtcacacatcaagtaaacatacgtatagcataatttgactgaaaattggagaaaataaagattaactttgaaagtagtccagatttattaaatcattcaagatggaagtgttgttctatgaaataaaaacaaccaaaaggtaaagcactaacatttggtgactgaagtgttgttcatatgtctcatgtttttgctaacactaccatgttatttgtgtctattgatgcaacacctcaaggttcaagtcagaggtcacacatcacacatcccattcaacgaccagtacattccgtacctacgtcgagcgaaccttttggcgttcgtcaccatggcgcagcggccgatgcctctatacaacgctgcggctttgacggcccttgtggaccaatggcgcttggagaatcacatgttccacctacccaccggggagttgatggtcacactggaggacgtcgccatgatcctgggtcttcctatgcggggctaggcagtcacaggtgacataagctcaaggaactggaggcagcgggtggaggagtacctcggtgtggagcctccagtggcaccaaatggtcagaggctgacgaagacctccggtgtgccacttagttggctgcgtgccaacttctccctgtgtcccgccgatgctgacgacgacacgttgcagcgttactgcagagcgtacgcgttatacatatttggcagtattttgttccctaactcgggtggagatatggcttcctgaatgtggctgcctttactagaggactgggacgaggcgggtactttcagttgggggtctgctgccctagcctggctctacaggcaactgtgcaacgcctaccgacaaacgagcgccgatgccaatattgctggatgtgtttggctgctacattgcagggttgacagtcggaagaacaagaaggtgactgattgggcttactaccatcaagatcatatcacgcattgggagaaacttgaagcgaacgtagtaccagaccacggggagcacaacaagatggagttcgatgcgtacttggcctggctccacaggaactatcatcttgtcctacgtccggcctggatgctagccgacatagcggaagaccccgaagatgtcgaggagcagaacgagtacaacacacgtacccgtgaaggtggcatggttgagtcgggacctattcgcaatagagtggtgagtactagcacgcgtatgtaatatgcacgctcctgctttaaccttgcgacttactgtatttgtaacctacaggcacgagagctcttgcggatcgtcaacgacgcgggagtggcgcttggcatggctcctaggtcggaaggagagagcagcaccctacgcaacacccaataggtactcgtttagtaagacatgaaactatgccggttttctccaaggcgctaactgaacaatttggttgcagagactacagcaacgatgtcggaagttggcagcacggctggaatgtaggtccaacgatgccgtcgatcaacctccgggccaccaaaagggggaggaacaagctgaagtacacgtggaggcggatgaagaacaagagggggatgatgaggaggcggacgaagaagaggaagcggaggaagaagaggaagtggagaagaagaggaggcagttgagctcggtgcctcgcagctggaggatgcaccgcaatcgttacaggccggtccatcgcaaaccgggttgtctcgaccactacgcaggcgggctccttcccaggactggtggtacactcccggtgcgcctcgtcctcgcactaggggtaggaagaggtaagacttcctggatggatggactggctgaggagtagatgtgtatatacttcctggatagatgtgtatggactacggcttttgttttgtgactatggacttcatggagtgatggactagatgatggatggtttcatggcctatgtacttgtaggaaaattgatggtttaatggatggatggaatgttggatttatgcattttctggatggatttatgcatcatggctttgatggatggaatggatgtaatttatgcatttctggatgcatggaataaattgattgattgatggacgaatagtggattgtctgtgattgcctgtgaaatagtgtaatggatggaatggatgaatagtgtatttttgcctatgaaatattgttgtctgggcagagagctggttgtttctggaattttgcaatcttagcgccagactacttggcgctgagatgtccaacgtcagcaccaaatacattggcgctaacatctggatgggctgaggagtagctttgccgccttggctaagtccaaccttggcgccaaccactttggcgctgaggttgtacatctcagcaccaaggcgcttggtgctgacttccctgccacgtcggcagggggattacctcggccgccacgttggcacgtggtcagcgccaggcccattggcgcttcaatgcacaacctcagcgccaacgggcttggcgctgagccgacgacctatttttggttgaagtttttggtaggggctagtttcgaaataagtttttcaaaagggtcaattcgtcaaaaaaggggattttacgagtgctaataaatactatgtttgcatgttgggctttagatgttcagtggacattaactttacaaaaaagaagagattacatgtactctgcccattacttatatagattgtgcagataaccgttgtatgatgattaattattaagactgcgttcgggaggcaaggttggggaaacaaaagcacacgattatattgtgattaattaagtattagcctaaaaaacttgaaaaatagattaatatgattttttaaaagcaactttcatatagagaaacttttgcaaaaaatgcttcgtttagcaatttgaaaagcgtgcgcacgaaaaacgaggaaagtgtgttgggaaagaggggaaaagaacacagcctaagagcaagtataatagtgagctataagtctactataagcttatgtggaggagagaggtaataaaaaataacacaagctccaagacaaatacattaaatgtataagtgagagatagagagaggagaagaaaattatagccaaccttatagctaatctagtatatatgttggctttaagatgggctaatagtagaaagtgagctctaagcaagctatatgctaatgtggaagagagagataaaaaaaatggatagtgttagctctcctgcaagagctagctctacacaagctccaagaaatatgcatttctgtgggtctagtcgtttttgtcacaggctttttgtgtcttctgtgtatggttttgcctgtttccctttagcaaattgtgcagttgtctagtttttggacccggttttccttataaacagggtcaactctcttcttctaatatatccggtagatctcctaccatctaatgtttcaaaaaaaaaagaaatgtgcattaaattcatagagtgagaaagagagagaatggaaaaaaataaagctaaccttatagctaacttatacatgttagtactacgtaagtagtgagctctactatttaaacttgctctaagagcaagtttaatagtatagccaactactagctccaattcatctataggcaatctaatagcttattcatacaatagttacatactacactattaatatctggtcccacctttcatacacaatgcgtcttggagtccgtgctatagttggctacaaatctgtagtccactgctcttctctcacctcatttatctccttaaaatatgtttgccgctggcttataggctgctattttacctgctctaagtgttttttattggattcagtttccagaactagcagttcaaatattttcttagagcaagtttaatagtccagccaactgctggctccaaagcatctatagtcaacttaatagccaattcatataatagttacttataaacatatatactacacaatcaatatttggtcccacctatcatacacacatgtgtcttgaagtctgtgctgtagctggctacaaatctgtagcccactgtttttatttcttttcttttatcttcttaaaatatctttatagctagcttttagtctgctattgtaactgctattacccctcttaattattcaaccctcccagaaatatgactcatgttgttgtgacattcagttagtagttttatctatgaggtcgtataaaatcagatgggtttgtagttagggtacaaatttcgattatttgaacaaccaagcatagtaataaaatctttttattactctggctaatcttatgtggtttactcatctaaatatattttctttgataattaggacatttaaattccacagcaacgcgctggatattatcagttaatactacaacaactgctaattatttactctaaatgtagggattcttgttaccatgaaaaaaattacctgtttcaacattaccacctgcggatcaaattaggagcagagattatgacctaaatacctcttattaaatagaatgtttatgagtggacgtgtagcggagtaagataagaaaataaataagatgtgattaatgagacaaatagatatatatcgtttcgcttattcgtggaataaaccaaacgacatattcgcaaacaaaaagtaatatgtgaataaaacttttatatacatgttcttagtgatttaaaagtaagaatcagctctaaatttaaattgtggctgataaatacgagtataagcatacagatagagctactccgaaaactgataagtatgagtatatgattgaatctgaaattgtcccttattctaggatgcagggatgtactttaactaggagtaaagaaaatccctgtttaattaacgccaaactttccccaaattctaaacttttttaaaattatagaggcctcaccaaagtcgacagatcccgtaaaagaacaaaacttgcgggacgcctccccttacccctaatcccactccacccaacgaggagatagcgcaagagaggagagggtttctgcggcggcgatggcggcggcggcgaacctggaggacgtcccgtccatggatctgatgaacgagctgctacgccgcatgaagtgcagctccaagcccgacaagcgcctcatcctcgtaggtccgtacgcttcctccggcctcccctcatctagcttccctcccttctctttctttctccttccacgctccaagatctggtgaggaagtaggagatccaactcgtccccgtcccttccttgctctaggctccgggtgtgcaaggcttggtggttcagatcttagtcgcttcgcctttttctgccccttttgtttaatgctccatcgaaagtctagtttccgatgttttccctttcctttgcaactgtagtgacatggagaagccgttgattgtgattcgggtaaaccaggtcgaagtgcgtgtggacttggtaccaagagtagaactgtttcgctcttccagatttcttgccgttgttttgatggattatttcggcaatgagtgcttgtttgatggactgatcttctaaaacaatcttttcttttattaggtaaattgcactaaattcttttagaatgtgttttcttgctctacttttctatgcgtatgaggctgaggaaaataacgaccttattatcctgaagaaattctttatgtcattgtggtagcatggaatttgtagcaattggcttgttccatggaactgataaaaaatatttttgtatgcattgaagtcacaagggagaaaagtagtatttctcagtgttgtggaagtcagaat

SEQ ID NO: 75480 - DNA, 31601 bp, Oryza sativa
gttggtgttacagtatagtcctagagactatttggcgcgcggtgattttacctatatgaggtattttttggtgattgatgtttttatgctacaagaggaaattcgtctcaaggtggagattgttaaatatgtgatccgtattttggacccacaatatattcggattagtttcctagtaggagtcctatgaggtgtctttctattatcccctatatatataccctggttagtcgtacaggaaggggtgacgttcccattgtgattcccctaagtttgtaatcatctcctctacagtgatcattgccggtcggcgcccgtggttttttcccgcatatgttttccacgtaaaaattcgtgtctctgttgtgcatctattttcataacacatggctagcatctgactcgggttgatttctttcttatttgatataggaatggaagccatgaggaataaaagcataacagtcgtaggatcacaagtcactcgggtgtatcatcgaggaaggtagcagtgaaacagcacctgcagtaaagagaaccaaccacccatattactgcttgcaaacacacagtcttcaactagtgatatttacgatttaccgtaggaaatagaagccaggtccggaatggtaacgatgcaacggcatcaatttcaagcaatcctattgtaagtgcttcgatttaataattcacattatactacttttactacaaaatagttatcttaattccatgaataataaaaccagtttattcatgctttgatttaataattcacattttacagcttttactaaaagttagatactttaattattgctctttcggatgaacgaacaaattaattgcaacaatatgtcattttgagctctacctcatgcacaagttgtatttttctactggactagtaagcctgcccgtgtaatccacatagctaaaagaagtctgacattatatttattaataaataaattattaaaaactacattatctttaatgagtaagtttatctcaaagaggcaaaaaaaatgatgtaacatccatcaagttgtgactgaattcgtacttctttttttttttacgtcgggcgtgttatactatttagaaaaattcagtgaaattgaaataggctcctctaagcctaaaataatgatgaatatgctatagttaaagataacaaattaacaatggttaagaacatttcaaactggatgatccagtcaaataatatgagaagggtactaatgagagaagtgcacaaatttattctatgacaatttatataggtacaaataattttcctcctgtttggcctcccccaactgaatcatcatctacaccttgtccgctgaccacagaaagcagatactcttttctgtatgcctatgaagatatggtcagttggtcagaaacttacaatgctcaaaagaatttctatcactacctaaatcaatgaaagttggtcacaaactcaaacaatgaaagtcacgaataatgcttatatataagaggtcaaaaagacaaggtaaatggaatttgttccctatcagtctatatattaggcaatgaaataattgtacactggagcataaatacatacttgcaaggcctttaatttttatcaccatgaaaaacctgcaacgcaacaaccctttcttcttctttttttttaactacttcctgagcccttcaattatgaaatggcattatgatagtggctataaatagaggctaaaagagatcacctctgctgaggtacgtttcagtttgaaggatgcatagactatatatgcgagagaactatacgtgcatgttgcagagatcccttttctgatgtccaaactatatggatggaaatggaagtcatcaaagttttaaaaaaacaatattttgctgaagatgagaccatggaagtatgagttttatagttactatgattattatgcttcttcaatatttcttatattgtgaggtagcagtactaacggatagggatggaagtgggccaatccacgaatccacttataagcaaaattagacgggttacctactaatttgacctataaatgggttatggatcaacccccttgcatttctaggtacgacgataaactagaccacaaagcaaaaacccacgagtaaccacttatttgatatattaggtgataccacgcgctttgctgtgggatttattgataagtatatgttaaatatcgccgaaatgatgaaagttgaaatgttgagaaaataatatgagaaagatgatttgacatatacttgttgatctctataatataatattgtagatgatgtgtcatgcttacatgtgatttaaaataggctagaatagtactaattgcgaagatcgatgtggcatgcttacatgagattttaaatgggctagaatagtcattactagtgagtgatgatgtgacatgcttatatgttgagctttagcttctaataattgttagtgggtatcaactatatagaatgtatagataagtaggtttgtaggttgacccgcttgggtccctactaacggaagtccttcagaaaataaaatgcaattttcagattcgcctgctagctgttcacctatatattctgtccaaagatgcaacagagatagcatccttgttccagaatatctaatctattttgtatttgagagggtgcaaaaatggtactacagtttagcaagatacttcccattttgatccattatccaaaaaaaaaaagcatcccattttgatgagtgtgattgagagagttaaaaacaaagtggagttctgatgagaagtatatatgggattggaagctgttgggattcaattgacgactcaatcaacggaagaccatagcaagggagaaaataaacaggccgggagaagcaaatcacagaacattgaaacgaaaccagacaaataatcaacgcccattcgaaattcgccaggattttagaagcgatgggagctgaaatattttttatgtgtaatgaacacagcgccacatcatatgatgcgtgcccctctgttctcctgttctttgttagttttaaaaaacacaccttgtcatctgtgatgggccaagactctcagctgtgacgggttagaacctcgtcacatataagtggtcactaatgactctgagtcatctgtgactggcgaagacccgtgagaggaaagagttagctttgatgggccgcaaccaaaacccatcacaggtaaccttcgtttgtgatggctaatcattttaacctatcattggtggcctttatctatgatggacacacctttcactactaaaaaacgatttttcgtgacgtcgtcctataattttcattggcggtcatatgcaaaaattgccactaaaaatgtgaccaggggtgagggactacggattgccagcgaaaatcggttttcgctggcggccacgctaagacgcccgtcataaaaaatagctctattttcgctggcagcggctctaaaaggcccaccataaaaatccgggttttcgctggtgctcaattttcgctggatgcagataacagcaccgtcagtgaaataaaatttgacgctataaaagcaccgcccccacaccagtgaaaacccagttctctccgccacgtccttatcctatctcctcctcctccatccactccctctctccctccaatcctcgctccctccaaatccataggcacgggcaacggaggagtgcgctcgtgaaggcggtggcgaggcacgggcggggagggctgattcgccaccgctgggccgcgggaagggcagatccgccgccggaccacggggagggcggcaccgaccttgatgccgtcgaccgtgctgcccgactccctcctcttcgacctcaacgccgtcgaccgtgctgcccgtctccctcctctccgaccgtgctgctagatgtgaattttttttgtgcatgttgttccagatgatgcacatgttttcagctgtgtaaatgatgtttgatctgtggacatatttcattttcaaatttcctctgcgcaccagtgggcatattcatttttgcttttcaaatttcctcttcactagcagctagggcagctgcatgggtttgatttttgcttgcggtcgatttaacacagctgccagcgaaaatgaattatcactggcggtcggtgtaagacaaccgccagcaaaaatggatctttgttgacggctggcttaagacgaccgccagcgaaaatgaattatcgctggcggtcggtgtaagacaaccgccagcaaaaatggatctttgttggctgctggcttaagacgaccgccagcataaatgaattatcactggcggtcgataaccgccagcaaagatcttgatctacactggcctttgctttgtggtggctccaaattctgccagcgaaaacctaaaatggcaaccacgaaagatggttttcgtagaagtgttttgaccaacttttatttgtgatgggacataattgggatccgtcagatacaagaaaaatagggaaaaaattaaaaaaaaaagctatctggttagctagtcacaaactttcatctgggaatccaaaataaaaaattcataataatcacattcacattcatctaggcacaaaacaaaatcacagtcacattcacattcatcttggcacaaaatagaatcataaaaaaaaaatatagacactggaatggaaagcttatgctgttgatggacttcactgcggtggtgcatctcttgccatgcttgacgctggaggaggagtgggtcgatggccatcatcgtagccgccaccgcggcctctgaactcgaggagttcagatcttgtgctcacgagaggtggcagcgactgcatccaaaggggaagggggagaagaatctgtcatgtagctatggtagagctcatccggctgttcttctggtagagctcgagtggatctggaaggagtagaaactagtggagatctgctcgttgttcaccaccaccagatttggctatcggtggttggatccgcccaaaaggcggttcggggtgttcagatcccaaggccggcccagcactagctgcggaggcagagaatgggtctatgatgctgtggagttgtgcccctccaaagctcgtcactatccacgccagaggagaggtcaacagctgcacaaccacggacgcttccatcaccggtccccatggtggatggccaaatctagctaccatgaactctgggaaaagcttgatcccacaatggtcggcccgagagtggagatggaggtggcagccggcactccgtggcaaaaaaatgcagcctctagtgcgtggttaaagacgtatgtagaggcgtccgtcgagctagggttgcaagcgcttggtgaatcaaaagagagatgatgttggggaatcaaggttaggcacagtcagcaggagcaaatagataagattgaacttgttaatagtgatgggtaaataaaaataaaaagttgtttgaggggaatcaaggtttggtagtattttcaatccgttagagataatagtgctcatatgtgataggtaataattcaacatccgtcacagatgaatcttcacctatgaaccgaaagatagcatcaatgtcaggtctacacattaactcgtcaaagataacgtaacacctatgacgggatgtatcatccagcctcatctacaataggttttattttagcccgtcaatgataaagtcctgtgtgacggggcaatctggttcgtcacagatgggctgtcataaatgagtggacgcgctgtcctttaattttgatcactgtatatgataaaactgtaaggctgcaaccatcctttcctcttaactatttcctgagcaaaaacaaaattttggcccttccactatgaaatcacacaatgacagtggatataaatagaggctaaaagagatccctgtgtgttgagactacgtataagagaacgatatgcatcttgcagcctccatcgtatatcaagttaacaactgcgataaatcatcatatgtgatccgaacccatcttgattctctttcttatatcatctatgaattaatggaaatggaagtcatcaggaaccaaagcataacaccgttgctatccatgccaaccagaaattctctccagtggagccatcatctaggacgccgccgaaacaccgggccacttttcacggtcgacaagtcaggctgctacggtgatcagcgttggaggaggttaatctggtttacgatcatgctgtcgtcgctaattctctcctgtagcactactacagaaagcgtttttgcatacgggcggaatcaattttcacatgcggttggccggcccgcatgcgtgaaatggtctgcaaagatcaccatttgcgtatgcggccgtcgcagccgcatgcgaagatcgatcttcgcatgcggtcacttaagacggccgcatgcgaaaatagatcttcgcatgcggtccatctaagaagccgcatgcgaagatatattttcccatgcggtcaacctaacaagaccgcatgcgaagatctattttcgcatgcgggcgtcttaagtagaccgcatgcgaaattcaatttccgaatagctaaaataatatttattctagccttttagtgagatgtgtctcgtaattaatattaaattattgagggatttattatcgtatttcggagtagtaagcatataagataagacaagtgccgcagtaacaaacatgtaatacataaccattaattcaatcgtaatttacatacgaaatatataatacaagtggcacagttttttcatcatatgtataagtagtgtacatgttattgcatatgttctttctcccactctctgagaggtttaaatttgtcgtccattgcgagttcactctggctgtcgtagaagagacctcttgcgtcccagtcagcctgcgatatatgtccataatccgtaaatggtgggagcttcttctgaacataatcccgatttagatcggacttccactgtcgccatcgatctcccatctttttaagtgcgtaatctctccccctgacctctgatctaggagggaatacaaaatacttctgcaactcattccagagaagtgtctttatgttgtcgtctaccgtttcccacaactttacattaatgggacaacacgtcctgactagagtgccacaggcgttgctgaacttggaccgcactatcggtggctcgacgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtatccatctcaacttcttgctctgtcctgttcctcccggctttacgtttcgagcggcgtcggactaccatctgcacagaattggtaactctatacaccattaggttcatgtcacatcatagttagggaataatacatggctaacgattttcagcacttacgccctgttcgataggtatgtagtccggatcatcatcgtggggggcgacttgtgttatttccattggaaacgggtcacttggtgtgcgccacgtttcttcactacaaaagtctagctgcttattgctaccggaattttgaggagcgttaccttcttgaggcgctattggtgagttcgatggaaccttttcgttcgacatcttccaacttgacgtaaaaaaatttgacataagtcccaattttactaagtcccaatttaacgcaatgtcacataagtctcaatttgacataagtcccaatttaacataagtcccaaatatacataaatctcaatttaacataagtcccaattatacataaatctcaatttaacataggtcacaatttaacttattttcacataagtcccaataacttaatttcacataagtcccaatttaacataattctcaatttaacataagtcccaatttaaacataagtcacaatttaacataggtcccaatttagcatcagtcacaattaaacggaaatctccatttgacataggtgccaatttaacaaaagtcccaattatacataaatcccaatttaacataagtctcaatttaaacatcaatctccatttaacaatctacaattaaaccttctcaaaattaaacaatcaacaattgcacatatcacaatccacgatgcacaattaaacaatccacaatccacaattgcacatttcactttttttttaaagtaaatgttaccgagcgacagcgagggggtagaagtcctggcagcggcgtcggcgacggcgagggacggggacgacctggcggcggcgatggcgacggcgaggggggagaggtccgtgcggcggcgacggcgacgacgaggaggtagaggtcctggcggcggcatcggcgacggcgaggggcagggcgacttcggggaggagccggcggtggcggggacgacttggcggcggggacgacttggcggcggcgacggcgacggcgaggggggagaggtccgtgcggcggcgacggccacctggcggcggcgacggcgacggcgaggggggagaggtcctggcggcggcagcggcgacggcgtggggcggggcgactttggggaggagccggcggtggcggggactacttggcggcggtgacgacggcgacggcgacttgggaaattttggcagcctggcggctagggtttcgcgggcgccaggacttagaaaattttggctccccgcgctccctatatataggcgcagatcatcgcatgcgggcggcttaagggaccgcatggaaaaaatatctttccatgcggtcgacatatgccggccgcatgcgaaaattatctttccatgcgggctattaagccagccgcatgcgaaaaagatatttccgtgcgggccataaagccggccgcatgcgaaaaagatctttccatccggttggcttaagtcgtccgcatggaaagatctttttaccaaaaaaactcatatttttttatttcctctaagtaaactgtacatatatatttttttcccaatatttcgccacaattatacattccaaatgtttttggcactaagaaaactcatgaaaattgctcaaaactcgtaaccaaatgttacatgctaatgattacaacataagggggacctaaattcatgcacgtacatttggaacacaatgagaactaaaggttacgaaataactatgacttaataaccttggcaacaccatctgctcgaacgtacgacatattcacttcatcgattgttcgctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccacacgctctgctaaaacccatggatcatccttgtggcctattttactgtgatcgactatcgttagcccgtagtcatcaacggaaacccctgttgtgtctttaacccattcacaacggagcacagggatctggatgtttaggccatagtccagttcccatatttcttgaatggtcccataatacgacctcttttctccactcgtgtcaatcgcttcgacacggatcccactgttttatgcggtgcttttcatgtctttcgtagtcgtactcaaggtaaatccaatgatgtcgtaaccttgccatgaattgacaatacttgaaggcccacatgccagtctttgtagagtaagttcctccacagaatcaccaactggtaggtttagatctttcaaccccagaggaaagcgacgcttgtgctctcttgatacccaatcattggaccgccctgggaagcaggctttgatttcttctaggtgtcgctcaatgaatggctcaacgatagcgagctgttgaagaacgctgttgtgtgctgcggacacctttttgtaatcattatcgaagaactgcttcctaccaacaataccccttccagacaatctaccttcatgtcaatgaacaggaatgccaatggcattagcatcctttatgtagtccatacaacactcgactgtctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccagaggatcaaataccttctgcgaaattcgattgaaaaagtcatggactggtttgttataaccacctttgtatggactggtttgactgcccttatagcaattggtaggaataccgttagcagcctatgacagtcatgcgcattgtatcccgaaatggtcaaatccttcatggatactagcttcctgatgttcgatgcgaaaccagtaggcactctaaccccttgtaaacatttacagaaggcttttttctcttcaagtgtcaacgagtaacaagcaggaggaatctcggtcttcccatttggcagcactactgggtgaaggtcatgccgtatggacaaatctacaaggtcattacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttccactttactgtcttcttctttccctttccatatacaaccttaatcttctttgttatctcatacatgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtacgaagttttctccagacatatcagacatccagtcttccctttaatctgcccagataatgaaaagtttgcaggtaggtcattgatggtaacgaatatgatcgcacgtagattgaagtgctcccacttaaactcatcccatagtcgtaacccctctttccaaagctcctccatgtcctccatcaaaggcttaaggaaaacatctatgtcgattccaggttggtttggaccttgtatgaggatagtgagaagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcaagcgtcggcaggatgtcgaatcataccatctattttccagctctcttgaggccatctcatcaactcagcatcagtcgggtttgagtacagacgcttcaggcggtccttaattggtaggtaccacgtcaccattgaaggaatcttcccgcgcttacccttatcagaatctggatcagtacactctgaatctacgggcccattccccgttttataccgacttgtgccacacgttgggcaacattccaagtccgcgtattctttacggtataatatacagtggttcttacaagcatgaatcttttctacaccaagagataaaggacatatgagtttcttcgcttgatacatgttcgatggtacaaagttaggcttaggaagcaacacacgcaataaactcttcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcctgccaattctccaatcctcgtgacctgcccgctagcacctctggttcaacatggcgtagcatatcctctaaatcaaaaccaccatcgaaatcatcactatcggtggaaacatcgacatccattctttcacgcgacatgtcttcgattataaaattctctgcctcatttatctcaaaacttaactcttcatcgtcatcttccggattggcgaattccccatgataggtccaaaccttgtagttggcggtaaatccgtactccattatgtgacccaatatttcaccaggatctaccaacaatttctgattcttgcaatgacggcacggacaaaagatctttgtcatattctccctcaaagcatgcgccttagcctgatcaataaatttagatgcttccttaataaatatcggttgcgttctccgcatctcatacatccatgacgaccgatccatctaattatataaaggcaaaaaagttacagataaaaaaatagaccgcaggtatttcatacaaaagtttaaatgcatttgtctcccaaaaaaaattacaacaatacatgtaactagtatgtacaagtgattacatgcaaaatttgcccatcaaaacaaatattttgaagctagattttgcaaaaaatagttagaacaaaccttgtcaaaatattaaaaaaactccactttccaccaacgaaatataacaaaaatggagccaaatgaaggaggatagagagttcttcacctttcgtatagagttcaagcaaaaatttcgagttgaaaacctccccccctaattggtgcttgctttaggagagagaaagcttcgttttcaaatggtcaagctcgggcctggaggagcatatatggccgatcatcgcatgcggctaatcgacccgcccctgggggggcggtttttgcaggcgccgccacaagcggcccgcatggaacctaccgaccccctcgtacagaaaaacgaattttgtagtagtgtcgtctgcacttcatctcatataccaaattcgcacctagatcttggatttgagaatcaccatacggcctgcttggagttcaggagattcctaacttctattgttacaaaacgaatcgatgagggataaaccctgtgtatatatgctgtagaagaaccggcacgtgctcaaactctgttctgagttcaatcaaaatgacagatgcttgaaatctgaaactgtaattctgaagaaattcaaagaaacaaaaatatcagcagtagtcataaatattagtctgtactatggagtttggaccttgacaaaatgggtttgtttattgcattgttgatcaaagagattagactataacatagaatacgtattgaccatggatatcccaaccaatcaaaacatatcgaatacaatacaaacttatcaaaactgtcctggcctatctttttcgggtatcatatccattcaatgtttcatataagagtttcattgtccatcagaaagcaccagtgatacgtactaaactctatactaaactaaatgttttggtaccttgagatatatagtatcttaccaaattttacattagaaaatatggtaactgatcctgatacgatctcaaggactatcaaagtactcttacttgtaagataacatgcctattcaatgccaatcagaatatatattggacgcaacaaccgacatatgtgagcatatgaatgctcagagatggacaagaaagtgcaggctctcgctaccagaaaagagcaacatctatatgtcgtgcaaggacacaagcacatacagtgtgggaatcgaaggcatcagaactacaggacagtataacatagtgcgagacatctttgctttaaaacttcgcgatattctctcgcgtcgccctccccaccggcgacacaagaggcgacgccgccgccgtcttcttcctcctccccccctccttctctgcctcgccgccacctgagcgggtgccggcaaagccgcgcggccgcggggacggcggcggcggggcttttgcccagcacgcgctcggcggcccggggagctggccgggcggcgacggtagcaaaccgtccggatctgcacccgcccggccggatccggcggggtggcgcttggtggcggggcggagtggtggcggcggcggctggaggtgcgtggtggtggtggacagggccggcggcggcggaaacccccgcccagatccgcgccgttttggccggatctggtggggctaacgccgggcgacggcgggcggcgaggaaacaggcgtgctggcggtggggaagaggtggcggcggcgacggttgcgcgggtggcgcagctgggcgaggtcgcggcgcggccgggcgcgtgtgagcgtcgccaggcggcgattgaggccgttgcccggaggccagtgaggatggcgatggtggccagaggtggatcccccccccccgagggcggatccggtgcggggcaagctcgcggcggtggcggcaccgcggagctcgcggtgacgtcggcggtggcaacggcgcgtgagcacggggcgccggcgacggtggcaatggtatggatttcatggcgacgatggcagcagcggcttgtcggcggcgaaagcacggtggctggttgacggcattggcggctgtcggctactatggcattgcggccctcgcggcgaaggcagcggcacggaactcgtggcgacggttacggtagcggctggacaacggtgatggggctgtggctggccgacagcgaggtggtgtcggcagcagcggctgtggtggtggtgggaggtggcatggtggcctcggtcggctagctgagggtgtggcatacggttgtatctggccagcgcgggagagtacggaggtggggtcggagattggcttggcgcagagaggcgcagccgatggcagcggaggccgactcggtgcaagaggcgcgggcggcggagatggaggccgatggagggaggccggattggcgcgagaggcgcgtcccgtggaggaggccggtttggcgcgagaggcgtggccggcggtggaggaggcgaccctggtgcgaggaggagatgccggtgggtgtggcgctatcttcggcgcacgaagcctagccggcggggggcaccagtgcagggttccccatgtcggcagaggctgagtggtggtggagcatcggtgcgttagccctggattcgcaagcgtgagcggcgggtgaaaacccagcctggccttggtcgggccgacaacaatggttttccccctcctgatggcgttgtcgtgctgtctcacccctcaagggcggttgctgggcataagcccagtcctggctcttttgagccccgacggacggcggcggtggttttccatcgcttttcttcttgaagatgtcgttttggcaccccctagctgtagggcgatctcgtctatgttcctttattggtctagcggcggccggtccgatgctagcctcctcctggtcatgtgtgttggcgctgtcggtgtgtgggaggcggtatattttttctttttcctggttatgaccctccagggttgtaatcttgtaattttttactgctttatcaatagaacttcacaccgtacttcacaccgtctcgtgcgagtcgttcaaaaaaaaaagaactacaggacagtcattccggctaaatttgttttgtgcgtcatctgcgggatgtccaagagcttcctttgttttaatcgtgtccgtagattagtcgttggattatacgaaaattgatacaattctcgtctcaataaatttagtagatttatctatgcatttccacaatttataggacacctctgagtatttgtcatcagtatcaaagtaaattgaaaaggagcactttcatgaattttattaggagtcaatatatgttttaattaggattgaaacttcatgtatcagtggataagtcgagatgatacaatcacagtgaacaaaacaaaaatttgcaataacataagatcattaaataattgattctgtagttagtataattatcgtttattaatatttcttctattgtcaagtagtagtagcgccaaagaaatcattttttaagaaaatataatgcaattttcacgttcacctactttcagaatatttctctatttgtatagtaccttctaagttccattctttgctaatcccttctgtacttgagacggagaaaagatagtactgtaacgtttaggatgttacttgccactttgatgtttgtgaatttagacagctaagaacgaagttgagtactgatgagaagaatgaatgcatgtatgactattttttttaacttatactccctcgtatttattttaatgtatgacgcgttgacttttttatcaacgtttgaccaatcatcttatttaaaatttttgtacaaatatagaaacattcatgtcatactgaaaaacatttaatgataaatcaagtcataataaaataaataataattacataatttttttaataagacaaatggtcaaacgttggtcaaaaaaccaacggcatcttacattaaaatacggagggagtacttttttatatggttttgaagttattaggattcaaatgatgactgcatatcagaagattttagcaagtggaaactaaactggatttacaggtggccaagcatcccttgacggggaagcaagagggacataagactggaatcaaagtacacaaataattaaggcccgttcaacctagaattttagaaataatgggagctcaaataatgttttatgtcaaatgagcacaactatttagaaaaggtagtgagtgtatcattaggaatcaagagtaagaaaactagtacatgatgcaactacatatcatgtattattaggagaatcaagactaagaaaactagtacatgatgcacagtgcatcattgatcactgcaaaatcactgtccatcagaagactatatcaattcagactcaatcatcttttattttgaggaaatcaaaatcatctttgaaggtgaacaagattatgtcttttgacccatgccggccagcatccccacccacatttccatggatcaaatgcaacttaggttgtgagcattttgcacgttttgacattctcttatgcgttagtttcttcatataacattttgatttttttttgcttgcataaacacataaacgcataaatgcatgtcgtttatactacctccatcccaaattatatatcattttgaatttttgcgtgcaacatttgaccgtttgtcttatttaaaaagttagtgtaaatataaaaaaggataagtcatacgtaaagtactttttgataataaagcaagtcacaaacaaaataaataataattccataattatttgaataagacgaatgatcaaactgttacagacaaaaactcaaacgacaattattttgagatggacgtagtactaccaaaaaataaaaaagaagaatagagcacatgacatgaccgccatatatacatgaccctttcttcctttttttttatctcatatcaaacataggtattggtttcttttttccttttcattatgaagaagagccagccaaccatttcttgtttttaattttctgagaaaaacacatggtccttgcatattgataaataacattgggatataaatagaagccagatcacccgtgttcagatagagttgaaggatcgaggagaggatgatgcatgctgcagagcttccattaatcaagcacggcaatcattaaacatctcacttggttgatttctctcacctactatatgaatgaaagtcatcaggaacactactactgcttctggagcagatcaaggctgatgaagtcaatgaagaagtctgtgactttactcagtcataatgtcatcagaaacactactataagctcatgtccagattcataatattaaaaatatcccatccatccaaaatcccttatattttaggatggaggaggtatattgtccaatcgtgtacatgctttttgcgagaagaacgtcaacattgtctaactcttattcgagtacaatcaaattcagcaagaccactacactgtgcactgcggcttcaactctgaatgctaattattcgaaactgcaatactggagaaatcgacgggaaaaaccaggtgaaatcttgtttaaatcatcaatatgggtccaggactccaggcctcagaaaaaaaaaagagtttgtttattgcattattgagaaaatccacttttgaagttcataagtaatatcgggcaaagtcatcaaaatgctcaacatctccctcttctcacaagcatgtccattccatggtaatggtacatatatgtgtttttcagcgagagtataactccatatactctgtacataatacacacttacacctgattgtgttcttcacataagcataaaaatatattgttggaggcatggataattctaaaatgattgggaactagtgccacgatcttatttcacctcattatttgcctcaagctttttcttatgctcaaatagttagtcgcaatgacaacaaagtagtgaggtcaaaggttaatttaccagtcatcgataaatgaaggcgtaaagagatttcatgttctgtggtggagctgaagaaggagaggatgatgctgatgattccatgcatatatagatcgagcatggtaaccatcaaattcatcgtattcaactcatcttgatttctttcccctatgataatatgaatggaagatattaggagccaaagaattaccaatgacttgatgatgttgtaaaatcaaagtgagtttgattcttattctgtgataaacaattggcatttaatatttggaaattattggcaaagtggttttggagatgattggattttataggtgactgacagggattgctgtttgtcgggaccggtcagaccgggtatgggttgccggtcagaccggagtgtatcgagcggtcagaccggcctgcccacagtctgaccggggcgactctgtgttagttacaatttcgggttgttttattggatatccatgattgttttatgattatggcttctagatggatactatacgcactacaacaaaaacctcgtatagaggcactttcgtagaggcgttttgtaaattgcttctaatatcataagttttattgtgtagagacactttatagaggcactttaacaatttcctagaaaaacttttgctctagagatattttcagctcagtttattagattttatctcgtagaggcattctttcggtactgtaaaatatgcctaatatgtaaaggtattttcttgagacattttaaactatttagagacactttttagaatgataatatgtactaaaagactaaatataagtaactaaatgcgcaaacatattagtaatgacaaggagttgagttggttagttgtcacgctctgaagttcccctccttgctttaaaatttgttaaataaatcgcccgaagaaattgtttaaattaacctggcgttgaatccaaattaataaatgcaaaaaaaaataatcgaaatcggcatgtggaatttttcttcgattctacgtgtcaaaatatgctaacaggatctttagtggaattttcagagccttggaaataattttaaccaattaaaataagcaaagtacaatatttaatccgtgggaaaatcctttttttcccttttctcttttctttttccctcctttttccttctcttgggccgccggcccatttcttcccgcgccggcccgctcctccctcccactcccgaagttcacccggcctccctctccctctcgggcgctgacaggtggggcccacctgtcagccctttccccaacctctagccgctcccccaagccggcaaccgccaccgcgcccacgccgcccgccttcctcgcgcctccgtgcccccactcaccgccctctcccgtgctgtccattgcgcccgcgccgctcaccccgccgtccgccgctcgccaccgcctccggtcgccgctcgccgctactagggccgccgccgcaccaagccaccaccgccgtcaggttcgcaagcctgagggccgcctcgtccacccctcgtccatcgcaatccgtcgccggagatcgccgtccacctcgcgccggtgagcaccaccattgccgccgccttaggccatggtttccgctcacagtaaaccttctctctttctctaatccccctcgttgggctccttaggcccacccggagttcgttctccactcgtcgccgtctcccggtcgctcgtcgccgccgttcgccgtcgcctttcccccggctggccgaacccctcggtgagaactccctcctctttccttcctctcacgcgcgccgctgctccccacatgcgcgtcgccgcaatgcaccgccgcccgcgccgccggccgcccgcgtcgtcggccactgctgtcttctcgccggtcgccgccgtcggtgccgcttgccgtcgccgcatcgcctaactggcctgccggtttgaagccaagccgagccaaccggccgcctccccctccccttgagccactgccaggtggggcccacccaccagccggtgccacctcctcccccttgagccgctgacatgcggggcccgcttgccggcgccgacccccttatcgatgacgtcagccctgggaatattgcgcaataatcgaataaggacttttctttaatagtaaaaacacagataatcttccaaaaatcatatctaattcatccgagctccgtttaagtccattcaagtctcagtaaattcataaaaatgcaaagaatccattaaaaatggttttgtttcctggttcagtagactaatagcatgttttgcatgtgtgctttgtttgtcacgtagatttcggccgttccgtcgatccgcggtttctcgaagacgttgttgtggtctcatcagtgtgagagcaaggcaagtcatgcattacaattgatcatattgtacccaatttagaaatgtctctcatttctattaaatgttgcattgttttacaatatcatgttggatgggtcctactactcagccatatattgtttaccttatgccattgataacttgggtattaaaatgcttagattttggtttagggaatgcttagccatgcttagttcaactagtacacgaagggggaatcacattaatgcatagactttgattattggcaatagctttggattagtgccactgcaatggtgttagtgaattaaaatacactacattgtgggctgtgggtgcatggttttgctagtcgtgcccatggcgattaaggaccggttcgcgggatgccctataagaacttatcgtacttaccacaagccagcgtgggcaatggctgggcttgtagtgtagctttcctctagccgacgtacccaggtgagggtgggcgtgatggagttggttcagccggggtgtccagttgatcggcttccggattcaccgcggcacgagaggggggctgcccgttgcctgctggggacgggggtgaaccctgaggtgtggtgcgatcggttagagagggttatgcgaagggtcctgtcacggcctctttccggtatgtcgtggtggcatgtcggcgcacaggaacgtgtcgtgggactgtgtcttgtgggtacagttgtaaacctctgatcagagtaaaactattcgaatagccgtgcccgcggttatgggcggtcaaccagattcaccgtgattagtctcacccctagttagctaatgaactggtgtagttcaggtggtttgttgggcctgttgcaacgtggtgtggcgttggacagtgattggttaatattgattaattactacaactgttttactgctttcaactactgcttttaaatgcccgctttatgcaaaagaacctttagcctcctttggatacatcttgcatcataccttctcttccggtatgacttgctgagtacagtgggtagtactcagtcttgctctcttttcccccacaccagagttgaagttcttctcagttggggatgtctcgaagaagttggtttcgtcgctgccgtcaaggatgcctgaggaatggagtcgcccgctgcagtagtcaagtcttcaggcttagctcgcttttatcttttccgctgcatttgtaatcttttatgtttttgtaagacgtggatctgtatgtcaacaattgtcgtttgtgtaccctggctggtcctggacaggggtttaatgcatattcagcttagaaattctggttcgtgaatttctaggcgtgacattagtgcattgaagataaaattatttgttcaagaaatcttgagttcaaggcttgacaaatgcaagaagaccattttattatctttttgactggtttcataagtctgtggtacaatttaatgtctctagaaaatgcctctaccatcttatagacattttacaaaatgtctcttcgtttgtagagacaattcaccataacacaattattagacattttttaaaatgtctctacagtattgtaaaggcatttgaaaagtgcctctacagtaatagaaaaatgtctctacaaagcatttttttagtgaagtatgtaatactgttgtttgctaacaatgagtcaggttggagatagcttggtctcggaatatggtttctttgtttgattcatgtgtaggtgacttgatgcctcgggagagtattggcggtgatggatcgggagttgacttggagataaggtgacgtccgtgacggtcagatatcatgcgggatacttaggctagagtgcaatgcatgtggttggtgaatattccatatggcatacgatggagatattgtgtgcgtatgggatgcgaagtcgaatttggaaggagttcaaatttggtatgattggagtttgtaaagttggtttcttgtacgagaaggtttcctaggtggattaggacttctagtatgagtttggttcgtggctttaggctgcctaccccatgtataaatagagagggagcgtgaggcttcccggtatcgcttttgagagcattgagttgatagtttagttagggtttcgagtttagtcgagattttcgtaaggagtgctgttgttgcactttgtaaacatagagagaagtaataaagttgtcatctactttgacagatcttcaatctatgttttctcgggtgcggcggtccaaccggcaacacaccaccggtcagactgatggcataggctcagtcagaccggtggagtaacggcggtcagaccggcgatggctacaggcgacattggctaatctcggtggttataccggagcaacaactgcggttagaccgacggcttccaggcggtcagaccggctcggctacttcggtcagaccgcgatccgtcgaattgagagtaacttttatttccactaaaagttttggtttttgggtacaccaaccatttatccctctctggttggcttagttcttgtgtttcaatcctacatatgtgtgctgaaaattaagaaaacaattacgtgatcttctggtagacaaaacgactaaagtttacatggaggcgtacaatggatgacaaaattgttgtttgttagagtttttatttttatttctttttttgttctgtgaggaagcagggtacacctgaaaagcatattatatgaaaaatatcttattgatgctgatgttgatcagttcccggaacataaatttattgatgcccacgagcatggattaggatcgcactggagaaggaaatacagaggtgggagaaggaaatgcagaggtactacagtattttgcattagcttagattttaatgcgttcaacagtaaaactggtaactgttagagcactgtgctaatgaagatcattatagtgcaaggctcagatctccaaagacaacactaatacagagtacctcatatgtgccaatagagagccccttatatgtgcataggtgccaatttaaaagtatctttacccatccgcataggtgccggttgtagaatcagcacctatagagattatagatgccggttctacagctaaaataggcaattatactctttgaacaaataaaaaaacccgagaacccacccacaaattcaaagcaatatcacctcgttggggccaccatcatcacagattcgattacagaatcaatctcataaaacattcatcacataatcaaacacaagaagagggaaaatctagaggaaaaatttgcaaaaggaaatctcttaaaacattcatcacaaattcaatcacatgaagagggaaaatcacttggaccggcggctagaggccaaggcgcgcagccgccgccatcactgcttgtcgtgggcagctcttgttcagtaaccgatagggacctccagaatcagtcggattcgtggcccccaaactccaaccgacgaatctagcgaccgaggaggaggagggggacgcgcgccactttgcctgctgccgcttggagagaacaggaggaggacgcaccacccgtgacgaccgagtggtggcggcctcagcgtgcccactgcgcgcaaccgctcattgccatcgcgcccgctactgccacgcccgctccaatcgccacctgcccctgctgcgctcaatacatgatgaagagagggaaagaagaggtggcaatcgccactattcgcaaagggggccgccgctgctgcaaggagaggaggaggcatggcgtgggagtcgagaggcgataaggacggctgggcttggccatgtggtcgcatggataataatgatgcgcggcatcgacaggagtgtcaatttttaaacacatataatatatattattatagctgatggtttttcctctgtaaacgctatctatagtgtttaaggtgttggttcgatatatatatatatatatatatatatatatatatatgtttttttttgtcatgtaaaggtaggaaaatgaaccatcacctatgagccgtcctttataagaggtttataagaggttttagtagtgcatgcatcccacgaggatatataggatggtgcaaattactgtaattaaacatggttgcgtatggagattgccgatcgatctagaaattaagatgcgatctgttttgtggagtaaccgtaatggctgaactatacaatgagggtgaaatagtattaaaaaaaattatgtaagcgtgaagtgagcgtagtttaactggttaggtttcttgtggtggaaccaacgcacctggattcaaattctagatttaacatgagtgctcgcatttaattattctttctgtggcagtgtgcacacgttgtaagcgtctgcatttgtacactgtgtttctaacaaaaaaaaaagggtaagaaagagcacatgacattatgtcacaccatacatgaccctcttgtttttcttcatttttcaaaatacagtacaaacgcatatgctcataacacgtgcgtgttcacccctatgaatacacacgcacattactctacccctgtaaacatctccggaagatttggccggcctatgatttcttgagcaaaatacttgggcattccattatggcaaataacatgagcctacaaccaatcacccccatgttgaggtggagtggaaattaaaggatcgaggagaggatgttgtatcttgcagcttcctcgatcgagctcaggaatcatcatcacatctgacgatcactttgtttttctttcctatgtcatatatgaatggaagtcatcaggatcaaaagcctaacattgttttgttctcacctcacacaactattgcttcctgaacggacgcaaccccgaggtggccgcgggcagagtgaaccacgtattctggcagacaagtcagttacctacgccgtagcacttggaagagcttgggtttagcagcaattaatcatcgcgcgttcgtcgctgtcgtctttgatttgtttcatcttctcatggaattcatcctccttcatgtaatccaagttatgcgcgaagatgtattggagatgtaataataaaattaagtctctaacttctcgaatattagtaagagcgaaaccctccgcgtatttatatgttgttgcagaaaattaaaacatcaacatgtccaatcccggttttgggttcaatcaaacttatcatgatgtactgattgtattatgtaccgagggttcaaatatgaaacatcgattttaaactataatactggagaaattgacatgaaaattcaagttaagtcataaatattggtctggtactagtcaaaatgagtgtttagtgcattattcatcaaagtgcttagtgtattattcattgtatccctacggtccatcaggtataaaagccccgcaggcatccactgtccattaagctagaaaagttggacttgctaaggtttgatactaaatgtaggatcttaaagggtttttgtcaccccaaaagctagccaatgagatgagaggctccccacctatatatattagatcatttgacctttcacaaccaatgtaagactattaaaaaaaacaaccaatacaaaatgactatgcatggaactgataagaaatattgtatgaaatcatcaaaacagtcctagccttattcgttcgatgttttttttaacgataatatttccattcaatgctgattaccatataaattgaaggcgacagatgtgagcacatgaatcgtgggagttggacaagaaagtggaacatctttctgtcatacatggaaacaaacacacatatagcttgggcatggaaggcatcagaaagaactatacagtctgtggacttggcctggtgagccatctgcgggatccggcgacggcacaacagcatttagcttgcagggattagttgttgagttatatggaaattgatgcgaatatcagcatatttgataggttttatatgtgtacgagtattttgacaactataataagatatccatgtgcatttgccataattgtcactagtacaaaaaggatttttgcggacaccccaaaaggggttttctcgtgcacggtagggctagccgcacgcacaaaatggtctgtgaaagtagctatttctgtgtgcgggtggcgcacccgcacgagaaaatttaattttcgtatgcgggtgcttatgttgcccgtactaaaaaaataaaaatccaaaaaaaactaaaaaaaatcacgaaaccctaaccctgaagtagccacgccctcctcgtggttgcagtcattgcacaaagccgccgttgtcgtcgtcgcggtcaacattgtcctcgttgtcgtgggggcgtaaggggctaggggcggccgggtccgcccgctcccattgccgtgccgccatcgctcctcaccacagctagatccaccgcggccgcatatccccaccaccagatccgccgctgtcgcccatccccaccaccagatccaccgccgccatgtgtggtgagagcagccgtcatcggatccacgcgggtgacagccgccgcgccttcacaccgatggattttctgccgccacacggccacgcgggggagggcggccatcgtcggatccccgccatcgcgcacctccaccaccctgccccgcggcctgagccctccattgtcgccgctgctcgccgccgtcaccaccgtgccatcgccggagctgctgctgagagggaggagtggggagaggagtaggggagtggggagagatagagccaggagaggagaggatcgagtggagtgggtgatggagagagagaggagttgagattaaagaatggaagtgggaatcttttcgggtctttttgcatgcggatgagttaagtgccccgcacgaaaaatatccttattttcacgtgtggatattttaagcaggccatctgaaaaaaaaatggatttttgcatatggatgtctcaaggagctgtacagaaaaatgagggtcgatttttgcaaacgtggaaatttatggtccgtttgtaatctattgggggtgctcacttcatgtctggtgagtttggtttttctatttgtgatgatatcaattatatggccatggactagataaagccaaatttaacacagaagatgaagatgaatatggtctatgatgtgatagctagaaaggaatctaatttttcttggtaaaacgactatgatgatatgatagaaggtggagcactattgtaagtggagtcaggatgaagaaattgcggagatagagaagtctcttgtttacggtgagcttggtgaaggtttgtcggggcggctccatgtgagcggagaaaaaggaaccaactcaagtctgggtgcagagagatttacacatggagcaaattcgggttggtgtggcatatttgtcaaggtggagtttgttagagtttgtatcgaatatatgcacgtagtcagttactgttaaggattggagttgcattagatgtaggaataaagtaaaagtcagactatatatcctaggatctctcttaaataggtcggtggtccttttgtaaccgcatatggcaactttacatagcaagagggagaggctgttagaggcgactggccgtgagtcattgtaactataatacgctatcatatactggatcggggaggagcgctcgtaatcagtatcctgatgatataggcttcggctgaaccttgttaacagatatcatatgtcattgtcattatcgtgtttggatctcctatgacgttttgtcctcgtttgatttccgatttgattttggggccggttttataacagaagtaaatcgcagaggaggaaaaaaagattccaagttgaaagccgatcaaccaggattatttgccattcatgtaaacgcaaaggccatcatcatcgatcgatcaataaatagaggtgaaaagaaatcacatgttctgtggtggccagctgatggagttgaaggagaggatgatgctgattcttccatgcataggtcaagcatggcaaccatcaatttatttcccctaacctatgatgatatgaatggtagacatcagcaaggaaagagtaacatggtcgattgatgttacggaaagaagaacaatttccggattttatggtagacagctacgtctaaaatttttatggaggtggcaatcaaaacagattatgtcctgaagagtgaaccacacaactgcgacttaggcccgttcgaactatgaagatcatgtaaagacagaatccatggacgcatgattaagtgatcgttcaaattattatgaattttaaaaatatatctatttaatattttagagcaacttctacgttgaacgtgtctgccatactgtgtatgataaaaaatatttttcgttagagtttttgtgattcgatcctacaagtggtatcagagccttgttttcttctttggatttttatcgatctagagtttttgccatggctactcccgctaggttttcaactaagcctcatgtttctgatggaacggatttttctcattggtgtagtaggttgcaatcttacattatggctgaagattatgatatttggataaaagtttctcatgcttatgtaattcctgaagctattaatactgctgctgaaaaaactgcttttgaacaaaattgcaaagctcgcaacattcttttgagtggtatttctcgttcggattatgatcgtgttgctcatcttcaaactgctcatgagatttgggttgctttaagtaattttcatcaaggaacaaataacattaaagagcttcgtcgagatctttttaaaaatgagtacattaaatttgagatgaaacctggagaagctttggatgactatctttctaggtttaataaaattttgagttatcttagatctgttgattcttcttatgatgctaattatccataatctgagatttctcgtcactttttgaatggtctcgacatgtctatttgggagatgaaagttatatctatttaggagtctattaacatgtctactttgactttggattcactttatacaaaattgaaaacacatgagatgaatgttctttctcgcaaagttgattctaaatcgagtgctttagtttcttcttcttcctcttttgatattgatgcctcttcatctaagtcgtcttttcttgctgtttttaatgccacaaccgatgatcaactcgaacaaatcgaggaggaggatttggctttggttgctaacagaattgctcgagctatgaataatgccaggaacaggaaaagaggtagtccaaatcgttgctctgaatgtggttcaattgatcatcttcgttcgcattgtcctaagcttgggagaggcaaaagagaagacaaagatggtgagaagaccaacaataacaagcccaacaacaacaagtcgaagggttcttaccaagggaggaagatggagaatcttaggaaggctattcaacaagtttgcgccgcctttgagccactaagtgatgtagatggtgaaagtggagatgatgataagggaaagaacgtctccgatgtttgcttcatggcgtgtggtgaatctgacacagagtatgaagacaatgaggtgagtgcttttgaggaagctattaacattttgagtgcaaaaaataagaagtgtgagaagatgtatagaaaataggagtttatcattgaatctcttaaatctgaaattgataggttaaaatctcttatttctaatgatgatgattgtgaaaattgtgaggttttaatgaatgagatttcaaaaattagagttgttaatgctgcacatgatttgaaaaatagatcttctcttgcttgtagttttgctttgcacacacgcactttggatgagttgtttttaactaaaaagttgttgcaaaaatatcaaattgcttttcatgctagttagtttgatgtttaacatgatttctgctaaaaagttaaaataacctcatgatgttttggattgctcaacatgtaatttgaataagatgaaactaaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaagaggtttcgtatttgaaaaattctttgctatgattttctgatggtaaaaagaacctcaacatgattttggatcaatcaaaggttagcacacataactgtggtttaggttttaatccttatgctcataattctagacatcctcctgttgtgttaggtgttagtgctagaagtagtgagattttggttaaacctgatactaacaaaactgtgtttaaatctgctggtatcatgtctactatgaatgcatcttcttcaaaatccaatgttatacatgcaaaatctcctgttgttgctcatgttgctaaatctactaatgctaccaatgtgcctaatcatcgtgaaaaatatacttgttctttttgtggaaaagatggacatattgttggtttttgtttcagat

SEQ ID NO: 75481 - DNA, 4811 bp, Oryza sativa
atcgctagttgaattggggtccaatcatatgcgttcttatcaattctggagttcaggtaatgacatgtactccatttaggtgttatgaccagaaggatccaatgggcactgcggcattaatatagtgaaagttaattaagtactcaagcaatatgtcatgctgttgtgtatatttagttaacacacttactattgattataggcacacataatgtactccttgtctcggcgggaccacaaggtgtcgtagatgtagttgaccattccttgacggtcattctggagatttgtgacagtgaccacttgtggatcaaggaaggcaacttccagtgcatgcttctgacaccattgacaacttaacctacacacaggatcaacaatcttgtaagcaagttaaaccgattgttattaccagaatgagttgggcgacaatatttacaaggagtagcacttaaggaggcttgtgtccaccgctcggagcctgtagaggtcgaaaagatccttaaagtcgaccacgacataatttgttggaccaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggcctgcacctttcctcctcttcctctcccctttgcttcgggtttatcgagagtaattctctgaggggaagagtgtgccttcctgctcttcttcatcggtgggggttcatgaatcgtcttgctgtcggcctccgttcggtcctccccaaaatccgtgtcgtactgcatctgcacatcgtaagattgtgcatgacgatcttgagcaggaggggctgaaggagcagaggcgggtctctttggtggacgaccgcctggtgcaatggttggcctcgctgtaaccctgatctcaatgaggtccttgggccattggatgaaggtaccacgggcatttcctagtgagaggacctcgtcgttcggtggatacttcagagggaacagctcgtatttgggcttcaccgagtcgacttgaacttttgcacagtcggccctgagttgcgctccatgcactcttgtctctggggttggcttgtacgcaagtccctcggctgctggaacagtgaaggtcagcatcaccctaactatgagggtgcagctcgttggtttctgcgatagattaatcaatttttttagaatattatatatcatatggattcgtccctatgtctttcatgtattgagtaagttcacggttaccgttatgtggtcgacggtgctgtcgaccgatgttggattttccgccaactcagttgatgtgcaactgctgcgtttttcgatgggacttcctaactctttgtgcgcagcagcagtggcggcctgggggatctgttgctcttctcggatctcttgcctaatcttggccctcatcgactcgagcttttcgtcgaattcatatgtcagctcagctcatatcgactcccggatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcatctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccggcggtaccaagccggtgcggatgctggttcttggtctggagcaagcgatatgcctcgcttctagctttggactcgggggtcgacttcttcgcatggaattcctcccagacctgttctgtgatccaaggaaatttctctcttggatctggatttgccgggttgtagacgaactcaccgactagcttagtcttgaagttcttccaagcagtgcccataaccttgaaagcagcccgcctgagacggtcctcatgctccgcaggataatcaaagctctccttgaacgttagccaagcaatgtccttctctgcgaccggcacgagcttgaagtcgtcttgcagaatactgaatttctgcctccctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaagaaaacacaattgagtgctacaatctattacaatctattaaccacatttcacaataatttcattcatgcaccacatttcatcccaacataaataaaccacatttcatcccaacataaataaaccacatttcatcccaacatgaataaaccacatttcatcccaacatgaataaaccacatttcatcccaacataaataaatctcatttcatcccaacatgaataaacccaacatgaataaaccacatttcatcccaacatgaataaaccacatttcatcccaacatgaataaaccacatttcatcccaacatgaataaaccacgtttcatcccaacataaataaaccacatttcatcccaacatgaaccacattgcatataaataaagttaaatgaactacatttcatcaatcactacaatcatctatcacaaaattcataaatgcaccacatttcatcccaacatcgacatgtctcactcacagttcaatcacatatcatccacatccacatttcaatgacatgtcattcacagttagcagagggcggcgcgatggaggactcacctgaggatggccggtggggctcggtggcggcggcgcccgggctcggtggaaagcggcgccggtcggaggagacaccgatcgggcaggtcggcaccgggcgggcggcgtcatgctcagtgggggtcggcgacgtgggtcggtgaggacgcgggcggcgacgacgaggaaggccaacaccggtccggtcggtgtaaaggctcggtggcggcggcggcgggctcgggggcgggggtcgtcggtgaggaggctcggcggcggaggtccaaatggagggccgaggaggctcggtggtgacggcggcaggcttggcgagggaggacgactgcggcggcggcgggctcggtggcgacggcggcgggcttggcgagggaggatgacggcggcgctagggttctaaggaggcgggaaactgtagcgggacttagaaaaattttcgatccactctgagaaaccctagttatattagagtgatgagtcatctcaatcgggctttgccgtagggccagtcacagatgacgcatcggtgacgggctccatactaatgcccgattgagatgacattcaggcccgtcacggatgactcatctgtaacgggccctaagataatgcccgatagagatagattaatctctatcgggcttgaactaaggcccgtcaccgatgactatttttccatttcccaggtaagtctttatatttgtgagtacaaaatatatagctgctgtataataatttattttattagttataacacattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatataatcaacatttgtaaatactaaatgatttgaaatggaaatatggtcaacaacaaagttgatcctctcatcaagatctataacttttattttggtcatttatctatataactttgtttctaacagcttgaaattgattttgacaatatgacaaatataatcaacatttgtaaatactaaatgatttgaaatggaaatatggtcaacaacaaagttgatcctctcatcaagatctacaacttttattttggtcatttatctatataactttgtttctaacagcttgaaattgattttgacaatatgaaaaatataatcaacaattgtaaatactaaatgatttcacatggaaatatggtcaacaacaaagttgatcctctcatcaagatctacaacttttattttggttacttcttcatccgacaaagtgatagttatattattcataaaaatcacatttttctcatctggtttacaaatatcaacacagatatgttaattttgtaaacattggtactatcactttgtcagatgaagaagtgaccaaaataaaagttgtagatcttgattagctgtacaagttagctgtttatggctttcccatttaaagtcatgtaatatttacaaatgctatttagatttgtcata

SEQ ID NO: 75482 - DNA, 33523 bp, Oryza sativa
ggcccaaagcccatgacaaataagcatgtcaaatgtaacatttcattacactttcagcttaaaatggaatgaaaataatccaaggcaggaatgtctagcttgacagttgctcatgagtttcaagggaagatggaaagagaacatgacaaatagcattatatcagtcctagaatagtcttgtgcactataatggaaaagttgcataaaaatatggaaggtttctttagaaccactggactgaaccatttgaatccattagaaatacattgattttatttatttctatgttattttcatcatcatttgcagcatctaggcacccagaattagcagagcttctggacacagcgccacacatgtatgcatcaaaaacaagaaaaagaattgcagagtgcagatatacaaacagagacagttattccatatgaccagatggtccttacaagtacatacttgtagaaacacttcagttttctataatgattcatttatttgtaattttggagctatcttataaagaaaaattggatgcatagcgatattacggatggagactcaccctttctgtacagctacatcagatactctcttgcaatagtgtgtacacgacattacgacagtacctgaaatgaaaaaaaaaagttgggataagtatgtcttaatttaatttgattctgagaaaagaatcacgtttaagtcccttctggaaattatttacagttcacttaaacaggacgctctggatcaacccaccagctatacttcttccaattgaaaccaaaaaggtatatacagattttacacatagcgtgagcaactcaagacaaagttggttcatgacacattcatacacaaaccagcaacatagtatcattcaaatcaatcagtcatccacaattccacataaattagcgatctgattggagctaccataatctgcaatctgctgaattgatggagatgtaccaagcaactactgcattgattagccatcattttctgtatcatcaaaacccaccatggtagggagtctaccctctaacgaagaactaacgaagaacaacccgaaattcacagatcgggatgtatactctactatatatatatgaactgtacacctacaaatgcggccacacacaaaaaatgtaccataataagctgaagaaattgcagcagttagttcatcaaaagctcaccaaatttgacaggcaactacccctcctcccttaccccctgccgggacgtcgtcgtcatcatcgcctccgccctcctctgccagcagcgatctcgaggaacgccaccgcgcaggggggctcgatccggtgggctccgcgctgcatgcagggcacgctcccgccgccgtacagggtggcggttctggaagccatcgctgcctccagcagcggccggcggagggtctcggcctctcgggagagggggtactggatcgagaactgaccggaggttttcggcggcgcagcgtggacaattcggcctccccgcgaatccggcagccaccggagcggcagccgagggtcgccgccccggcgaacttctccgcggctgcctgtcagtgtccgccgctgtcttctgcagcgccgccagcgtaagattagttgggccgacgtaattagcagcccatctaacaacatggggcctaattcggttatcgacgtaaaattagcccttgtcatatcccggttactccgtaacctgattaggccgttaacatagattcggctcagattgaaaaatcttcagtacattaaaaaagaaaagcaagtagtcgattttacttctcaactattgggcgaaacaatttttttttaacaagcagaaaattttttattcgcccgaaaaagtaaagaccatgtgttagaaaaaatagtggttatgcactgtagtgtactcccaaaaccacgtgtcaaccagacagaaacaagcctctcggagggaaacctagcacccaatcgatcgttgctaagattggtcgatggtcacagacatacaacaacactatagtgtagagtctccaaacacgacgtgtctccataaaggttatggcatcaaggacacagttgttgtgcatccaaagactgacatgttttcacccattgtttctcaccaaaagaagagaagggaggtagatgacaccccaagggggtcacgcccgcgggcgtcgccgctgctagcttaatgaatcataagactagacttacacttgcaagctctacaggctacaaccttgatcacggtctatcaggctacaaccctgatcacagtctatcgtgcaccatctcagtgcgacttcctgccttccagcgtgagagaaggaatgggaagagaaaaggtaaggatggctcatgcctggtctttggaagggaggtggccaagcaggtcggaactttctacaccgagctggtcctgctcaccgtcggagctcgtactcacactctcgtccactccggtgcggtgccactagctaggaataagttcactttaggtttcttgatttatcgttgagttcaaattaaatccgtccctaaaccgtaatactaggtataacgtgtccctcaatttacaaaagcaatgtacttgaggtcccaaggtagtatagtgcctggtttcggctgatgtggcggctgagtcagaatgggatccacatgttaggacaattcagtataaattaaaaaaaaattggtggctccctctctccttttcttggcagcatcggtgtgggagcaggcactacatgtggcgagcaaggccacaggtcacgggcgacggtgaccggcgatacgtggaggagggtgttaacagcgacggcaaaggagggatggggatcgaacgatgcctccagtggcccagccaaccgattttcccttatctgctctaggccacagctgcagccgaggtaggggaggtagcctaggtcggatgcatcagcggcaccgccgagcttgaggggagaggtggtggcatcgttggagttagtcaccgacgccgagatgctcccaaatccccacgtgacgccaacgagaacgaaatggcaagcgaagagggtggggcaccgttgcaagggagtagaaggcctcgccaatggaggaagggtgggaggatagcgcctcgccatcaagttagggagaggatgggggtggagtaaaggcctctgccgtcgagttagttcctccatggcgatctcgtcctcgcgtgccgcacctactccgcctcgtagcggacgccacgcacataaccctatgttggcaatcgtacctcctaccgctactggagctcgaggcggcgatgtcctcccatgcatagatctcgtcggctcgggcggtctcgtcccctgcgtcgtcgggagcactgccatctgggagtaggcccgcgaggagtgcgctctaagaccaaatgttgagctgcacttgtggcgcggcagagtttagggagatcaagggtgcccccgacggcttgctcctggagctactcctctttctctccccacacgctctcccactgggccatgacactcgcacggagatcaccacgccagcctccgcagtggctacagtgggggtagggatgctacaagaggctgcacatggtggtgcccatcctcgccaccgacgttgccctccaagttgccaatgtcctcgtcatcgtgttagtggagttcctctacccctaattgttgtctagccgggctagacattcgagcacgcctgcatcgatgcgtgcgccgtgctcgccttgtctccgccagtcgtcgtcgctaaaggcgccacgctcaccttctccctgccacctagctatcagatgcagggaaggagaagaagcaagaaaagagaaaagagaaataaagaaaataaggtggggacccactacaattttttatttgtaaccagacactcactaacatgtgggtcccatcaatttttttatattataagtgccacatcaacaccagctaaaacaccatccaaaccgtcttaagacattatttgtactggttttgggagttgcgagagacgtgtcaaatctgatattgtgattcaggaacgaaatttagacgcgccgttgagggacctatagtgaacgcattccccactggctatgctactacccgcagcgatttttttacattttttattaaaatatttacaaacataattttttgtttcaaaaatttacaaatctaattgcctctcaccctctaggagggcgatttttaaaaatcgcccttccaaagggcgataagggacctaaatgcaaattttccagcacagcttgtttgctctatgattttataatttaaaattatattatataaagtcagatgaaataaaaatttatatcaaaattgtagagctcaaggagatctacaactttgtagttaacattttttcatttaagatgttttagatatccaaatattcattataaaataaaaaacctattttaaaaaatctcagatctacatctcaaacgacatcggatggagataaactttatataaaagttgtagatctcgatgagatctataactttgtagtttatcacttttccatttaaaatcatttagagtatcgaatacgtattattagtttttaagcaattaaaaacggtggaaagggtttaaacacaaataaaaaaattgcatttaggtcccttatcgccctctggatccagagcaagagacgactagattgtaaattttctagaaaaaaaagtattttcgtaaatattttaataaaaaaaatgtaaaaataaaaaaaattccaggctcgtttgccaggtgccatcgcctacaggtccgctatatcacgtaaggcccatatcgcgctcctcgtcttgccgtccaagacgtctatagcatcgtgggcccaacccgttgtcgcctactcgcctcctttggatgacggaagacttaccaatccttctcaaagacctttgacccaagcgagccgcgagccgcgacacgcgatgacaaaatggacaaacaacagtgctcacttataaactagcggttaaaaaaggtgaaaccaagtaaccaacatctgcatttgagcagctagctagcaacaaggatagaagaaacgggagctgatggcggacaccgtcaccgtcggcggcggaggagagcaccgggtgcaggtagcagcagccaagccctgcggcgggcagcaacagcaaggcaagaaggcagccgcgccggagaagtggctgaatggcttcgttagcttggtggcgctggtcgagagggtgggcaacgcgctcggcacgctggccttcacctgggctaccgtcgtcctgctcggcggatacccgacgtccctgacggcactcggctcgtacaacgatttttggttcgcgacagccataatcttcctagaatccgccaggttagggcctatttgttctgtttccattgtgttgatttccaatggattggggattttttttctttttttagagaatagtatttttacccggcctatacatctaacatgatacatgtatccttttaaatcgggaacttagtccctcaaacaactcaatctgaattcgctcttatggggatttaaagttggagtgtttctcaggtcactgcaatcggccaatcactagtctgcatacccttttgcaatcgattgggaatacatggcgatcgccgatcagctggaggcggctcctctgccgtcacaacagacaatatgcatcgccataagtttctggattactatatatgatttcatttgctccatacttctaaaaatactatttctcaaaaaaaacactttttatatattgattagaacatttatatctttttataagctatttattaggtttttaacgtatagtaagacttaatctttcctataagcaaattgataatccattaagttaagaaatggtaatccattatttttcattcacaaataatctaaaaggaactctgccttgcacattctttattgtttgaatgattttacagttcttgaggagatatcgggaggtatcacattttttaacgtaaaatttagtatctctcagttccttcaatgctaggaggtataaaaatttctctcaatgcttctcaaggactataaaatttatcttaatgtttacttacacatcctatatacttcaggatgtttagtggcagcaacaacaggtccgattaccaattgttcttccgaaccaaaggtgctttcagacctcttgactggaactggctgatcgccatcgtctgcattctggatgtttggaagctgttgattccccttccccataagaatgttatggcagctgtagtgctttatgctatgataattctgcttatacttggcaagagtatgactccaaagtttcagccatcactacgcaacccgttacgccgtgccatatcactatggagccccttagctgcgatactgttgatgactccagccatgcagcatgaccattcaagggactttgtcaggaacattacaggaaacggatcgataaccacaagaacgggtggcttcgctccaactaggtccacagtagttgccaaatggatagtatttctactattgctggtatccgtcctcgtggtgacaatcagcaggctaaagttcccaagaatcatcaaattgttagatagtgcttggggcagaaaactagtgtcttggcgtcgatctattcagaacatttgcatgcttgctgcgctagtgatggtagtactgactactgatggcttctttcggttcatgataatcgggatgctagtcattgttgctgtgatggtgtcgtcgggcaacttgcagataccagcagcagtcttgcgtgttgtgttcgcaggcctcgcactgtcacaccttatggcactacataagaacaacaaagaagacgaagagactaacctggtaccatctctcattgtcttctatgcgatggtgacggcccaaggaatactctacaccgtggcatgcaccctcgagatcttctcattcatcccccggagatccctcatccggcgtgctggattcagaggtcagctgggagtggaatatgtcaatctgtattatgcatatgccttggagaaatgcatggaaaaggctgtgtttgctccgaagaaaaccagcctgggcaactttgccatggattccctgaactcagactctcccaagaatcatctctatgggattcaactgatgcatagccttctggagaaggagacgacaagggcgcggctccttgaaaagctcatcacttctacaaagaccatggctaggataataagtatgttgggctggactagcccaaattatatgatggtcagattatatgccgcgaaagtaactgctgagcttgcgaaggacctccaagttatcgctgttcctagggcaatgcagcttgtgtctgcccttctggacaccgatggcaaacttaaaaagggaaatccacttctgcaggtagacgatgaacaagaggagaggcaggatcccattctcagcacagcaaatagccaagaggaaagaccgaatgcaattaggaatgcagatgatcccccaaagcaaagacaacaagagacacttcaaggcactgataacctgccggagacacaaactcgatcagcccacatccatgaacagaactgcataatcagaagcttgcagaagatttcagagtactggacagttcccaaggagcatccattgacataccatgatcaacttcctgcacttggcatgttgattgttgacaagcttgctagttgtgatcaaaataactgtgtggaaattgatagagtaactgacctcattccgaagatcataggatttacaagcttcagaagtgacacaatgaacagtgaagcacagcaaatggtcctagtgaagtcatcactgaaggtgttgcagaggctgacaagcattgaaggggaaatcggcaaagcactgcggtacaagatatcgaagcatcccttcttgttaagaaacctcgcagatatcttgggagacaacatcagagaccaagaattaaaaaagcttgcagtaggaatcctcagaaacatttccattgatggtaacacaaggcaggagattgggaacatgaaggtgctcataaccagactgatgaaggcattcctcgacttacatagaacctccaacacagatgttgatttcttgctaccaaaggtcgccgggcaagcactagcaatgctagcaatggataatgtgcacaactgcttagttatgttgaaggaaccagagttcattactaaactcaaaaatatgatcctgatccaagatgaaaagtacatatatgtggcgccaagcctgttacgtagtatgtgccagcatgcccaagctaagctcacagaattagacctaaaagaactatctcacaccttacgagaggtgagccctgctacttaatgctacagatgcaatatttgaggtggatagtgtggtatgcttttttgcataaattattttatgttagaggagggaattccacctgcatttttttcaaactgggtcatttattactagtaaaatagagtataatataccgtgttttgctgaattatgttgttaccaatcatgctacattatccactacaggtgttggaaagaataatgaatgctgaaggggcagaactagagattctcattggccttagttcacagatatgcaaagtcaatcctgaagaatttgcccaagagctagatcacggacatattaggcaaagatttgtgaagaggctagtggatgcactgaatgcaaacatgaaaccaagtgctcactgccctgggatccggagggtgatacttgagcaatccatatacatgatggagtgcaattctcactatgccaattgtttcaatgaattccggatgatggacgcactgtcaattgtagaagaaacgccctcaaaggttgagaactacatggttttcttgggtgatgtaggctttatggaatgcggcacacctctctttgctctagtggacagagcaaaagaactgatgggtcgtcaatggttgcaaggaatcaacaactaaaagtaattgtatgagatgatttctcatttacagttacagtgatttagtctattgtgcattgcaatccaaatgccgtaaatttttagttgatgcatgttgtggccatggtaaaagaaataaacagaaaatgatggcattggagtccgaaggccatgcatattactaacatgtggtaaaaagaaaaaagtgaatgtgcacatggcctttctagaaagaacacgatttgcctctgagatgagaaaatactattgtaattgtacctcattagtttctttttagaaaatggaataaacccgacctctacatccaaccggatgtacacggccaacctcattagtactgcattgtaatatgtttgcctgcttttctaatgatgatttgtcccattatcatctcttggggtgaacaatgcataactggtaatatatagattgcagttcctgtgccaggctctagcacgtgtactagttttggcatcaattgttttcttaaaatctgtggtttattttgacacctgaaaattgagttatcttttgtagcaactagccccattcaacgcaagccagtagcagcccacattgcacagcttatggagtacagtccctccctggcgaactcaactgaacaaccatgaatacatgaatcatgcgccatgtcaataatgcatgacatgatgcctgattttgattttagtagttggttttccatttttgtaaactacgatgcctgtttggaggcgagtgaacacaaaaccctcaaattcgcatatactgcgctggttatatacttatatattgagaccaaaactatggcgcattaaattttctgcaagtcgcattgcgattaatcagtacagcagcaatcgaagaaaactcccaaatttccacatccctaaaccagtcgattccagtataatcattgactctccctgttactattttcttacgcaaggacaaccatatataggaactgaaccaaatgacctaagcgacgagataaacattctgcttccttataagaaaagagacgagcaaaacgaagggatgcaaaagagaaaaaaaacgggggaaggagacaccacccgtcgacggaatgagctggagggggattcgccctctccgcggcggctgctcttctctccgcccaagatcctcccccgccacccagccgctaccgtgacgcctcgccgtcgccgcgtcggccgctcttttctccgccggagagcccctcgcccagcccaccgccgcgcccagccggcaccgttgcggtcgagggaagaagccagtgcccagataaaagtttgtacgtgggccaaatgtcaggcccttcaaaagacctagcgaaattgtttacggcccaaatgttggaacagctacaactcaacgtgggcctaattttagtcgacgtaaaatttgcacaatacccgaaatatgggcctaagtatatacttactccgtactatatttgaacgtttaatttaattatttagatcgtatatgaaaaataattatggatcataagaacgtttaaaaatatatagagcatatattccaaggagtattacactggtagtccaaccgaaaataaatgcttgcatgtaatactaaacaagcagctctgaacaaaagtaaccataataaagtaattaaggctgtgttctttccacaagtttcccaacccctttccctcgttttccgcgtgcacgcttttcaaactgctaaatggtgtgtttttttgcaaaaagtttctatacgaaagttgctttaaaaaaacaaattaatctatttttgaaaaaaaattaactaatacttaattaatcacacgctaatggaccgcttcgttttccgtgcgatggagttgggttcccaaccccaattatcaaacacagcctaagtagctttaacaacagccacatgacccaattccaccgaacccaaataaagcttgccgccgcctctctcaatcacctccgttggcctgacgttcttcggccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctaatggcgaggccgttcgggtacgtcattccggactggagcacgtcgaggtagcccgtcgtcgggtcgtacttcatcaggcggcccgtggagtcgccggtggccgtgaccatctcgtgctgggatcgctggaagcgcgtgctgctgtcggtgaagtagacctcgccggtgacctggttgacgtcgacgccgttggtgaacttgaacggcacgccgtcggcctccgtggcgagcaccgttgcctccccgccgcgcgggccgacacgcatgaggcccttgtacgcgtcggcgatgtagaggttaccggaggtgttgtggaaccggaggccgagcggccggccgcacttgctctcggtgagctccgcgggatggagcttgggagccatgcacttggcgacgttgtaccccggggcgtgggagtacgtcgtccagcctttgtcggcgccgtcccagcggaggatgcggccgtcggagacgccgctgtaggggccatcgccgaacttgtcgaacgcgacgctctctgggccgaccagcgtcgtgggcagcggcagcgtctcgaccagtgtggcggaggtgtccttcgcgacggccgcggcgagggcgtgcgacggcaacagcagcaggaagacgacgatcgtcagcgccacccgagtcagagtccccaccctcccggtgccgaggacggcccccatgaatgagaatcgccttgctttgcttcgtctcactatcgaaatttcttttttttgtcttggcgtgtttttcttaaatgttcttcgcttcttgcttgcactggtgccgcgcgccggagtgtgcctttatacccgtggccactgcaggcaggccacgtccaatttcggacgccgattccgattgtgtcgtgtaactgaacactaaagccgattcggagtcggagttaccaagattagtgaggtcgacgtacgtaattagcccattaatatgccaattcggaatcggcatatttttatggggtgacgtaatcaacccatttaatgtcctggacctaattagctcatccacgtaaattcagcccatctaagggcttgcttggaacatggaaattttatacacccgcaaaactttcacaccgattcattctggatttagtgcgtcgatgctgtaacaccattgcccccgcgtcgctcctagggcaggggcgacacgggaggcgacccagccgccgccgccacaccacccccactgccctccttccacctcgccgccgcccgagcgggccgccggaaaccgcgcggccgcaaggacggcggcggcgtggccttctccccccccaaggtcgcggcgtttggagcccacgactccgacctagctccggggcggcgacttcggcggctgcgatgtcgagatcaacggtggcgcatggtgtcggcgaggtggcggcgccgacgacggttgaagaggtgggcaaccgggccgacgacgatgacgaggcggcggtgctggctcccacgctctcctgcgcggatctggtgcggggggataggccgccggcggcggtgatgcgcgtggaggcggcggggtggccggattcggccccctcctgtccggatccggcgtgggaggccgagctctgaccccagcagcgaggcggcgggggcgcgcggcgctggggcggcggtggctgaaggcggcggggacggagctggccgagggcgcggaggcggcagcggtggtcccgtggctgcgacggcgcagtgcctggcggcggcggcggtgccccccagatccgcgcctctcgaccggatctggagggtggcggcagttggcgacggcggcagcggtgtggcgacgatggtggcggcaattggccggcggcagttggtgatggcggtctctctggacgccggcagcagttggcgacgacaaccgcggtgtgatggcgtcgggcagctagctgctcggtggtggagggcgacggcgcggcggcagtttgcggaggcggtggttggcgtcggtggcagcggtgacggcagctgcgactctggaggcggtggcaacgtcggcggcgaggaaggagttgggtgcgaggtgaggatgacgacggcgaggtggctgggtgtttggcagcagcggccacggtggtggtgaccgtgtttgcggtcaccgaaggcatggcggcctcgcttgactagccgagggcgtgggagacggctgcatctggccggcgtggcatcgtgcagtggaggggtcggaaaccggcttggcgcagagaagtgcagccgatggtagcggaggccggctcggcgcgagaggcgcaggcggcggagatggaggccggcttggcgcgagaggcgcggccggtggagggaggccggattggcgcgaggcgcgtccggtggaggaggccggcttggcgcagagaggcgcggccggtgatggaggaggcgacctaggtgtgaggaggagctgccggtgggtgtggcgcggtcttcgacgcatgaaggctggccggcgggggacgccggtgcaggggtcccacatgtcggcaaagcttgtgtggtggtggagcatcggtgcgtcagacgtggtttcgcagaatctcgtctgtgcccctttgttggcctagtggcggtcggtcacgcttagtggcggccgatccggtgctagccttctcctgggcgtgtgtgttggcgatgtcggcgtgtgggtggtggtatattttttccttttcctggttacgactctccagagttgtaatattgtatttttttcctgctctatcaatagaacttcgcaccgtctcgtgcgagtcgttcaaaaaaaaactttcacacccgtattttttctgtgccccaagggctttcctgggatcgtggaaattttatacgctcgcaaacctttacgcccgtattttttgtgcaccaagataacatgtaaaacaaaaataaatatatttggtaaaatgatgtttcctttcataatacaaaagtagacgcacacgccactacatgtgtaacacccacgaatgctcatcctagctaacaaacatctatgcgtccgtaatacttgtgggtgttgggattttgaactctagtggatggagtcatgcacccacgactccactcccgtatcacttactatgacaaaacataattttgcatggggccaaacgctttgctagtatttaaggtctgtgaaaattgatgagtttcgtaggccgctaccctaagagccccatcagcgcataattaagtggcttgactaaacaatgaattttagcgtaagaaaacaaagtgcacatccaaatatcgtccgattcgcaaaattcataatgcaatttcaacatttgaaattcgaaacagatttgtcaaattcacaaaaaaaaagccagccgatgatgtcagcatcggcatccctacgtcggtatcctctctagcttcttcaaccagtctaagggaagaaaccgaagtagcgcaccatcattgatgttggtgagggagggcgcggaggcccgccgcgacaaagtcaaccacctcagcgaggatggccgtggaacgaggatggccgagagctctccgcgacaacgagtgagagcttcttgaggccttgtggcaaatctgcatgctccaggcccaacgacggcaaatccacccgcgtcaggctcggcaacagtggatctagactcccaagaccctgtggttgcagacctgatgctcctgaggccggtgacggcggattcaagctatggaggtcacatcgctgtcttcacgatcgtggtcattgtcgtcatcactagtgtcgtggtggtggtggccacgttcatcgtcgcaggcccaattgatgtccctttgcctcctaaggcccaccaagttggtgtgatcgacggtgccgatttttataggcagggctaaatctacgggcttcccgttatttatacaagtattaacaagcattaatattttaagcccacctgataaaaataaaacgtaggtctgggcaaaattgtttttttagtgctagtacttccccctgataaatgtcgtttcgtttgggtaaaacataaaaaaaacatgtgaattcatgtaccgattctgaactcattaaaatcattgcatgagctgtagcagcaaaacaagctatgatgctgaaacgtgagagtattcacgcatcaaaaagatacaatgacgaaataggatgcaagtcagaatagattatagaacatgacttatgtgataaattctaagcataccagcaatactcgtgcaacaagcgtgtttggtggaccataacccctagatttatttattttttttttgggggggggggggggttgttgtagataatgagaaacagctcatgtgatttcagctagcataggaaaatctactttgtggttactagtttttttgtaaaattctcctattacagtttttaatcaaaataaaaggctaaattgtttaatttagaggagcttttagttttaagaaaagctgcaggttccaaaagttctcccaacattgccctatgttctaaactaattagcatattgctaattgttcttttagtgatagcaacttactcatcgagtatgaggtgtttataagtatgtggtgtgcaattgtccattcgagttgctcatagtaataggagtgtgtgtatgtgcatgtttatatggtcactagtaatcgtgcacgtgcaatgcacattttccacgttataaaaaaaacacaaagtagattcaaagtttattatattttcctacagtatacatcacataaagtatacttcctccatttcacaatgtaagtcactaacatcaatatgagatgtgagcctatgatagagattccaataaaaaaaataactaaatcagtgcagcaaatcaagaaagagtgtgcaacacgaatcgtccagaaccaaaaactaaaaatgccaagttggtagggcttccatcatattctatataaacatgttaccacgataaaatttcaatacgtacacaggttacaaccacaaaatttaaaacatgaggctttcacgaactaacgtaatatatcgtaatcctaacgtattattgtattctgatgctcaccccttgataaagtaaatgtgagaatatcaccttcagataatcccgaggaatccttattgttttggtggcccctttggtgctatgaaggtgtaacggcaggatgacacattagtcttcttgttggttgaatgaacttctgaaatcgtagaattttgggcactttcaattttgttaagtggtggcccatgaagatattgttgattaccacaaaccagtggaaaaacatctcatttgatttaatagcaaatcagaaaattcatatgttgttattttacatcaaatcaaaacccaaaaaaatcaagacattttaatatttcagtatgatatgaaatactttgacgcaaaaaatcaaccactgatcacttccaaatacaaaggattataataattatcttcctcatatattccccaagtagctttggtcttccacacttcaccctggaatgaaaaggcattatcatttaaaaatgttaaaagccacaaaaaagaacttgtcactataaactgaggcaggaagtgaaactgtccctcatcctaatgtaggcctcaatataaaaacataagactacacctaacctctaaacatgccaatgccttctagaatgaatagagttgtgcattgagatatattgaggcaaattaagaggaaaaaatacagaagaaatttgaatcctttgcttcagagaagaccagtgataacatttttccacccttgattctggatcctcaatttccatatgcttagaaagttggacatgattagaacaaaatgttatttagccctgcgtgatactattaagcaattgctgaaaacaagcacttgaaaatgaggacgtacatatgccaaaaatcccacagtttgatgcatggcattctagcacctattagaaatgtttcagttatcaacccgataattcattttgttgaggcattaaactaaaggttgataaaccgtgcatagctatatatcagtatattattcttcctctgccctccctccgagtgttaagtctagccattcaaatcggtggagtacatatcaaacatgcagaaaatatacagaaggtaaaaattatccaataattaattacttcctccgtttcacaatgtaagtcattctagcatttcctatgctagaatgacttacattgtgaaacagagggagtacatatttgtgctgctctatgataaaaagaagagatttaccttcccctaattcagattaccaataattaccaagccattacatcatacagtacacattcacttgacacttaaaactcacaaaatagtagactccctatcagttaactgaatggatataacgcttttaacagtacaacctacctcaaatggcattgtggatagttacaaatctctcttcctcttctgttgttgcaaatctgtcaattgtaattaaaaaagtagataaataagatgattgcgtagagatttctcaaatcgtacaagcttagcaaagaaaattatctgcttaaaccaaatgggatgtttgaaactgattcaaactaaataataagcaattatagaatcattcccattggtgtgttgcacacacatttttgttgttcatggatgcagtatttaggcacgcatggacagtgttggagaaaaaaaaaagacacaggtgccagggaccatcacatggccctcaagtgtaaattaagttgcagaggaatgggcaaggtacaggaggtgtttgtgagtgagccgaggccaagcagagagaggagaacaacaaaatttgcatcaataggacatgagctaactgacaacatatatgagtgaattttaccaatctgcaaaacaaaacttttagaacaatatgtgaacttatattgaacgtcatttaagttttattgtgagcaaatgaaagcataatgtataacgttaggattatacctcaccgttaagatacactctttctaatatggggatgaagactacagctgctgcactgaatcttgaatcatgtacaaaggtaaatcaaattgaaaattgcatttataattcttcatttagagtgcaaatgaaataataccgtgagatactgaggatagttctcaaaaatatactggggatatatttgttgccaaaccgtcaggacatacaacattaaaaacatctgatttctgcatcggcaaaaatatgcaacacatgcaatcaattttgggaagcaaagagttgccaaggtggatgtgcagatcatggaaagacaatacattcactggaagctgcatagcaccttgagatcaggtctgtgttagcaaaccgattactcctgcagttcaagaactgtgaacaccaccaaaggcggccgcatcaacagctgtgacctgctgcccttcttggaaaaacaaatatatgaagatgatagcaaagcaattcaacaacctgaatcatctcatcttcatgctgatgtatgtgtgttctgtacttctggtagaaagctggagcatccgaaacataaaactcaattaaatctctaaaacaaagggattattagtgcacctttgcattgaccaatatgagggggggagcaggcgacagtagagaaagcaccaggtcacatggtagagcaggaggtgagcagtgagggaggggattggcggtagaggcgaggtgagcgggctatcggcaatggagtacatcatctcagattctcagtccgctccccactttacgatggagtccgacagtcgacagaagcatggcagcataggcgacagcactgtggccttctccctcaccctccattgtctctgcatgtggactgagaaggaagaggcgatctagcacaaatggatgcgtagcaacagcggaggaatgtaaaattggcagatccagcactaaaataagcaatgtagtcacattttcaagttttcatttgcaacagcagcatcatgcaattgcttccatagccttaccaacaaatataccatccttatttcatctctaatttcatgagaaaaattgtctattgttattcttaatttgtgcacaatcagcaaaaattccgttctgctatcatcagtttgatgggtactacttgaattgcttgaataataatttaacaatgttattttcttctccattgaaaatctatgaataaatcaaaactatgatcatgaagctcaattcttgtaaatcacatcatctagatgcattactgaaatcagagacaaagattatgaacagaggcacggggcgaggactcaccacttgttctgctagctgctgctgctcgcccctcgctgtctgatgcccttcatggatggatggcctgatatgctagctcctcgccccctcactcctgctgctcgtgccttgctgttcgctgtcgccgccgagccgctgcagcctgccacgtggcagctgcttgccgttgttgccactgcatcgtcgcttgccggcccgccgtcgccggccacgctgatagctgctagggtttgtgggctgcacaccaacggagcagctatagaaactacagaagcggcgggtgatggggaggcggacgcggcggcggtggacaggacggcgcgacatgcgttggggatcgagcactggaccaccgttgccgagttcacccagtcggcggatctgacgacgacggctgcgctcgcgaaggggactcggggacggtgatggagaggagaaggacacgaaggaggtggggaggaggaggacgcggtggcggtggggagaaggcgatgcagcagcggtgagtgggaaggaggacgacacgaaggcgatggggaggaggagaggcatgcagcggcggtgcgtggggaggaggaggacgcggcggcggtggaaggtcagggagattcggtggcgcgggggagtggcaggaaggggatcgatagcggtagtagcgagtagcgcgggcggagtcctcgcgcggtgatgggagcgaaaatcacggtggagataggatgggattgctgtgggagggtgaatcgcactggacggtagggatgagagtgatgcggacgtggatacagatggatggtaggatcaacatgttgatttcacccgtacgattgcaaaaaggcaactcctactttttatattagtatagatatagattatcgcaagattagcctaattgtattctattcaattacatgattattagtgagtgttaacttcttcctccgtctcatattaagtttagttttagctcagtccatttgtcccaaaataagtttacttttgggaggaatcattgcatcagaattagtaaaagtaaagaataattgtattaactagctgggtggcccgcgcaattgcgcggctagcacccaaacaaaatcatatattttttagtataattttacttaaaatttattaaatagctacctagctatctcatagttttaagactttaaaataccaaatcttatcatcctcgtgtttttaattatatagttttaaaagttacaccagttgctaccccttatgtcatatccttctttatttgtttgtttgatctaccactatttctattcattcttcttagaacctttaaaaattgaattttatagtttttagagtttattgtcacgttaggttttatttttataatttctagatgtaccgtcaaacgttgccattatactcctctacggcccgtccactgtctcttctctttgttgtcattgagactttaaaaatcgaacataattatcgtttgggttcattttttactttttagaagtcccgcccaaccgtcagcggctttgccattgtactcttctatggctcgcccgttgcctcctttctttattgtcattgagattttaaaatcgaacatgattatcattgaatttttttactttttagaagttccaaacctttaaaaattggacttgtagttttattttttataatttttaaaagtcccatcaaacgatgccactatgcccctctacagcccgttcgccgccaactcttttttgtcattgtgattctaaaaatcgaacataactattgttgtaattcattttttattttctagaagtcccgtaaccatcggcggctctgcaactatactcttatacaccccgcccgctgcttctcctttttattgtcattgacattttaaaattgaatatgatcatcgatgttttttttttactttctagaagtcccggcaaccgccttactcatttttgccttactcatttgcttcatggcctgcctgacgtccctctttttaatcgtcattaggattctacttggtgttttattaataatttttatatctcgtatcaaccgccaccactctactcctttataggcatgttacttaatttatatcgtcatgtgttttttagatggtcttttctttcaataatctttatttttatcacaaattttagttatttataaattgtattcctaattgaaatcttatttttctttttctaattttagaatttttttaaaaaaaattagttaatatcgtattgtgttattttaatgtttttattttttattttgaatttcagttgtttcgaaattgtattcctacttgaactctcttttaatttttctaattttagatattattttatttttattctaaattttaattaatctcgtattgggttcttatatagattcttctttcattattgcttattttaattccgaatttcagctaattttaaattgtatttctacttgaactcttcttttattttcttttgctaatttcagatttatttatttttattccgtattttaattaatctcgtattgggttcttatatggactcttcttttaatatttcttatttttaattccgaatttcagctatttttaaattgtattcctacttggactctcatttctttttctaattttggattttattttatttttatttcgaattttgattaatctcgtattgggttcttatatggaaacttatttcaatattccttatttttaattccgaatttcagctatttttaaattgtatttctacttgaactctcatgtccttttctaattttggattttattttatctttatttcgaattttgattaatctcatattgggttcctatatggactcctctttcaatattgcttatttttaattctgaatttcagctatttttaaattgtacttctacttagactctcctttttcttttttctttttctccgattaatgtgtgattttctagctcccacagcgaacgtggggcctcctttcaaagctgttttaataatataatagattaggagtagataaagagatgaattgcattgggatttgatatattaggagtatttctttttattattactacctccgtcccatattacttgtctttttgagttttcgtttgtcaatgtttgatcattcgtcttattcaaaaaattttggaattattatttattttgtttgtcaattgctttattatcaaaagtactttacatatgacttatctttttttatatttgcattaatttttcaaataaaacgaatggttaaacgttgcaaataaaaagtcaaaaacgtcacctattatgagacggagggagtattattggtatgtgtaggatgggtaaaatattaacttatttgggacgtatgtagtagaactagtatatagatatactaatgtaggattttacactaagatgtacgctacattacaagaaacaaaaatgacaagtagtgctcaatcgcagttctatgtgagaagttatcttatattactaaaagaaatttacagctaacaattcacggtcgtgcgaatatactagcatttcaatacactatgtatcaaaaaataaagtccacgtcctaaatatcaggattgttgaacaggcaccgcaaaatgtgactatccgaagttagagttttatttgaaatcaaaatatacagcatactcctatattcccaggagagatgaaatgcaaactattacataggtagttcggccgaaaattgatacttgcatctaaaacaaaataagcgctctgaaaaaagcaactataaactaatcaagtagcgctagccttgacgacggcgacatgacccaattcaactgaacccaagtaaagcttgccgccgcctctctcaatcacctccgttggccagacgttcttcggccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctgagtgcgagaccgttggggtacgtcattccggactggagcacgtcgaggtagcccgtcgtcgggtcgtacttcatcaggcggcccgtggagtcgccggtggccgtgaccctctcgtgctgggatcgctggaagcgcgtgctgctgtctgtgaagtaaacctcgccggtgacctggttgacgtcgacaccgttggtgaacttgaacggcacgccgtcggcctccgtggcgagcaccgttgcctccccgccgcgcgggccgacacgcatgaggcccttgtacgcgtcggcgatgtagaggttaccggaggtgttgtggaaccggaggccgagcggccggccgcacttgctctcggtgagctccgcgggatggagcttgggagccatgcacttggcgacgttgtaccccggggcgtgggagtactgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaatcttgctttaatccataaatggatctctttagacgacatcccatattttcgtttcctttcatgacaaaaccttttggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcccgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccatttccaaagcggcaatcatatccatcaaaatccaactttgatacacttattaagttcctttgcaaagaaggaacataaaagacatctcgaagtaaaagtatgaagccattcgagagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctatgtctcttttgccagtcagcatctgactcactttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaagtacgtcgtccagcctttgtcggcgccgtcccagcggaggatgcggccgtcggagacgccgctgttggggccatcgccgaacttgtcgaacgcgacgctctcagggccaaccagcgttgcgggcagcggcagcgtctcgaccagtgtggcggaggtgtccttcgcgacggccgcggcgagggcgtgcgatggcaggagcagcaggaagacaacgatcgtcagcgccacccgagtcagagtccccaccctcccggtgccgaggacggcgcccatgaatgagattgagaatcgcctttgctttgcttcgtctggctgtcaaactagcttctcttcttcgcttcgcgctttgtaatggtgagatgttcttcgcttctgagatgcttggattggtggagagcggtggccgtgcctttataccggtagccacatccacgtcgtcgattcggataccgactccgatccgattccgactccgattttacaacgaacctaacctcagcttgttgccttgtttacagtccagactgtgcttaatttcggcctgtgtatgaatggatctggatctaatgtcagcccatgaaaaaaggttggatggttaggcctgcattgaatttgatatggatgtatgtttggcccagatataattttatatgggcttagtttccagccgacgtatgttatgtcgtgggcaatttacgccctcagttaggaataagttcactttgagtccctcaaaatatagctccatcaaatttatatccgtgaaccgcaatatcagatattttaaacccccaactattaaaaccggtgtaatctcactccctcagcaattttgaaggacaatttctttgacgtggcctttgacttggtccaacctgctgagttatcctgtaaggcccacccgttagtgacccttatataacttatcttccttcctttcccctccatttgatcggcgccacccctcttcccccttctgctccacgttgggccgccgtcaggaaggagaagtgcgttaggagcgacgtcgaatgcagtagtggcagtagggagagtggcagaggtggtgcaggtcaggggtggctctccggcgagataagctacggcggcttgacagaggtcgcggtttgtagtgacgatggcgtggttgtggcggttcttcgatgagataagctatggcggctcaacggcgcgcgcaatccttttggtgagataattaagctacggcagctcgacgggtgtggtgctctgcggtgacgataacatgggtaccgccgtgctcattcgcattgaggtggggtgcttagcaacgacaaggtgtctagtcggactagttccgtcccttttctttgctcttaactaaacataggagcttatgtgatggcaacaagaacagagaggaggcagggtggcggaaagacgtagccctgctttgtcttgaagtttgaagcaaggaggaaaagcttgaagctagtgttttagtttttctttattgtttgttatatatttcagttatgagattaagaatgtaacttatggttgtataaatatccacttgaggtcggatttctaaccgctcttaagcttttttttttgtgtgtgtctttgattactgctcaggataaattaaagagtgaaatacatggccggtctctaaacttgtgtagtggtatcacttaggtccgtaaacttaaaaattatacgtttaggtccgtgaatttggtttaatgtaccactccggtccaaacgtcctttgactgtgtttgaccgccaacgtggcatgccacataggcaacacttttgttatcagccccctctacatcacaacacgtcgcatatatctcgttgtagctatatagtgacaccagaatcccaccccccaccccccccccaaaaaaaaaaatcctcaaatcgttcttccctctcattcttctccttgcgtgtatagaaaatacggtcccaattagcaattgccattgcactgcctcccgccgctaatccggccgcactgtgccaccgctaaccccactgcactgcgctgcctcctgccgctaatctcaccaccgaggtcgccacagccgctacctctcggctccttccactaacctcaccgaagccctagtcgatttagggattatttttaggggatttgggttgaaatgcactggtcagggcaagttatgtgcgaagatatatgtggagggggctgagcataaaagcattgcctacatgacatgccatgttggtggtcaaacgtggtcaaaggacaattggactggggtggtacattaaaccaagttcacggatctaaacgtgtaattttcaagttcacggatctaagtgacaccacctcacaagtttaaagaccggccatgtatttcactctaaattaaattatttacttagttatcaaagtgtggagtaaataattcatttgaataatctgatgaacaataatcttttaaaaacacatagcctagtccgtaaaattatattacaagcagaaaacctacatgaagcgatcagaatgtcagatatagtatccctgacaaattcggatatcaacgtcccacttctaatcagaatatttgctatactacggagtacagagttactagttacgctaagaatccgaaattagactagctaaatgctacttcaacacccaaatcggaaccggtggtcactgttcagccccagatacgaaacggagtcggtgtccgaagcttggacgtggccactggtataaaggcacgggagcaccacgccaccaatccaagcatctcacatatctcagaagcgaagagcacatctcatctcagcatcagagaagtgccaacgcaaagaacagagtttgaaagcgagactatacgcaagcaaagcgatcatccatgggcgccgtcctgggcaccgggagggtggggactctgactcgggtggcgctgacggtcctcgtcttcctgctgctcttgccgtcgcacgccctcgccgcggccgtcgcgaaggacacctccgccacactggtcgag

SEQ ID NO: 75483 - DNA, 5354 bp, Oryza sativa
ctcccatatatatatatatatatgtcgacgggggataccctagaccagatatagagggtattggggtccgttggaacgaggatctacgtagtacgacatcaagcaaacagaaagcaaggattatactggttcaggccccttgataggtaatagccctaatccagttggtatgggattatataatggaaatcacaaattataaagggaataacaaaacttgatggtaccgacgagaccgtagtcaaattggttcgactagatctcccggcgacttggctcctgtgcgctccgacttcgtaggctgtggtgaatgtgttcgcggtgagattcgatgccctaggtcctgcccagggggtccattttatactaggggtcagttgatctccaagtaggactcggagatatcggacctctcacgatatggtaaagacccggtcttgcccgagtaggactccttacatccgtggattctatttctattacatgatagatttcctaaacgtataccagaactatccgtatacgcatgggtataccatatcagtactcatcgtacgtccaaggatagagggtataccttatccgtaaccttgacagtagcccctgacttctgcttaaatgaactcatgtaatcgatcggaacttctgatgtcggaatcgttgtcattctcatctggtcgatcccggcatgagaaccgtagaggcaaagagtcatcgacaacgtcgcatgaagttcaacagttatgagtgaatttaaattgaagtatgaaaactaccgcgcgcaatggacccagaattttccggcggcaatctctctcctttcctcggaatacgcaccgtcggtagtgcacttatttaaagggattttggaaacccatttgaagtccgttcaccaaaaaactcttcagccttctagcgcccttcgtcttctccgctctccgcaaagaaaaccctagcttgcttcttccctcttgttctccggcgatcctccggcggcgatggatcttgacaagtccacctcaaccaccgcgtccatgaagaagttgcaggacgacggtgccctccctggtcgcgggaccatgtagagggagacaggaggtattaaacccgaacccgtcttgggccgcatggttgtggtcgaagattacatttcttgcggttttcttcctctgccttccgagtttcttcttattgtcttgaacttctatggtctttctttgcttcacttgaacccgaattccatcgcatttcttagcatctttgctcatctttgtgaggcctacattggggtagagcccttccttgatctcttccgcttttactacaagttgcgttggatggaacccaacagggtatccggatgcgttggattccgacttcgggatcgcctgaagtcacgttacatacccttccaatgcccctcttctcgtagcaagtggcaggcgagatggttttatcttcagatagaaaattcagaccccgtccttgttgttcctgaagaacagccagacaaaatcccagagtggaccgccaaacccgccctaactccctccctccagtctttcatcgacatcatcgatgacctctgaaaacgggggttgtcggggtacgaagtcgctgccgactttgtaggtaggcggatccaaccgctgcaggctcgcgcccatccggcctttgattactctgggccagaagacatgacccgggtttctcctcggggtattttttcttgtatttcaaactttactccgagtgcgtctgtttctcctgacttatcgagttcttgttctcgatttataggtctggacagtgacaccgtgggacgccgcgtcggccaggtgatgattagtgccccctcagaggcgagcgacatcccgatccccctttgcgagaggggcccggccgaacgcactgctgcgatcaatgtgagtgtactcaatgactcctttacatctttctcctcgagatcgcgtcgtgatttcacgttatgtaggctctccctctgacggacgtcatcggaccgctcgtggatcatcaggcggcggcgtcattgaaggagggcgtcgccaaggaggcgtccgatgttgctgctgctgccgctgctaccacgagtggcagcaacattccgaagaaggggagtaaattctcctctgtactcgggacccatcggaaagcgccaaacccggcggtaagcctctctcttgttttttaacgcgtagtcggaataacttgacctgacaccatctcatcttacttaggactcagacgcgtctcctctggctcatcgaaggcaaaggcttgtgacgatcggcgagaagtaagtagacgtttttgaagtcttttcattcacggagtcttgatcgcttagctttatgaaagagaggaaaatcttcgtaggacggcgcgggcgaaggcgacgcaaggtgggaccgatgctgcctccagcgcgtcccctgcggcgacctcgacagatgtcgtggtcgctactaaggaccgggaggcggcaccgagtaaccccatcatcagcctcatgcctactcggggcccatccaccgatgacctcacctggggggagctccaagtggagatggagcatatcctccaggccggcgctcgcggcgtaggtcgtgagattgaggaggccagggtggtggcgtcgtcggcaaaccagcgtgccgaccaactggctcgcgacctggcggaggcccgcgagaacctcctaaagatgagggagctggtggtcggcaacgagaggcagcggcaaggacttgagcaccggatgtcggagctcgagaacaacctgtcaaggatccgaggctcgctgcggatatcgcacaccggcctgcaccaactcgccggcgagtgtggtgtcacgactaccatcccggcgaaccctgacgagttctcgctgacgtcctcactcgcggaactggctacggcgatggaggagatcacctccaagcatgcggccaggattggggaggagacgtccaataggatctacaccggggcgtgccatgtcctcgcatgcgtgaggctggcacaccctgatctagaccttaagaaggctttggatcagggggccgccgatgacgcgcgcaagggtgtggtggaggaagtcgatgacttgggggagtccgtcctccccctttttgaagagtaagatatttgttttcccctatacccttaatcctcatgctgtaaaacctttgttggatgcaaactgctcttatctgaacagtcgtttccctcgttttcttagcatgtgattccgagtactttgttgtcgttgtagagatatcgatattgaggatgtccagcagcgcgggcagcctaatatgccggtggtcgttccggcgcttgcactcgagccgtttgtgccgcgggaagaggtcagtcaaagcccgtccgcggaggcgaatatggcgatgacgtccctaggtttgcgtcttagtctctttcactccttgtattcggattgacttaattagctgtgtcctcgaaagagaagagtagcttgacttagtctttttcgtcccaggcagattttgagaacacgatggctgaccgagtttgtcgaatccaatattggaggacgaagctcgagatggccaaactcgaaaacaccatgatcgaggtgaagaaggatcaggctgtggaaactcttcgaggtcgcgaggtatggttcaactcgtacctcaagagctgctgtacggcgatggcgagggtctgcaaggagctccgagttcctcgcagagatctcgaggagtcggcagccggatatatctcatggttgaatggggcttgtgcacagctcgaagggatcggcaaacgtatcgacgaggccctaaagcaggagtgtcgtcgatcgagccagtacaccagaggacatgtgctggcctgcatccgagatcaccgcccgcagcagcacctcgagttccttcacgaagggttctcacgttctcggaggactcccacggagattgatggtcttgagcagtcgatggcgccgcttaccgagaaggtatttcggtccgtggattggcgttggccgtcctggtagtttttgtatcctgtaaaaaatatctcaaagaaacatgtaatatattttggagtatctatgacttgcaagaaacacttgtgaaatagaaaaggaatctatctaactaagttttcttactctgggtatgttgtgtatgagcgttttctcactttgcgacttcgatcagtcacttgagccatacactcttcctagcccctagccttgtcgtcggagaattattctcagaggataaggctcttggactcttgacttgccttggttgaaaaagcgctgaccctagcccccagccgtgaagttggaaaactcaatttccgattacacggcttggttaatacgcacggcgagaactcttacatgaccagaacttacatggtcgtttgtctctacatgatccgacaaggccttatccgctctaggcgtccccagccgaagttcccttaggttcctcagaggccttgtcaggatggcgtaaagggacatgaggataggtttcaactctaggtgtcgtcgtggtaagggatcgccgggaaggaacacttagactgtagtctttacctgaaatcaatctttattgaaatcgtaagatgtcttacaagtatggatactattgatttatacataaaattttcgtaattgatcaatgttccatgaatttgctaactcgcgaccatcgttgtctgcaatcttgaatgcacctggccgcaagaattgcgtgatcgtgtatggtccttcccacttgggtgagagcttgttacgccctgcttggctttgaacccgtcggaggacgtaatcgtcgatcaaaagtgtgcgtgctctgatgcgcttctcatggtatcggcgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggaattgatgaactgggagccattgtctattatgatgcggtgaggc

SEQ ID NO: 75484 - DNA, 5219 bp, Oryza sativa
agacaccaaccacaactagcagcttgcctacttggtcagtggagaaaatcttcaacccgccgaccacggttcgattcccaccagctctcccttttagacctattactttgcctctatctctccgttttagacctattattactttgcctctatctctccattttagacctattattactttgcctctatcaggctagattgctcagaaatctcaaatcctattgctactttgcctcagaataagtctactttgcctcccacatctcaaatcctattattactttgcctctcctaggctaaattgctccgcaattttttttatccgccctactttgcctcccacatctcaaatcctattattactttggctctggctagattgttgtgcaatttttttctctctgccactagcacgttagtaattctgaaatcttataatgaaccagtttttaatttgaaaattaagcataattatttttttccttttgtcatctgcaaaatacgacatattagagtccgcaccatctatcgtccacgcatgagccgtgaaaacgattcgtctccacgcaagtccatgttcgattttagaaattatatcaggctcttaccatgcatccgatggctgaaaaatcaaaagttttgcccctctttcttcaatagatatttagtgattctgaaatcttataatgaaccagtttttaatttgaaaaataaacataattattttttttcctttcttcatttgcaaataacactatattacagtccgcaccatctatcgtccacgcatgagccatgaaaacgagtcatctccacgcaagcccatgttcgattttagaaattatatcatgctcttgccatgcaagagttgagagagagcgtgttacgataatatgagtatatcaatatgcaatagcgtttcttatcaatcctaattatcattaatccagtgaacaatttatctatcttagaacattattatatacatgtcaactgtgtatttatatcatttaatctgtcaatatacccgtagcgaagcacgggcattttgctataataataacaaagggattttggctggaaaaacaggaacccggaggctatgggccaaagtactgctaggaacttatgggccactttctctggtggaacctgagcccgtgctagtgttgcaccaaaaatgtctctcttctacagatgtggacaataagcacttggatcatctatgcaaccatttggatcccaagatagaaaatacaaaaagaaatttaaataattcaccgagtcttctcgctgctttgcatttgttgtggccttgtggggggttcttcatgcacacctaagtactctgaaactaattatctgcactcatctcaataaacatgttccttaaccgttctatcattaatcaccaaaactcatttagggggctagatgcactttcactattctcaacttgctttgcttgtatatcaagtgtgattgagtctcttgtctagtttttatcttgcttaattgctcgagtcttttgctatatgttgactagattgtcctagagcagtcggacaatatgagcccctttacaactttccgtttttcactctgaccggacaatccaccacattgccaaactctccgactgctcctatagttagactgtccaacctaatgtcagactatccggttaagctttattccactgcaaatttttgaatttccaggaatgcctattcactcttcctctagctctaggcgatgtatcccatcctcaaggccatttcaaggacaacatcgatggcagagatatcgatggcggtgaggtcggaggtggctagatctggtggcctctaacctccgaatggctggatccgatgaggaggagcgggtgttgcccggatgtgatatgcatcctggtccaattaggatgaggcatgtgtggcccatgaaagttgtgtgtgcatgtttggtaccacatttgctagtttagtaagggtgaaaccaagttataagggcatatttagtaccataagagtttttgtgaggcttttgtgacccataagagttgtgtgtgcatatttagtaccatattgctaatttagcaagggtagaacaaacttatattttcttttgtaccagtagtgatgagtcagtccattattgttgggtttttaaataaaccagcactgatattctaggtttttttaggacacgcgtgagttgggggtgggctcgaaacccttatcggtgcttggtttagtctaatcgacacaaataggggtggttatgatggctattctgtagtacactagtacataaatgcccttatgtgcctgttggaaactggttgtaggtgccgctgaatgatcgattaatcctatatatacatgcgatggtgaaaattgcagtgtagccaaatgattaatcctatatgtacatgcaggatgaagaaacacgtggatgaatacaaaactcataatttcaacattgggcagaagaacaattgtgagttgatgaagttaaaatatcgatcatgtaataaataattttagtctaaaaaatcatgacacattgatcaaatccatcaattgggctagggttgaaaagtatggaaggaatgggcttttggcccaaaaccaaggaatagttataattaactttttcaattatagtgtatagcaattttaatgttttaatttgttgctaaactcctaatagttgtaccattgaagaaatgcttttacccgttgcaacactcgtgtattttttctaagttaactttaaatgagtactatcacaaactctgaagttgttaccaggttcaaaattccggaataatactttcaaaaagtcatgaatttaggcccgccctatatgaaactatttcgccgaaattttcaggaatgttttttttttgtgaatttagccaaagtagtttttcaaatttaacaaaacttgttcaaaattcaaattattctgaaatttccacaattagtgaaatttcggttcaagcagagtctccagatatagaaagctccaaacagaaaaatctgaacctagcttggtcgttatcagcttataaccgccagtaatggtagctagtagtagcagctactcaaagaagcattgccgacgtgatgaagaccgtacgtgcgcgatccggtgatctctcacctcttcggcggcggcggagcgcactgtattgccgccgccggcgaccactccgtcgtctacgacttcgagctcgtcgtgtaggaggttggcgtcgagctcctcgccaatgcgctcgcagaggttgtgcagcacgcagcagacggccagcatgttggctagctccggcagcttcacctcggcacgccgcaggcactgccaccgcgccctgagccgccggaacgcgcccaccgccgccgcgcgcgcgtcggccacgtgcgcattgagcctgtcctgcgcccacgtctggttgggctgcgtgtacggcaccagcatccagctcgtcagcgggtagctcgcgccgccgacgagccacagcggctgttgccacccgagcttgtcgtggccgagcagaagcccagcctcgcaccgggcgtacagcgccgacttcgcgaggacggcggcgtcggagagcgagccggggtggccgatgcagacgtcggtgaaggcgccctcgtcgtccacgacggcctgcatggcgacggagtaggtggccttgttgttccggtcggtaaggcggtggtcgtagtactcgccggcgtgctccctcggcacgacgatgcggacactggtggagaaaccatctttcgtcggtcggactaattccacaatagtctcggttgcaacaaacaccgggactaaagatccccggttaaaaagggtaacgggcatcaccaaccgggactaaagatctttagtcctggtttaaatgctgtcagggcctgtcaggccctcccgggatatttagtcccggttggtatcgtaacattagtcggactaaagatcccagcgatctttagccccggttcataacaccaaccgggactaaaatcccacccctatatatatatatatgtcttcgtcctcctccagcccgagtaagcttcaaaatttcttcaaaaaagaggggaggtcatgccaaaatttctattgaatttattttggtgattatatataaatcggaggtgcctaaaaggttagcaacttcatcctccaatgttttatttttttcatattacatttggatcatgttttgcacacttttttgtcttcaaaattttattgttagttgatgagagagaaaatttgtgtggagaagaaagaatatatagaaatttagtttatttgttaaagaaggttttataaaatagttgagaaggaaaatatagtgaaagttaatcttgaataatagaaaacaaagtaaaatgaaaaattaaaataagtacaacacattaatattagtttaaaactttataaatagtaaatatataattattcggtgtaatatttcataattttgtatgaataatgatatgtcattattgtgttactgttgaaagagtttgtaattattttataattattgtatgactgtcattattgtacgaataattatgtgtgtacgattttttttcatgtcatgtagatggatcggcaatggatatacgctgactggcggtccaaagagtttattgacggcgtgcattattttttgagagtggccgaagctaacaggcaaaagggttttatttgttgtccatgcaataagtgtaagaatcggaaggagtattctgcatccaggactatttatttccacttgtttgagtcggggttcatgccaagctataattgttggacatcctacggagagcaaggtgttgaaatggaagaagatgaagtggaagacaacaatattccgaactttgctcagtacgctggatttgaaggaaatcaaacgggcaaggaggaaagggatgctgatggtaacaacgttgcggatgatcttggtcagatgttgcaggacagcaaggaggattgcgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgataaggcatttggcgatttattgaaacttgtcaagaacattcttccggagg

SEQ ID NO: 75485 - DNA, 2569 bp, Oryza sativa
agctagggacaggaccttaaaggaactaactctttttgttgatgtgttgtttgttttgcttattctgcaagttgattaagcaaacaacctagcatggttacatcacaacccaccgatgcaaaccacgcgctacacacacaagcaaggaaacacacgacaaacgactctaccctagagggtggcttaggttctgcgacgggttctccaagatcttcactcctgcttcacagctggcttcactgcttccttcgcttcgctggcggatcctgcagtcttccggagcttcggcaaacaactgacgacatcttcttcttcgcaaagctgaccatctagtacttagttgaaatccgaagaaagaaaagagtaacccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcatcaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggagatgcacaattaatgcaaaggagtacaagggggtaataatatagggtttaagttttgcagtaaacagcatttaaaagtcacttagttgcccaaagccattttataaagacgatcctagcgctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgctgagcaaattttaagaattaaaacactgacttgggtacattgctcggcttgcccataaccgagggcgcggctattcgaatagattatactctaatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggagaatgtccatcgacccccgacttcatccacctccatccgtgtacttttgtttataaccagactgagccacaaactaagccttacccacaagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaatttcccaagtctaaagttgtgaaaccacctaatgttgtctaattcaaacagcgaagcatctacctaaattcatactagtggaaccatgaatagagtacccactagttgaggttttgtttaatctagggtgaacaagggaataataataacaatagcaataataaggtcataacaaaggtaaataggcatggctaaataaaacagtgataacgcgggaatttaaataaagcggtaatgcattaatttaaatcaacataattttataaactgggattcaatatgctcaaggatgatgtgacttgccttgctcagagagaacggacttccgaaccttcggcgacgaccgcgaaccacgcttcgggaacctccggaacgacagaagctacgcgaagcacacaagcaaagctacaagcctataaagaagcaataacagtacataaaaagaaagcaccgggttctttaggttataacaaacattaagagacttgaacgggtcgattcggagttcgtatgaccaagatatgatcatccgaagtttaatgctgttatatggagatttgcggattattataattaagctttgcaattataaaacatgtgtaagcgctagcctgggaaaagacaggaaggctgcgccgttgacatgcggaccccacatgtcaacaaaaaggaccacggtagaccgagtacacagagacggtccacgggtcgatggaagcggatcccgtgtgtcaaccgaggcgagtggccgacaacggactccactagacaccacacggactgcacacgtggaaaccacgcggctaccgagcggacacactaacacggt

SEQ ID NO: 75486 - DNA, 3014 bp, Oryza sativa
cgactcgaactctggtgatcctgattgcagccgattcagactttagccgatcctcgctctgtttccgtaacgatctccatcctggattctgctttggttttatcttcatctccgatacttgaattatcaaatttggttattaacaataggtccaaggggaattcgagttttctccattttttaatggaaaatcaccacagaacttcaagcaaaatggaaatttcttttttttttgaaaaagaaaagaaaagtagctattcctcaacgcacaatcccaaccttgtaaacatttaattaggagagtaactatacatcgctagatatttttttaaaaaaaatactttcaatagtataattagtgtttaattatattaaaactatcatgtaaccaatatataactcgtatataacttaaaaaaacacgtttgtacttagttggctagcaccttgagcatccactttcaactgttgcaagttttttttcccaccctacatgactcgaagcaacccaacatttagaaatttgaaagttctagaagaccaaaaaattttctaatgtttagtgattccgataaccatcgcaagtcatcaataatactttatgtgattgatcattgatacaaaacaaatccacccgacatggtgtcagaaatgttgtagccataaaattgcttcctcattttttttgcatatggttcgtatcgccgatcagacagatgacataatagcgttgcttaattatacaaatagcacgaatacactaactaaattatttaccctactatagtttatcaactgcagtcctatagaaactttattcattaaatccaacgacctatatcgtccaacccaacgctccaaatcatctcacgttccccctcccctctctcccactttgcctgcacgggtcgcacgccacccccaccatgcgccgtatctcgcatgcgttgcaccaaatcctagctcaagtatgccgcagcccgcaggcgctgccgcgccatgccccccgaccctcttgccggtctcctcagcgccaccgtcgcgctgaccacatccccttctgtaccgcggcaccaccgaagactgtgtcgtggcaggcgtagtgctgggggacctacacccacacccagccatcgatgagctcctggaggtggagggcatctctcttgccagtggcctgacttctccctcctcggctcctcacctacgccgacctcctttcctccgcagcctacctcggagtcacagattgtcaccaccaacaaggtcagttcctatcacccctgctccacttcttgaagagctgttccatttgatgatttttgtggcagcagagcatatatgtgagcctgacagggaagctcgaggacgtcatgtggcagccatgcaggtggccaactcgacgatggcaggcacatcaggcacaactacaagagattttatgataagtgacgtttcatttacgtcacaaacagtgaaatttacgtcatgttatgtaatctgtgacattcgtcacctatcatgcgtctctaatggcgttctatgacgaaatcttattttttgtcattaatctagtgacgattcttctgtcgtgatagagttatgacatccattttcgtcaccatcaagcctaaaaatcgtaatgagattctatgtggcctattaaggtccatatagtgagcaacttgtttatggggtagacctattgtaagtccaattagattttaataaattcagcccaattatactatatccatccatattaagtgggccatacatattcaaaagggccaataggcccaaccattgcaatgaaattgaatctaggccattgtcacgcccagaaattcccgaatagaattccaagcagaatgtgcattagaatccccgtccaggaccggccgaggtacataaacgacaaagtttacatacagatccacgtcttacaaatattataaaagtcttacataaatgcagcggaaaattaaaaggcaattggagctaagcctcgacttggactgcagcgggaacaccactccacaggcatcctcgacggcacggacggagtctactcctcggagaaacaaccatctgacgcatactcaaactctggggtttggggaaaatagagcaagactaagtacaatcaccgtactcagcaagtcataccggaataggggtatgatgcagggaattatcaaaggatagccatagaggttcttttgcataaagcgagcatttataaacagtagttgaaagcagaaaaacagttgtagtaattaatcaatattaaccatccactgtccaacgctacaccacgttgcaacaggcccaaccatccacctagactattcaattccattagctaactaagggtgagactaatcacggtgaatctggttgaccgcccataaccgcgggcacgactatttgaatagttttactctgattagaggtgtacaactgtacccacaagacacagccccacgacacgttttcgtgtaccgacatgccaccacgacataccgaaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccaccccgctccatcacacccacccttgcctagatgcgtcagctagaggaaagctacactacaagcccagccgttgcccacgctggcttgtggtaagcacgataaattcttccagggtttcccgcgaaccggtccttaattgccatgggtgcgactagcaaaaccatgcacccacagcccaccatgtgattcattttaattaaccaacaccgaagcggtgtcactaatccaacaataccattagaaccaacagtctaaacattaataggattttccccattatgtactagttgaactaagcatggctaagcaatccctagtccaaagtctattcatgtta

SEQ ID NO: 75487 - DNA, 8698 bp, Oryza sativa
cacaggcgatgaaatgcctgatgacgtgcaaaaaagaacaaaaccaacaaaatccccccagggagagaagcaaacctaggaaaaactggccctttggttcatcagcctggagaaaccaagaggcacatagacaagtgcattgtaataggaagaactatgattcaggaagggccaagaacaaacccgggtggtgtgcctcctagatcggccgcccgccccatcgaccttggctccagattcgccaccatcctcagatcctcttctttccaccacgccattggctacttgcatctaatgccgctgctcatgaattttccatgtgaaaagactaattatgacttataccttagtaatatcttacttaaatcaagcatagtagcatcttactaaaaccgtaagaaaaatgaaagtacaaaaaaatctcgagcgaaacaagacaatcccatgggtgtaatttttcaacttgcaagaaaatttacccaagtaacaatacgctaatatgtatgaactatcaatttctgacctaaaaaattaccagcactacaagattaaaagtgaaaattgggactggcaaagctgctagataaaaaaaatccaaagcaatgccctatagaaatattaggatatcagaaaaatgaaccaatagataatgttacaccattgggaaaaattttatcattggcaacgccgttgtgatttaaatagtagaaaaatgcaatcttggcaccatctacaaaataactcttcgtcttcataacaaaagcacatgtaaactaatgttctactattcaatccatcagtacattaaattagcatgaatacatgttgactaaaaataaatatgctgaggtttatctaaaacaccatttcatttgaagcaacacaattagaggataaaacatatggcatcccatattaaatatttccatggtttcaacaagtaacaacagcatttgcacctagataatccaaccaaatcactgaaactcattctcaagaaatgcaactaaatggaaattttgaaatagcacattattctaccatggtgtactaaaataaatttgaaaaattctaaatcattataagtaattcatgctaaaatgaattttcaaccacatgatataaatcaaacaacatgataatttaaatatggttacaggtaatgacaagcatatcatgtatataaatgctgggggcgccttggcacgcctcctatatatagtttgctcgaattgctgtttcgagcagtggtacctactatgtattacttcgtacataagaaagaaaaatgacagaaaccttaaaggtgcattatttgaatgataaatagtcagactatgcatgagtcgctgcataaaattggtcgtgcctgtgattacattctgtgttgacaacaaaacatgcaagtaacagagccctgctaaatctacatgacaagtaacaattacacaagtccaatggattgacgagataagagtattagtcaatagatagtccagacttcagagaatatatatgattgcttccaagcgcttcttaacgtagaaatgggagatgcaaactgctccaatctgaatgctattggttgccacgaaatctatccatctcattctgaggttgcaatgaccatctattgacgtgagtatggtggttgggtctcctccagcttgtacttgaatggtttaatttgaactggcttagtggccatatgtcatgttgaatactgtcttgtgaaatattggtgagaaaagcaacagtcagtttggcatgttttcaaacttcgctgctcaatggttgtcttgttaatggttaccgtctaaaattttttagaatggtcaaggactttttgatatttcctctatgaagcttcttgtgtcacttcgtaggttcctcaaatgggcgttcagtttatttgttcttttaatggatacactgaaaatagataagatatgaaaatcgatttgaaatacatatgtgcgtggatagtttgaaaaaatatgctaagctcacatgaatttttgtaactgcattgatcatcacggttacataatttatctgtgtcgccttcagaggatgcttctgtaatgtaacggaggaggattatgagtaatataactgctatatgaggtactaaaggcaataataactttataagagtagatcttgatctgcgtgattctaaatttatttgaaacgtaaatgcgcaaggatagtctggaaagtggaaacagatgataaacttgcatggattttgggaactgcattgaagacgttgatctccaagatatgaatccattcaagaagaaagaacgaacggatagggccgaaggaggaagatttaccaagatgagtcgaagagggtggctattcaaccttgacgaagtcagcatgccaattttttaggtcgagaccaacacctcagcagcgtcatgttgctcctttccagctcctcctcaccacactggctgctggcctgcatcagcatgtcctccgccgccctagagtgagggctgccaacggcagccatcatcttcttcaccaataccatcaccttctcgaatggatctgctcctccttccccgcgatcgagggagaccgggacagcaatacacacagataagatcatatatacaccttctttgagccaccaaacagcaagcatgtgatagctttcttgacatcagaatgaccataaattcaagggccaatcattgagcaaatcttggcatacgcatttgacctctgtacaaattcttagaattccatttcctacaaaccaacaagaaaattaacgatgtaaatatgttgtagcacccttcaacaagaaacttggaattttggaaagcagactacctcatcaagtgtaaaatttgagggaccatttgagttggcatctagggaggtaccgtttgtctatatggaataataagatttattagtacaaggaccatttgagttggcatggaggaacatggactcatggagtacaaggacttcaccttgcaatgaggcattaaggaccaatgatgttttctcaacaattgaatatgtatattctgttttatccatccaacatataaagctgccatattgagtttatattgcttacaagttatacccaaactccgtacaagttactaaacagaatatgtacaggaggcgcgttgttctaatctctacaataataagtgactcaaactgcacattgattgattaaaaagaattgaaagctttcagcaagcaagcagatcctatagataattgttaccttctgaaaaactggatatccagctttaaatcttatgcaaaggaagaccattattggctagaatggcccagctcttgtcacaagaatgggttgcataggaatgttaatatctcaaaatctgttcatgttggaagagatggagttagtttttgttcaaaaccaaaaattagtggaactttaaataaaggcaaaatttgctaaagaacatctaaaatttgtgtaattggctgaaggacactgcaaaatcgtgtcactgctaagggacactacaaaaatgatgtaattggctgttggacactggaagcattattttatcattttcgagcaaaaagtggagagagaaattttaaaaatacaagtttgcccctgcctcttaattgcacaatccaagcgctggttcacagccaagtacacacttattgtggatgagctgccgcttgagcaggtgtgaggtgaggtgcgtcattgccgacagtcaggggcatcattgccggtggggaagagcgctaggcccaaaattaacctctttcaacttgaagtacaaggcagcgcagagcagtagtatcccaaacgtgggggtgtctcggccagcaccgccgccatgaaagcttttccagcgttgcgaccaccatgtcgttcgccgcctccgtatttggcttcaaggtgagcacgaagccaagtcgaatgatgggtgggcgcagaagaacgccgcgtgcgattgtgagtagagctgctgatgatggagcaggagctcgggttgcaaaggggaaacaaaatgtaaagctcgataccaaattttccgcatcgccgccgctgccgcttgcattggaccattgcctcctcgcgtccggccaccccgccgtcgctgcccttcctctccctgacgcggcccccacctccaccgcttcctctccctaaccctgtccgccgacgctccaccatcaggtcggcctacaccgaccccaaaaacccatcccgtttgttgctcaatattgagctgaagcaagaagaagaacagtgccaggggcacattcgtactttccacggtttttctctctccattagcatcaaatataataaaataatagatctagtgcccagcagccaattacaccatttttatggtgtccctcagcaatgacacgattttacaatgtcctacagccaattacacaaattttggatgtcctataacaaattttgccttaaataaaatactccatcggaatataatcaaacactgaaaccattgtaaaagccaatatgtcctatgtattacatccactacgaagcaatattcgacgagtacaatggaacttagaatctcaatatatgaattacaatgtatcattataaatttcagttgctttcaacctccttgcagttttaggagtaggattaatacatagacatggttactctaaacaaattagcatgttaccgcactttaaaataaactaaagcatagttaaaaacacccatccatgacccgcatgatatattccaggttagcaagttaaatataagctcaggccctcctatataaagccgtggcattttggttatcaaatttacagaaagtagcaacgaacacagaaatgtcaccttggtctaccaaaagatgcggtatcagatgggacttttgcaggaagatctgggtgtaccttagtgcaaagcttctcagcttgcttgtaatctttttagcttcaacttgcatgcaacattgttcaagtcacgaggcggaggcggaggcggcgacgggcacgcggcggttgtggcggccgtgctccgagatggggtcggcacgaggcggaggtggcggcgccggaagaaggagagggagaaggtgagtcgggaaggaggagaggatgacgacgcgagagggaggcagaggtggcggcgcgagacggcggcggcggcgcgaggcggaagagggagaggaagagggggaggcggtggcggcgcgagacggcggcggcggcgcgaggcggcagagggagagggagagggagagggggaggcgcaggcggcggcgcgaggaaatggggacggcgcaagggggaggcggaggtgacggctcgaggggtgccggcggcggcggcgccggagagggagagggagagggtgcgggcggcaacggagggtttggggagttaggtagtgggcattattttgcgaaaaagcccctattattttcactttttacatataggttcctatccgcgatttctcctctccaaatacgttactgagagacctatacggaattacgaacaaatatgagagtttctttgcaaaatccgacgtggcgtgctccccggccgcccagcccgccacacttaaaggtttcttttagtgttgattaaattacttttagagtacttttagatttaattaaattacttcctatacattcataattttagatttaattaaattacttcctatacattcataatgctagaggtgactacctattattgttttagtcaattccatagtttgtgctaattaatttagtttatagatagagttatgtttttatccctacaatggaattacccctaatgttatgacaaagttactttcgttttgtctaaagttacttctataatatatgtaaattacatttagactttattgaatttacttttgtatgtctaagaagtaatttagtgatatccaaaagtgaaggaggatcggatgtgaaggaggaatcgagatagagattgtcccggaaacagagtgaagatcggctgaagtccgaatcggctacgactaagatcggcagagttcgagtcggacggggttagccgattgagccgaatccgacaatatgacacagcatatgttgtcggtttaggttgacgtgcttcatgatgatttccacgcatggatagagtcctgagaagtcaattgtatctattacttaggatattttatgtaatttccttagagatatgtttgggcaaaagtctactgcaaagacttatggtatcttagagtttgttagagataagagtcgtgtccgatatgaacatattttgtaattctcgggtataaatagaccaaagccccatgtaatcaaactaacacacgttcaatacaatctcggcgcatcgccacccttttattttcgttttgtttcgacgagttcttacttttaggttgagctgcatcggtttcgatcttcaacaagaggtaaaacttgttatggtggcttgcgttctcgagattagtgcttccatcttcatgatactctaatcttgtttatgtaattcgacgagttatcatatatcttatataatctccggcaatatcgctatctaacctacaatcggctaacaattgttactagaaggcagccgattaggttaaataccgatgttgacttagattatataggatatctaccactctatgacatatccgacgacttgattgtctagatattgtccttcttttcatacttatagcttcatcagttgagtttgatcttatgagttgtgattagaatcttaatctctagcctgtctttggttgctgattagggtagtattggggtttcagccgatcttatctgatttaactacatttatcctacatgcttctttgacatgttaaatttgccctttatgttaagatctcgttgcatttaagtatattaggctttttgtttgatatattctactcgctttaatatcctaatatagagtagtatcggagtattagccgatacatgctagatctatctgatcggctatgctatgaacacatataatctcattattagtatatatttcgatctaagtgatttatactgtctcggcatgacgaccgatctatcccaatcacttgatttaagtatatatcgatctaaggattatatattgttaatatctgcagccaatcgagtagatttagttctttttatttcttaatgactgccgatcgatgcaaatatgacgtcggctcaaggataaatgatatgtcatcggcacttagccgatcggctatcgtttatggatttaaccgcggttttctttgtcttagtttcctgttgattgcatgatcaaatcaactggcacgctcacacacccaaaggcaagttttggacctgcactggagttaagcagatcacccaggcctcgtgtttttacatcaacacgcttttggcacgcctagtgggaccgattagaagtcagaaccgcaacagcattctctcatggctgagaaaccaccagcatcgccatcttcggctggcaaagagacccctaccaagaatctaaagtctggtgcatttgaggttcacgaaggaaacattgcccccgtcactatagacaagctaacacctgagtagaagaatgagctcaatctgatgatgcagcaaacacaacaccaattcttgaattcattcatggagacccgtaaaggaacaattgttcagaggtacaagatgaaattagttgctgatgttcctaggacaaattcttccaaggatggagaagtacaacaggtctcagatggtacaactcaatcaggcgataaaggcgctgcagatggctcaggtgacaaaggtggtggttctcaaggggctcaaggtgatggttctcagggatttcatggtgagaatcttaaccaagatggcaacacgacacagctacagtttaacaacttccaatatcggattgactatgccctacaacatgctttgattaatcaatctggaatgttagtcaacactttgtcaaacatggtgaagtcgatggttgatggctcaatagctgaataccaggctacaggaccggtttatttgccaggaggtgttttcccaaactattggcccttgatcactaataatcagccagctgttcagccaattcctcccaatgcaccatcggctcaaccgacagcaccagtatcggctcctgcaccagctacgccatcatcgacaccaggtcaattaattaatcctcgattgttggtaagagagcagccatagcatagtggacaaaatgtgaatcggctaactcaagaccaagttgcagctatgtttttaccacctcagcctactgttgacctagtccagcaacagccgattcagcagacgccaccaaggcagcaggttgtgcagccgattcagcagacgccaccaaggcagcaggttgtgcagccgattcagcagcaaggtttgctaaatgcatcggccgggttcagaacacccgacaatcagccaaggcagcacgctgcaaatcaagttgtcccagagcatttagttcataatgtgcatccagatcaaacggtgatacctcaagtgattcccgaacatttggtgtgcaatatacagccaaacttccagaattatcaagggggcaatttgaattatcaatatcagcctccatcaccgcaagttcagtatcaataaggagg

SEQ ID NO: 75488 - DNA, 8086 bp, Oryza sativa
cccctaatgctgggaaatgatcttcattaaatatacaatcagcgtatcgacccgtatgtacgtctcctgtcaatggttctaaaaatttaatgatagacggagattcaaatcctacatagattactaattttctatgaggacccattgacgtacgcttaggtggcggtatagggacgtatacaacacatccaaaattgtgcagatgggaaatatttggtgcatatccacgtgtaagctgcataggggatacaacattgtatgcagtgggtctgatttgaagtaacgccgctgcatgcaaaacagcgtgtccccaacatgtagttggtaggttgctatgcagtagcaatggcctagcgataagcttaatcctcttaattaatgattcggcgagaccattgtgagtgtggacgtgtggtacagaatgttccactttaattcccaaagccatgcaatatgcattaaataccttagaggtaaactccccggcattgtccattctaatggattgtatccggttatccaggaaattggctctcaactagattatttgggaaataagccgcgcaaaagcgtgctttctagtagaaagtaagcaaacagtgctccagcaagttgatgcatcaattaataccataaaataccggaatgatccggacattggattaattggtccacatatgtcgccctgtattcgttgcaagaatactggtgattctgcgtccacctttaaattagagggtctaacgattaatttccctgttgcacaattagtgcaaacaaaatcttcttggtttgggaaatcgttagttcgtaaattatggccatttgaagtgttgcacaatcagtgcaaacaaaatcttcttggtttgggaaatcgttagttagtaaattatggccatttgaagttaagatgattcttctcatcatccctagaccgtattctgtatgactcaggatttttaaatattgttttcagtgcaacattttcgggttttatatgagtgtagtacagtccagatttcaaggaagggagtttttcaacaacagtcttatgatttccgtctaatttcgttatgagaagaaattcgagtttattctcatctttggtttctacgtgataaccataagcacggatatctttaaagattagtagagtacgactggactttagatataatagagcatcatttataatgatcttggtaccatgtgggagaactactgttgctcgtcccactccgacgatgggtgcattgcttccggcaatagtagcgatttgaccagtctttttctttaaagtctggaaatacgtggtatctcaaaagatagtattggtggtacaacagtctaccagacacatctcctcttccattgccatagtacgtaacactgttctatcataaagaatttaaatatagtcaattcatgaccatatagcaaaaataacactttaagatagaaaaataaaaatctggagaatatattaaactaaaagagttcactcaattattaagataaccacgctctgaaggagcttacagaaactatagttctgctaggaacacaaactaaatgcacacttgaaaaatcacctaactttagtctattacatagtctaaaatttaaagtaacttataatgcaggaagctaagatacaaattggaagacttaaatgtccccatataactgatcagagtccatgagatcatctgagagcttcagctctgcgtctgctgcattcttttccatcttatcatcgatgtgcattgcaaccactgccttctcgtcgacctgcttgtcgatatgcatggcagccatcttctcttctgagtgctggatctcaacagtgaagtgtgactcatgctctgacttcttcttcctgtgcttctcttgataaagctcaatgagatgcttaggggtgcggcaaatgcgagaccagtgtcccctagtgccacacttgaagcatacctgatcttgctttccatattcaccactagtagagcccttcttagacttactgttctgatttcctttcttcttgaaagacgtcttgttaactttgccaccatttttccagaaattcttccctttgttctggttattctggtttttccccttcttaaaggagctagcatttgcttcaggtgctgctgaacttccagtggggcgagacgtatgattttcaacaagtgtctcatcttctccttgtgcttcgatgagcatggagaccagttcagaatacttctcgtatttagcctggcggtattgcctctgaatattcacatgattggcatggaaggtggacaaagttttgtctatcatgtcagcatcagtgattttctctccacatagcttaagacaagtgacattgcggtgaagaactgagttatattgctccacagatttgtaatcttggaaacgtaagtgaagccactcacgttttgtttttaggagcaaggcctttacttgatggccatagcgatccttcagtgagtcccaaaggaccttcggatcttcctcagtcatatactcattcttgagagtagtattcaaatggtgcctcaggaaatgcagtgcctgatttttctcagctgaagttggtaaattattaactcctccagctgatgttgcaatagttgggtcctgaatgcagttcaggagtttcttagcaccaagcatgattttggcatccagtgcccatgtcaggtaattcttgccgctgactgctagttcagcaaaatctctcttagcaatatcagtcattttcctacattagtcatgcaaaattcaataagtactgcaagtaggagcatgacaagtgtgcaaatagtaaattctggttatctaaatttagtactgtgtcaatatattcccataattctcccaataattttcagaattgtttcactaattatttaggtaccaaagtaattactgaattactaacccattaaatagtattctgaaaacagctaggaaaaataaaccataaacacgatgctcaggttcaaatgatgagagctcattgcctaaaaaccatgtctctaggattttatggttgattcaaaaattaactaataaatagttaatatacagaaaattgaaaatacggaataacaaaaataatctgacattctcagtaatttctataatcccgagggactattccgctaaaattccaaatccgcgtgtatcctgaaaattctaggacatatttagaagtttgccattttcgggccaaatttcgatttgagcccgactccttttataggcctaatttatactcggcccacctctatgtaccggctactcaaattttaaccggcccgtcgggaccgtcggcctgctaatggccttggcccataagcggcccaacaagagcgctgcaccttatccaatcgggtggctagggttgaaaccctagcccccaattccaccgattcgatggtggcggcgagtatcccggcggctcatgcgagtgaggcggcgaggttgacggggctcgtcgtcatggcggggtcgacagagctcgtcggcgcggcggggtcgatgacagaggcggagcggcggtgaggctacaagcagcactgacgctggcgtggttggctacgggccgtatccagcgtccggcaagcgcagctccttgctgtgcgccggcggaatttggctcggcatgtgggccggcaaggcggacggctatcagcggcgggaggccgcggcggcttcggcccccgacccagtcgtgtgcggtagcgctggaggcgtgctgtgcgtgccgtcggcgggggggatgcgggcgcggtctcctcagcgtctctgcgggcggcggtcgtcgacggcgagtgcggatggtcgattgaagacccgtcggctggcttttcaagggcgaaccgacgacggaaagccgatggcacgattctgcggccatcggtgaagggggtggctggcgacgcgtgctggcggcagcaagggcacgacggcgcatgctggcgtcatcgactcggtttcgtcatcgtcaacatcaggaggacggcggcgctggcatgaggatttgggccaattcgttcgtaatcggcaattacgttagccaggtacgcgattcttctcatgtgcatcgcgattacaccctgaacgtagcgtcgcccttcgaggcatcactagttctaaaccgtcgttcttgctgtggcttgtctgatccgttcgcgcgtctagggcgtacggtatccgtgtctttgtttgcaagaaaagaaacccagcgcaaaggctgggaacagatctaatcggactatagcgataaccgcttctcgttcgatagatcggttgtacaagggataaccccatacgcctgtcgcgcatagggtggagagctgcaaactctcctgctacgtgcgccataagggacaaatccacgtagtacaacccatcaatcgaacgattagcggagaaataaaaataacagaaaacgatctagcaagtttatcgttatccctatagaacgagattagaacagatcgatgttgacaatataccttggctgaagagcacctcgtgctgataacgtgttagaattcatgttgtcaacaatcgaacaagcacacaataacacacggacatgaaagtggaaggcaatcaactttattgatgtttctctctctgttacaagtattactttgccctcaacctcactattgtatttatacccacaataggatgtcctatatggatacatacatatatatttggtataagcccacttccttaataaggaaacagaagaatagaaggaggaggtaccgtgatcctcacgatcacggtcctacaaatccgactcctttgggagatcggtttcataacagtcagggggttacaaaccagagttaaaaaccctttctccagcagctacctattgttgagaaggccgcactcaattaatttctttaatctcacatgattatttagattcaggacttttggtttgtacagattctgatccttgcacggattgagggttggtcttctttgatgaaccatgcagagaacacgggatgttgggatataggatatccgatcttcttttaatcttctagctagtacatgttgtatcttgtagttttagtctagtaatttataatttaatttttaccaattatctcaccattgcttaaatgactggatgtttgaattgataggctgtgttcttggttaatctctttttttacacttatcacatatataattaattaattatataagtcataccacatgttgagagacaatggtgacacaatcgacttgaaatcctggctccggccattatggcacgtggaggctaagaaataagcaactcaatttacgggttccgcatggtagttgggtggtcactgccatcactactataggttctaatatcgaataattgtttgttaaaattttaaccaaacaaaagaaaatatatatacactttaaaatatactccctccatattttaatgtatgatgccgttgactttttgaccaatgtttgactatttttttattcttttttttgtaaatatgaaaatatttatgtcatgcttaaagaacatttgatgatgaatcaaattacaataaaataaataataattacataatttttttaaataagacgaatggttaaacgtttgataaaaagttaacggcattctactttaaaatacaagctagctagtccaagtccagagatagatcgatgcatgacctaattaattaactctccggtgtgtgcgtgtgttggggctggggcctgcaggcgttgccttcatgcagaagaaataattgtagtggtggtccgtccgccggccattggatatgtcgtcatcgatcgtcttcggcgtcgtcgtcgtcctttctccagctctcgctgacaggattctgtgtggagagcggccggcggagttggtagcgaatttgcaaatgcacgcggtcgcgccgaattctgtgtggatgacggcagcccgcccggtcaccctagcatacgcacccggtcttgaaaacttgagaccagtatgaaacattgaaaacccctctgcacgcatatatatatatatatatatatatatatatatatgagttgcataatatgaaccaaggtgcatatgcacctatatgcatagtttgacacatgtatctacctgattggttcccttcatggtggctgtaagggatggtacatgttatgatttttgtggtccaaaatgtcccttaagtagtactataatagttcgaatgaattgtttttgtggttttcctttttttttcaaagtaatgtcctatgtttatttaatatgttgataaaaaatatgacattatatttctgaaaaacatataatgtagattcactacaacatattgtgagataattttgtaatttttttataactttagatatgtaattgatattttattcaagaataatgtatttctatttcccccctcaacggttgtattatctttttatgggtggattttgtgttctctttggtttgcatttgcaagaattttttttctcatggttttttagtcaatgcaagttataggtttagatataaattattttgtaaatgctatttagagatgtgtcatttgcaagtttcatttttagagaaatgtcattagtatgaacattaggagaccatttgcacattttatttagagatataaaatcattttctaaatgctatttagagaaatgtcaataacagatcatctgcaaattttatatttcatacaaacgaagatatatgatatatcagtatgaacatgttcaataaatcttaatatatattactctactacaaagttaagagaaataaaaaatactaatatttatatgtacgagtacaagatagaaatttgctttgaatcaatgaaccaatgaacgtctcgtattgtaacatactagtataaaagggcaatttgggacaaactcaaagtgggcagtggcattgtgtaccttccctcatctctcccctatatagtaatagcacaaatcttagcagccatcaatggtgtaaattgttggtgcatatgaacctaggttcacatttgcttttccatatatatatatatatatatatatatatatacttaaaaaaaaatttgtgcgttacaacgagtgaaggttattttaatcttattattattatacggtttagttaaggtgaaatttactgtgggaattctcttagatatttttttttacaaaatcaggagctgcaattaaaagtccgatcgtcttaagttagtatataagtttttctttaaaagaaatttcttatatgacttttatggtatttctaaaagcgaaataacttaaaaactgactcaaacacggatctgtatttctaaaaacgaacgaacttaaaaaccgacttaaatacgaatgaggtactaaaataccgataaaaacatcttcaatgtttataatagtaaagagagatagaaataaagatacttagcacaattatttgcttaatatttgattttcttttcctaaaaaaattatactttcggtcgttctatatctgttccaagatgttttgatttctgcaataatgtcgttctatatcggaagtatgtatttgttttgatttccttttatttttttttctcgttcacttagttttcattctcttcttccgtcttccgatgcgtggacgctgcatattggcaagacctccggtgaaaactcttcattcttaattgcatctgacggttcttgttattccgatgatgtggtttaatctgctaacgagaagaaacaaccaactcaacatgaaaaaaaaaattaaacccttacttgatctatacctaataaaaaaatacgtaaggcttccggtggtttttttcgtccgtcatcccacgttgctaaaatccgttttactccgcttaatagtcggatcggacttttctaatctactccaaaacctcggttgatatacaatatttaccgctcatgtagacaccaaccacaactagcagcttgcctacttggtcagtggagaaaatcttcaacccgccgaccacggttcgattcccaccagctctcc

SEQ ID NO: 75489 - DNA, 42607 bp, Oryza sativa
tatgcgggaaatgctagaatgacttacattgtgaaacggaggaagcacttttttttttgaaactgaactcagtacttgatgctgaaagggttggtctcgttgcaacgtgtgctttaatttgtttgcagtggcattcctggcttggtagttggtagcgaccgtttttttgacaaattgacccttttggaaaacttacttcgaaactaacccctgccaaaaacttcaaccaaaaataggccgtcgcctcagcgccaaacacattggcgctgacgttggtcgtgtcagcgccaacgggactggcgctgacattgtgccaccgtggcggccgggccgatcccctagctgacgtggcagctacatcagcgccaaccgcttcggcgcggaggtgcccaacctcagcgccaaccggactggcgctgaggtgggacttggccgcaacccccaggcccagaccagcaagcctcctggatggcttgcgggctgggatctcagcgccagccataatggcgctgactgtgggaaactcagcgccagtccacctggcgctgaggtgggacttggccgtttcggccgtggcccagcccagcaagccttctggatggcttgcgggctaggacctcagcgccagccataatggcgctgactgtgggaaactcagcgccagtccatctggcgctgaggtgggacttggccgtttcggccgtggcccagcccagcaagccttctggatggcttgcgggctaggacctcagcgccagccataatggcgctgactgtgggaaactcagcgccagccaacctggcgctgaggtggaacttggccgtttcggccttggcccagcccagcaagccttctggatggcttgcgggctaggacctcagcgccagccataatggcgctgagtttgggcatgtcagcgccagttagcatggcgctgacgtcccagccctgctaaaacttcagcaaaactttgcacacaacacaggcaaacatcaaatgacagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataagccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaattgaaataatatacaacattaatgctagaaacgaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacagtaggtccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcaccttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggcggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaatggccgagcaagcaaaggcgcacgatctctctccgagtgtgagcggcgacgacggggaaccaaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggcgcgcttcaggttgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccgtgtcgtcaaggcggagggcgcggcgagcggcggcggctgcacgtcattcggctgctactccctcgtcgacaccttcgactcggaaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcccccggctggtggtgttggctgtagagcctttgtggcgagtcttcggaatgtccgttggcccccaaggttccggcccaccatcactgagaagtacgatgggagcgtcaaccccaccgagtttctccaggtctatatgaccgggatcgaggccgctgggggtgacgacagggtcatggcgaatttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagcttgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttctggcaaacggcgaagtgaggccaagcagaaggcccccgctgttgacatcgatgatggtgaagatgacctaggtttccaagaacctggggccaccattgccaccgtcgatggaggagcgcgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccagccgtctcaaccaatcatcggtgtgacgccggggcacacatggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccgacagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcggcttaaaaaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggcctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacctttgtttaagctcctcaagcgctcggggccgttcacttggacggaggaagctgacaatgccctcgcccagttgaaggcgtatctcagctctcctccggttctagtcgccccggagccaaatgaacccctgctactttacttagcggcgaccccccaagtagttagtgcagcgttggttgtggagcgcgatgaggacaatcctcattctgcgcacccccactctgtgccgacttggcccgggagcaggcagggaggagaagcccccgagtcggacggtggcctacggcccctgacgaccggagtcggccctctgcccgcttgtcagacggtgctgggtgcccccgacccacaggaaggccccgaggccactgcgggaaggccgcacctatcgccctttggccccgaggctaaccctgtgctgactcgacccgggagaaagcagggagaagaggcccccgagccgaacggaggccagaggcccctgacgaccggagctggccctttgcccgcttgtccgatgacaccaggagcccccgacccccaggacggctccggggccactgtgggaaggccgctcctgtcgtcctccgaccccgaggtcatcggcacagaagacgagtgcgccccaaggggccacttggacgaagaacgccccggggatacggcccctagcaaagaagatcggccccaccgaagggtgcagcggcctatctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggctagcacgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggttggggatccgccgcctcctggtgttaggcgactctcagttggttgttaaccaagtctgtaaggagtaccggtgctctgatccgcagatggacgcctacgtgcgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgttggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttactggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagattgataagcactctgctcttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtggtcggtgtcccccggccgggctcggtacggctggccacgggcgacggcacggagctgccaaacccgtggaacattgaacaccttcgtcgcttctacccttgaagggggggggggtcgggtgtcaggttttggctcgggctaaccccgcacccccctcgggtgtgccgggttagccgggggctaccacacatgcacagctttacttttcgtatttcagcatttcaataaaagaagtttcaatttcctaaaggttgtgtctgtgccgtttttccttctgaagaatcttaacttgaaataaggtcactcgtgctcaaccttaccctcgggggctcggttcggtcagctaaaatcgccaaacggggcccagaaccgagccgtgccccgggacgtggtgaactccgggggggaaccggcaaaaacccacaatcgggtcacccatacccctcggtcaccacgttcccggcctggccagtctcgacatgcggacttgggcacgagcccttatttcaagctaaggcgcaaaaggaccatggcacagatcatcctcatctcatatatagcaaaataaaactaacacaaaaattttttttcatcatttctcattgcagattgagttaatttatacaaaaaagaggcatgaaggccttagaagaaagaacaagaaaaaagttaagattggcgggggcctgggggctcattccaatgcgcccgggtcgccggcctcgtcgccgccgtcatcctcatcgctggcgtcgccctcctcgtcggagctgggggcgaacgcgagcagaggggccgacccctcgaagccgtcgacgatatggtcggcagcatcccggacgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttgtcgagctccacggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgctcgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcccggagggagaggctgtccgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgcctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcgagaaccccttgggcggcgtcgagcttgttcttcaactccgcctcccagctcccgtgttgaaggcggagggagtcctgcgcctcgatcatcgcggtggtggcgacgagggcggcctctcgctcctcctccacctctcgggcgatctccgccagcgccgtcttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccacttgggcgctaaatccatctagcaccgcggtgtttgcggcggccaaggcctgcataatgggctcggcgctcaccggggcgacggaagaggaggagaagagccgccttggagaaaatgcgacgcggcttggccccccgaaggatgcgctgggctcggggatgtcccccgggcccgtttggtcctgggcgtcgcccggtgaggtaggcccaggcgatgtgcccgcggcctcgtcgcgagcctccccggaggctgtcgcctgagggttgcccgagggagtgggcccagttgacgcgccagcagcagctgttgcctcagcctggcgagcccgggcggcctcctccttagcggcttcctcagcccgggcggcctcctcccgagcagcttcctccgcttggcgaacccgggcggcctcccgggcggcctcttcagcttcccgaaggcgatctgcggcttcacgccggtcagcttctcgcctccgctcttctgcggccgccggatcttcggcctcggactggccggacttggggtggcgggaggagtgcgacgggacatcgctgaagcagaagaaaaaaccagaagacaaacaagatgggtaagagaaaacttgtttaatgggatagaagaaagacggtcgcaatgagaatggggcgaacctgcgaaggggtcggttgaatgaccactttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccaacataatggttagaatggagacgcggtcgggatcgatgcagagggggaggatctcctgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccgacggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcattactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgttatctcgctccctcgtttcccgtgcccccgcttccactaatcccattcgcccgcttacggcgcatgaagtggatatgcgttggtggcaatcgaaacggattgtatcgtgcgcgcgttaattacgctcgccgaccgaagcggcgttaccgtatctccgggcgagacaaatctgctcacccagattcgcgcgctgctcaagtggtgtggcagtcttgaatagaccgcccattatgaacaaccaaagttaccaatatcaatgtgcatgaattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcatgctgcatgcaacgcagtacagcgcgttcctttatccggtctgtgaccagtcacagaccggtcagatcacgggttaggtggcgactggcggtctgacgcacgccttgccccatcccgtcaagacaaaagtctgtaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggcggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggggcatgtggtatccccttgagatataaaaggaggaccttgcccatttagagaagggactttttcccttttggaaggctgaggggaaagggagttaatcctttgtaacttgtccatacacaaatccacaaaaacacaggagtagggtattacgctgagcagcggcccgaacctgtatagatcgccgccgtgtctcgcgttttctccgagcaagcgatctttccacatatagaaagagcttgagatctcaccctaagcccccggccgaaccggcaaaggggggcctgcgcggtctcccggtgaggagccacgagctccgtcacacctgtaaccggaaattaaatggaatcattagtaattgcaaaaaaattaacaaatgaatacgaagactcgttagtaattccctgacgctgtgtcacctgtgactgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacatgttagtcttgttctatttatctgagctaaattacgatatttgtatgattttcattcgatgaaacagtatgttagtttaaacgatagttactttttacgagcagtgaaataaaaatgaaagagcgaactgagtaatcaagaataatataaaatcataaagattgaaaacaatccttggagcaatgggcagagttggcgatacttttttttatagtttgcaatcaatattatgacaatttcattttgtcctcgacaagcatttgattcagaaattgatcatgtacaaattccctgctaggtacagttccatggtaatagaagctctttgtgaaattggggatccaaatggttcggatgttgatgcaatttgccactacatagaggttgtgcatctgcacaaattttcttatttggtatcactatttgccagtagttatttttatttcttctgaattcattcaagttttgttcgttcttgatttcgtaataaattatgattcagatatgtgtacaactaacatgatcagaatattaacaaaatgcgattgcttgattctttttctcttctgaatcattgcctgattgactgtatggtataaagtccctcagttattggtatatatgtgtgccattgtgtttatttcagcttcctatactttaggaagcttctaaaagtgcctttgctactaccggagctttcactttggattttataataatttcctgcacaactaccatttcccatttcccgctatcttcctcgcataatcaatagctgggtacacatttagggcctctgcatgacgagttgatgactatgcataacattggttggaggatagggaagcctcactgagctgcctcactgagctatcttctcagcatttgttttgatttgagggaaatttgcgatttaaagattttgcaattataactctgcatcaagcccataattcagattcttcattttacttctcttttgtaaaattggcattcaataactcaatttacaattattcattgtggaactgtgcaagtggtagctatctaactacttatgttgacatttatctaactacattatacttttgacatgattcgatcataaaaataatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctggtaagatcctcgaattgagttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattgacttcctcccttaacggcacattgtcctctgcatgtacttcttcccttaacggcacattctcctctacatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattagggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcgcacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttgggtaacttagggtttatagaggggtttaccttctcttccgatcccaaactcaatgccgcacaaatcaccttcgattagagaggtttttgggggagattgggcgaggagaactcggtggcgaccgaaccctaggcgggcggctggggaaaaaacggaggaagaactggctggggcggcctcggccgggctctaagtagccaaggtcagcgccaacttacttggcgctgaggttgggcacctccgcgccgaagcggttggcgctgagttagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaaataagtttttgaaaagggtcaatttgtcaaaaaaacggtggtagcgagccctgtgcacttccgataagaccgtgtttccatggtaaaatgcgcatccgatgaaacagaaatgacagaaattaaatcctcattatgcaaatgtatcaagatgtttccatggtacggggcactctgaaattactatcttccatcttcagttataatcctgttaatttgtgtttgttgtaataatattgcaggatgcattcggtatattgttaccaaatgccaataccatggcaaaggtttgcagatgtgtgcttttctagctttcggctaaccatagaactgattgttttgtacgtacatacgtgccgtgtgttagggcacaacagaaatttgtttggctttggacgcgcattgccgccaaaccctgtgcaagttcaaaccgcggagttttttccgatcgggatgtaccaccaaccaaatttcgttctccgcgattcaggattattacgttatgcgttgcaaatcttgaggtttgtttagagcttggaagtatcgcattatatatgaaatgtataaaatcttgaaatgtatcgcattatatatgaaatcttgatatatacatttcctgtaggaattatatatgaaatgtccgtgttccaaatgtgaccgtgtattaaaacccatatgcaggcagattattctgtagcctgacaaccaagacagacaacactaaaatggtaaaacggtaagtggatggctccaagtaaagaggggaaagattagtaattatttttgacattatatcataacccttttacgactactatctacaagacagagagtacatgctgtacatcatatatgtaatgatatgcctataaacgtgttgcccttgtaacacatgacatgctatactaaacaaatgaaagcaaaccgcataagagcaagtttaatagtaccgccatcaactagttataaacatgtagtacatgtcatccgaggggtcagtatcgtttgtgatgaaaggcgaacccaggttcgccgttgttgcatccagaccatccgtacttcaatcaacggcggcatggtttagcacctcaaagacgattaacagctaattaaataatataacaatttttgtatattagtccaattaattaacaagatcggttctgtctattaattttcttataataaaatactcttgtacaacaaatacagtttagttttttcaaaataaatgtttaatttttggaaggattttagcagtagagttgctagatgcttaaggacgtgggataattattttactattgtataaataaaggattttcttatcctgagattgtttgcttcttgattttatcttattttttaagttggttccaaaaggcgagggaggtattagttgtatttgatttaccgttggagatcgtttccttgattttttttaagagagaacaaactcttaagctgctaattagtcactaagagggtgctaactgctaaactatggaaccgttgattgacatatggatggcctggatggaaccaatggtaaactttgcctttggtcccagatgcagaggatacgaacccgtcatccgagagatgagagatagaaataaagatacaatagctgactattaatctacctacacacttctttaggtagttaatttttttagaacattgctacatgtactaaatttgcactaacaatcatctcagtcgtttaatttacatagatgaaaattataaaaaatctagatgcactgatagtatgacgtgtaagtgttagtaagaattttatgaagaaaagttagtacgtatagacttttcctttatttatttattttttattctaacttgctattctctgtcctatcctgtgtgttctattgatggggccatatagcaatattattagagaaaaaaaggacacggattagcatcgattcctgtaatttgcatatagcttcttgtgctgcagctcagcgctcgctggagcgcccgttgccctctccctccagctttctctctcctccacctatgaatctggatgacgtggcactactaccgccaactgagtgtggcttactctctccatctacttttaatagtcatatttcatcttggcacaatgaccaaggataagtaattaattctacttatcatccatttaaatatgatactaattattcctcgtaaacaagcgattcattaatatttacatttctctatgcccatgtagccaatcttgtgtagaagaatggagagcaacgcagtaaatccgataaagttattaagaggataggtggttgaattgaaatatgtctatcaaaagtaaaatttccagatttagaaatatatctattaaaagtggatggagggagtattaaacttgctctaaatccatgaccttgattactgaactctcactacttaaaaaaaaagatttttctatacgagaacccctttaggttgcagacggactgtaagtgacggcgtcggtaaaaaatgacctttattttcgcatgtagctccttaagacacccgtatagaaaaatcgattttccatgcgggcctcttaagagatccacatgcaaaaattgtatatatcaaggttttaaccaacaagtaaagtctatatattccttatatatttgaaaggaattgaaatgatgaaaagtgaaatcagagaagtattgttctatacacactcattattattatcgctataaattcaaatggattaaatctatatacggattaaattagcacgatgagaaggtactgtcgcgtgtgaatatatacctttatgtaccaaatagggaaccaaacatgcctcaaagttctttttacttgtcgacaccaaattacggttcgatcgaaaaaatcagctgttacccaccgtgcattaattagatattgtacatagcttctttttttttgaaaaataatgggtgaaaatatggtctctatatttatactaccttcatcccaaaataaatcgtgtagttcaaatctaaaatatactgctacacttatttttgaacaaaaaaggtattaagggtttatatttaattttatgggatatcctatcgatgtttgtgcggtagctttgtcggattgccacatcccctcgtgacatggaagaccgaaagtgatcattgtgtgtttggacggctggcttgcaagccaagctacaaaagttagcgacaaatattaattacttgcccgtttgaaaataaatggcatcgttgttttccacagtcattattcatttttttactagtaattaaactaaaaatatatgtgtttcacaattgaaaatgtttttatatattgttaattttgtagttgttgataatatatttgaaaaaaaataatgatcaaacaagtccgtgtagaaatataatactgtcttatatatatattattgagtgagggagtacattaatttaagtcctctcatttaggagtagtagcttttgtgattatattttccgggcgttggatgatgcattcttgtcaacttgtcatggtctctatttagtgtgaggacgtgatcgataatacgaattgaatcagcagtgataactgctatgataattaattttgttaggtcatggtttatcttttgacatcccctattgatttaagagtgttctaattgtgcacactagcgaacagacaagtatgatatactaggtgaaaccccgcgcattgctgcggaaatttagtatgataacaataaaaaaacgtgtaagatagctagataacatcagattaaataaattaatgtggtttatgataatttaaatttaaatagtatgtagaatgacgattcaaacggaaaaagtaaggtggtatgactttatggaagaagaaaagtagggagatagtttggaccgttgattaatcatctaaaggctaaaaacaattgatgtgatatgatttaattagaggaacaaaggagaaagataatttgtaccatagtttaatcatttaagcattagctaagtgaagatgaactatataagtatataagatatcataaaacataataaagatatgcattgaaacattgtgtgaattatgttggatgataatttaacatgcttgtatttgaaaagctcttaaattataaaaactataaagttatagcatgtttgcacgatgtttaaatgtgatgattgttagtgggtgatgatgtggcatcttgttaattagtggatgatgatatgacatcttgctagtggatgatgatgtggcatctttgcatattaagcttaaggagttagtgggggataactttatagtaagataggattacatgactatctgtgttttcgtagacatcttaattgtaataagcgaattgttgagttagcacaaattattagactcgacattatattttaactatttgtttcacttaaaaagctaataagggacatccttatatgcatctgttcatataaaactggaacatattagtcttttcctcctctcatgcgcagacataaattcgaaaaccgacacctataacaacttataagtgtcggtttgttttaaaaatggcacctacaacataccagctttttaaataataaaatgatacttttatatgggataaaagtgtcatttttttattaaaaaactgcacttttagcctggagccgagctgtcaaatctgctctttttttactcctctttctcatctcctcggccttatctccttgcgcacgcgggctctctctctcgtcccttctacctctctaatgattcgctgtctcccctcctcttcgagctagcaagcgatggaaaacggcccgcctctccacaatgccttctcatcccgttgccattgggcatggcctcggccacatcgaaaggaggctgtcgcaaccccttcagcctggtggccaagtcagcaaatccagcgtcgtggtggtaggggcagtcggatccagcagtcctcaatctatcacatgatggctgcggtgatgcatggtaaggagtcaaggccgccatgagcttgaggacaccatgagctcagaattgccaaattcggctgctacgagctcgagggtaaccagatccggccttgaaggtgatgggcaggtgggcagacaacaacggtgagcagcggcggcatcagccttctctccttttgcgtcctcctctatgtattttttttagtgagttcttgatgtcaatcgatcttggaagcaatatattattcttggatgttgattacgtgagatgtgattattgtgagtttgttgttattggttgtgtattgatttcacgagtgacatggttggatgcgcttggtgcatcggttcaaatcaaggcgatacatcgagccagatttttttattcggggaacctcatatgtgccgattcctacaccgcacctttgattcttcctcatcattgctgcctacgtggtgccgttggggaatcaatacttatgtggagtttacaaccaattgccattataatttctgatgtagtgtttgaaaattcgggacaacatcgtatttcaattaaaaactaatgtcaaataaatttggctgagggagtatgttttaattttaaccgtagttactcagcgtaccaatcggcggctatacaactgatatatatgtcatgtcatgaatacatgagtaaagagtaacatggtgacagaaagaccaaaagtaaaataaagttggtgctaaactaacaatataccaatgcgttttagggctgcttcccccgtggggccaaggaaagattctcggatgggtcggtttttcgtattaaatttccaatcatttttttattttaaaattccaatcatttggcccaatacacctgaaaaattaaaaaaaaatacaggattcagaatcatgtttgagagtgcacgttccatcgtggatgcagaatgtctctataaaaggaccttgtgttgattagtagaatttaaaactactgctgctcccacctcccaaaataaatttatttttcacctatctcatatataccaaaatgactagaatacctctcttttaacaaatcctaatccaattagtattatttactttatctactcccaatataattagtttctgcttcacaaacatcgatgcaatagttacttaaaaataaacttattttgaaacaaatgaaaggatcataaaataaacttattatgagacgaagggagtacctcttacgcactgtagcttgtttagatccaccactaaaaataaaatatttagaagcccatagatcacaaataataggtcagctctccacagcaaacagaaaatctcctgcagaatcgacccaaaaaatcaggccctcttaaattgattatgacccgtgagggtatcatatcatctatttattactcccatagttcctagtaattgtcagcgtcggtaggcattgttacaatttggaaataagagatgattctccctcatgctccctccccattaattttgtattataagttgctttgattaaattcatagaaaacatatgtttttaacacaaaacaaatatattattagattatatttaatgttagatttaatgaaactaatttggtgttttaaatgttgctaaatttgtctataaacttaatcaaactttcaaagtgtataatatgaaacggatggagtatctattatcagaaatggtttgaaatggttgttttaatagtaatttttttattaaatggaaaacacacatgtgctttccctcttaataacaaaaaatggtttactttaaattgcgatgaacaaagttatacggttgtttttacgtatttttttcacgagagcaatatatttgatattgtggcatgcaattaattaaatacttacaaatttattactaacaatagagtgatcaaagtttcaacagaaaattatatcataaaaagaaatgaagttatgaccatttggtcgtttttaaaaatattatttcaaccctgccagaaaaacccccaaaattagtgccaaaccctcttgaactgaggccgaggttagtactataataagaactattcttaaaataaatttttaaaaggttaaaatatcataatttcagtaattgggacgcggcaccaagtcaccgcaattgccatcaatcggcatccataacactgtagctgtcgaatctcacggcttacgaagacaggcatgtacggaaacattctccctccgtcccaaaataaatgcagttttgcattattcacgttcaacgtttcaccgttcgtcttatttgaaaatttgttataattagtattttcattgctattagatgataaaacatgaacagtactttatgtatgactaaatattttcaaatttttcacattttttttaaataagacgaatggtcaaacgttgggcacggatatccacgtatgcacttgttttgtaacggaggtactatagtttgttgctgcggtggcacgccagtaggagtacgccactcatcacatggctacctacgtacgaccacgtaggggtacttcgtacgctaccgacacagtgggttggtatagtccattcactgtagtattgaatgaatgacaacgatttggaaaaacattgttacttaataatggtagttctatgattctgatgtcctcgtgatccaaaatattttagaacggggtattctaagcttcccaaatccgtgaatatatgattacgttggttaatcatttgttctcattttaaataaaataaattttagaattttaaaaccactataatttaacttacaaactttataaatctatcatggatatgagatatgaagccgtgtcaaatataacctgagtattgaatgttgaatcttatccaaattacgttcagtaaaattccgccaatatcatggcgcacatgttctttccttttgaatacgccttaagcgatggaagataacaacaaacctatgacctaagaaaagttatagtaaaaagtaaaaacacatccacacacatgtaagaggatatatccgtaaaaacaagttaattgttgaaaactcgtaaaaatcatacctaaaagttttataaattcatgaaaaaaagatactaaagatagatgtcgatataaaatatattcttaccaagtctcaagttcaaaatcaactttatttaggagtaaaaaaaagacaaatttcaaatgaatagtaacacatgacactatctacccgaaatttgtttttttccttaaacaaagttgagtttagatttgaaatttgatgataatgtatttcatatctacatatatctgtagtattttttatgaggttaataatttttttagtatgattttcacgagtttctaatatttagctcattttcgccggatatgtcctccacgtgtaattgcccgaacaagctttttcttgttcctattaaaaacacacacgacacatggtacaccactttatacgcactcactagtgtgcccctggcgcatatatgtgcaatcgcacaatacttctttttactacacaaaatacgccaaacacaataattaatgtgcatacactcgtaaatgtatctataccataagcttaaaaaagacagagatcaatacgacaaagttttgacctcgatatatcctattgaaaacacacctacgtatttggctaatgctttctagtaacagtcttgttgttgtaacctacagtatgtatcaatataattaaacttctccctatcttaataaatatatgtaggccagcttttcttctgtcggcatggtaaaaaaacacgcctacttatcaataatattcgtgtatattagaatctgaaccatagagaatggtgtcatgtaagcatgtaattaaccacatcttcaccataacatacacccaatactttaactatagatgaatcatacaagtcaaggcatatatcccttccgtctaaaaataagtgcaaccatgagtttctatggacaattttaatcgttcgtcttatttaaaatatttttcaaaaactaaaaaacataagtcatgcatacgtactattcatgttttataatctaataatagtataaatactaattttaaaaaaatttaaataagacggacgatcaaaactggacacagaaatttatggctaatcttattttgggatggagagagtatattagatagtaatagctcgtagggttctgattttctcagatttttgaattaattattttcttctcggaatggctgccacgttatcctttgtgcgacttctcgattgggtggatagcattggtagcacgcggtaccacggtgattatgttgttccccaggcgtggttatgctccctcgtgtcccggttgcattaaccggtggtgtccggtaagggctcgcaagcatgctacacgcatcttcatgtatttttgccaaaagaaagaatccttggtaccttgaaaaatactccctccatctattttttatggtcatatttataaatctgaaaaatttatttttgataggcatatttcaatccaacaacttatcatcttaatggctttcttggatttaatacgtgactctccatttttccacacaagattggctacatgggcatagataaatgtaaatattaatgaatcgtttgtttacgaggaatgactagtaatatatttaaatagatgataagtagaatcacttatccttagtctgtatgtcaagatgaaatatgactatcaaaagtagatgaagggactagtaaagtaaccctttcaccacttttactccgttataaattttgtgaaaaactctatatacatttgagaaatataacacgaaaaagagaagattatatttttagagatggcgctataatactaagaagcacaatgtttttttttatgcaaaacttcctctcaaacttatcttgcctggtgtatctgtatactccttcaaaggtaagtgggtctcacttgatattgagtgaaccgtggcctcaaacgcacttcccatgtcaccagtggcggacgtagcgttaaaatataaatggggcggaaaacgaagatgttcactcgataagagtaatcgaacacgacacatatcgtattaacagttcgttcgtataagtagataagggggtctcgagagtatggggcgacacgagccgtagctgagtcggtcgacccaccccgcctaatgggtaaatccacccctgcatgtcacagatgccgttgtgagtttgcaactatatatttcctctgtcttaaattaaactaaaatctactacggtatgtaatatattctagtacaataaatctgaagagtaaaccgatttgtttaaattcattgtactgggataaagggcctgttcactttactgccattttcaaccttaccaaattttagtaaagttgccaaaaaagtggctacatttagtttgctaccaaattttggtaactatataagaaatcatgtcttgccaaaattttggcaactataccaaaatttggcaatgccaaaatttgataaggtttttttttggcatcaaagtgaacaggcccaaaatctattcagatttatttactatgatgcatcacttgtacaaaattcgtttattttggtacttatagagtacgtggcaatactccaattttttcctgacgcacacgtattccagcaaggctaacagaatatccactcgaccttgtcgaacacccagtcgatcaactcggcgaggccgccgccgacgctcatgtccgtctcgccgtcgaacggatacggcggctccggcgccgtcgcgtccagcagccgctcgatggccacctccggcccagacctctccagaggcctcatgggcctcccgtaccgggccggatccggacagcaatcctgcacaagaaagcccatttctcaggcctccttttatgggcctagatttagcccatactaactggcaaaatgggcccaaacctgatcggcgtgcattttcctgacgaaggccttgaaggcccggaagttggtcgccgtcaggagctcgtccgacagccggaggtacgtcacggcggcgacgcggcgcggcggcgcgccgccgccgccggcggggccgacgccgttgggccgcgcgttcagcagcatctggttgtacccgcgccggtcgtgcctgctcagcgcgttctcgcacgccgcctcgacgccctccctccacgccgcgctcagcgcctgccgcaccagccgctccggtgagctcatcgcctccggcggctgctccgagtcccgcatctcggcgcaggtgaagttgagcacggcgccgtcgtgccgcgccagcatgcgcgcgacggggcggtacccgtcgcggccgggcacgttgtagtaccccgcggcgagctccgcggcgtggctcgggtgccggtaccaccagtggatcccggacaccttcgcggcgagcttgaggctgcagcccaggaacgccatgttcgcctcgtcgaggaccctgtcgccgtgctcgagcagcttgctggagtaccacgtcaggaagaacctcccggcctcggtcaggtacgtgccgccgtccgccgcgaagaaccgcgtgtcctccggcgtgtagttgtactctccggcggcgtcgcccggcagctcccactccgggtgcccggcctctgtcgccgccgctctgaagtcctcctccaggtatttgtcataacactgtaacatttacaaactgaagtgactgacaccgaattgtaaactaatttaaacgtttttaacatcaagaatttaaaatgttaattgcagaaggaaattgatcctacctggaactgtccgatgccggggaattcccaaccttggctctctgggtaggatgggtatctaagctcacctgcagggccgaggccaacctctatgtccacgatcaggccagagtccaagaagtcacccatgttctctctgaagctcttcatgaaatcggcatacaactagtgtcacagataaacaatcgatcaagtcgattagattatcctaaatttgatcatatggttgtgatatgtaattttgcaatctcaatgtaacaatttatgaaatcagtgtacctggatggcagtcctgccgtggaacagaggccggacgtccacgccgatggtgaggtactcatggttcctcgcgccgccggggctcgtgtagtacacgtcggggtcgtcgtcgccgacgtcgcggacccagcgcggcagcgggatggtgacggcgtcgccgacgttgccgccgcaggcgtggaacgacatgatggcctgcaccttgagtccttcctcctgcgccacgcggaacagctccctgtacgcgcgccactcgtaccgcgccggcccggcgccctcgacgatgccccaccacacgtccgccatgacgccgtccacgccggcctcccgccgcagccgccgcagccgcgcccgaagccccgccgcgtcctccagctcgttctccgcggtgaccacgcccagctgcgcgccacgccacggcgcggcgccgctcgacacgatcagttcgaacgaaagcttgaggagattgcgtgagctcggagcttaccgggagcatgacgtagacggggacgtagttggcgagcatcttctcctcctcctcctcctcctcggtgagcaatggcggaggctgcggtgaacgagcaatgcagcaggaggcaggaactcagtttgaatcaagaaagttcgcgcgctcggcgtgtgcctaggtacctcgggtagaggagaagcctgttcgctctcagcggcaatagcacggacccggagagaagccgccgtcttctgggagtcggcgacgagccgccgccgacgccgccgcccggttgccggcggtggaagaagaggagcaggagacgccgctctgctccggcatgtccatcgttgctgcagcctgaccggctgcgacgatggcgacgaggttgtaatcatgatgggcagcagcgaagctgtccgggctatgtttgtccaaatttgaaaatttttgctagatgttcttggctttgtccggtgaattctcggcatatatcgttggcgacttggcgtgccatgccatctgcgtgacacaaaaatctgtcccctttttggcgatgtgtgttgggaagaattgagcaggtgttcatgaaggtgtggtttgcgtgagctctcaagcgtgttttttttttttctcccgttaagtaagaggctcataccatttcagtttctgcttttctagtggtgaatattgagggttcagaagaagctactagctgttgttgtctgtgcttttggttttggctttgtgcagtgatagctacagtaagggtgtgcgttcaacatgcgagcaaatggcagaggatggctgcttccccatttttcaattccacctgaagaaaataaaatcgatgttttcccaaattagaggatgtctttattatttcccaaatattgaagatgattatcgtaaaagaaaaactattagtatgacaaaatataaattaagataaaaatacttaaaataaaacaatacttatatcttttttaaactaattggccgaacctctttgtttttcccgaaacacatatactcacccttataaatccacacatacgcacaccttatccctataaacaacttctttaataacactaaaaaacacaaaacactctcttctgttttcagaaaaaaaactttcttctgttcaagaataaatacttcaccttttatccgagcaaaaacactctcctgggctctacgtctctattactacctccatttcatgatgtaacaatttttagctacttgttatattttgtgacggaggtatggtaagctaagggcttgtttggcacagcgtggagctggagctcagccaaacaattttagttccatctaaaatgagagaagagttagatgtaacgctatcacaaaataaattagatatgtgaagctgggtttaaactttctttccaactccatttcagaaccaactcatgaaacaaaatttaagttgccgtagcactatcactccatcatccaaagcctatgtccattcagcccattacggtctggcccaaagtccgtatccgttcacctcgtgctcctattccgcttgtccttatctcggcgtccgagcccaccaccgcaccaccgccccgaatccgcccccaaatctcctcgcgacctcgaaaccctagcctcctccggccaccgtcgccggccacggtgagcggccccacccccccgcagccatggcctccccggagggctccacgtgggtcttcgactgccctctgatggacgacctcgccgccgccgccggcttcgacgccgcccccgccggaggcttctactggacgacgcccgctcctccgcaggcggcgctacagccgccgccgccgcagcagcagcccgtcgcccctgccaccgcggctccgaacgcctggtaattgcggggtttacggcctccgatcgcgctccagccagccctggctgggcccggtgccgtggtctggggtgctacatttttttttcgtcctgatttgtcgcggcagcgtgttagtgcgtaagttgagactgggtatatcgtgatcgttgctattgattgttcgattggaggtcgatagaagcgtatcatatcagactatcagtgggattcggattaggggattagccattgagtgtgtctgaacatgtagaactagttacgtactccctccgttttctaaaatatgacaccactgacttttcaaaatacacttgaacattcatcttattcaaaaaatttatgtaattattatttgttttattgtgacttgatttatcgtcaaatattctttaagcatgacttaaattttttatatttgcacaaaaattttgaagacgacgaatagtcaaacgtttatcaaaaagtcaacgacgtcatacattaacaaacggaggtagtataacttagtaggagccgtcagcctgttttactgaacagagggctcaattcctggttatattgaattgtcagcttcattttcaaatctatttatttgtgtgcatacgtaatgtatttaaacctaatttagggcctcttcatgatttataattctcattttaattgtgatgcaaatgctgcatagcatagcatatatagtttgctaagcatgcattgtgtcatgtttatctggtgtcatgtcatgggatagttgaactgaagaaaacatacaccataattgatgatgtttatgatgccactattgtacaagattcagtttgccgtgtaatattacaatataagaactgataacaagtaaaccaaatggtgtcaaattggcgtggtggtgggagggtggatggttgtgatttgctgtaggtccaactgtctgagataccagattttaaaattttttgtatctatatgcaagtaaattgcattgacatgatattttgagccaggtattgagatttgtcctgagctttccagtggatttttcaatgaatgatctatgaaggatcagaaacggggtgagagaagtggttaatctgtatcacttgggttccagcacgaagcttactgtggaatggaaatttattgaagaacgtgttcatgttaggatattgtttactgcaactctttgatttaagagtattcttttatttatgataccttgtagtcttgtggtgctagtacattttctttatgcaccaggaagtcatctcatgtgtttttaaatctgtcctggtttttgacttgtgcttccaccttctggtgccataggttgtggtgttatgaaccacacagtgcatcttaactgatgtattgttctgttgtgttaaatttgcttgattcttttgttgtcattgtatagttttttatgtacttattgctgtatattatcgtgacatatggcatactgaagtacaagtttatttttttcaccagtgctgaaatcaatggctctgtggactgtgaacatggcaaagaacagccaacaaataaacggtttgttcacatccattatccaatctacatttcctttcctgttttcttttgatcatttctaacttggcaccacaaaacattagtccgagatcagaaagtggcactcgaccaagctccaaagcatgcagggaaaaagtaagaagggacaagttgaacgagaggtaattttcgcatcatttttaattcaacccatttttctggttgcagcattgttttttctaactctaaactaattcatggacttaatttctgttaggttcttggaactgggtgctgtcctggaaccagggaagacacccaaaatggacaaatcgtctatattgaacgatgctattcgtgtaatggctgagctgcgtagtgaggcacagaagttgaaggaatcaaatgagagtctccaagagaaaatcaaagagttgaaggtatgtctttttattttctcttcataattatttgccatgcatctatttttatgggcacccccgcagcagctgtgtacatattgttgtctaaaatgtaatgacaatattgatagttttgttggctcagcatggtgttaaccttaggttatatggtttgtatggactataaagtgtaaatccaaaggacaaactaagcatcatgtccttcaattttgcaggctgagaaaaacgagctgcgtgatgagaagcaaaagctgaaggcagagaaagagagcctggagcagcagataaagttcctgaatgctcgaccaagcttcgtaccacaccctccggttatcccagccagtgcattcactgctcctcaagggcaagctgccgggcagaagctgatgatgcctgtgattggctacccaggatttccgatgtggcagttcatgccgccttctgatgttgataccacagatgacaccaagtcatgccctcctgttgcataagtcaaagcaaagatcaatttgcctcgccttgtaggaaagaggtgaaactgccttccattcaagcccagtttggtcgtcagtgtttaaactacctagctaatcccaggattaaaccgaagcttcgctgtatcgaagtatcaaccggtgacatgtgaactgacgaaagatgacaccgttgtatattacatattagtaaataaattccatctgtccaattaaatgagaattagatgccatataattatatcccaccgtgttttgaccattgagaagcataattgggttattggtggccatgtccgaagaaaaggaaaacaatatataattgggttattggtggccatgtccgaagaaaaggaaaacaatatgtgcgctgtttggtgcaacgtgttcacctcacagcaagacgtgctctacatgctccctggcatctatggtattagccgtcagggaataaaatattccattattttagtaccattttgcgatttttctccttttctttcatcggcatgcaatcctgatcatgttcagggagtttgctacttgtaatttgcctaacatgatctcctcgcggttcaaattaaattatctttgagatgcttgtgtttaattccaggtttgccttgtactcaacaaatcgaatagcacatgtaaacacaaacattatgttgatcaacgcagaaaattttactgtttagtaatatagcagcaaataccttcaaaatgaaacagcaagaatcttctctttaataaatggaactgcaaaatacagaagggcttatgtatacacaacaattaattaatacacagcaaccctcaaaacgagtaacaaaacgcctctggtgcaagagaagtttcaccacacctcgataaatatacgtagaaacccgtgtatttacgtacgccacatgtaaatagtaattaaaatcaataagaaatataaaacgatattaatttctttttatatcgtttaggcggccatggccaccagagcagccaaggccagcccggccacggccaccgccggctgcttccgatgccgcggcgtggacgccgcgctgctgctcgggccggccgccggcgacgacgccgagttcgacctgtgctgctgctcgtcggcgggaggcgaggggagcggcgccggggaagggccggcgtccgcggcggcggcggcggcggccgaggcggagtaagggacggtggtgaccttgacgtgcatggtgccgttgaggcagtggcgcgggatgctgcagatgaagtagcgcgtgccggcggcggcgagctcgaaggtggtgttgccgccggagtggacggagacggggttggtcgagacgcagccgtcgtagtccgtctcagccggcacctccaccacgttgtggtacggctcgtacttgaacgctgcacgccattgttgatctcaatgatgagctcgtttgatcaatcaaccagtaattaattatcgatggacaatggcatttgagatagattaagaataagaaagctattagcatatgattaattgtgttttaattatttacaataaataaataaatttagttgatattccaaaacgacttatatagaaattatttgcaagaaacatatcacgtactagtagtagtttgaaaaacgtgctaatagaaatcgagagaaaatgtacatcttaatcagaacggggtctacgtgcattgcaatggaaattaattacttatggtgtcgccgacgatgaacgtctttccggcggcccacttgtcgtagtcgacgtaggtgtcccagccgtaggagccgccgaccgtgtagtccttggccaccgccgtcgaggccaccgccgcgaccgccatgacggcggcgagcaatgctacggagctagccttcatgcttcccttgtggtagatcgatcgatcgatcggctctctctgatgctgcggttgtcgtcgcctgatcgatcgatatgttgtcaccagcaagcaatggctgtttatataaggagcaagaacaaggcagaactagatactgctctcttctctttttttttttttctgttaagtaattggggccagtgtttatggcatgcatgtatagaggagttgttgtgtagatgatctggagttgcttcccgttcattctacaaaattggaatcaaaatgatttaattgtgcattgcacgttgtacctcttgagttgacttgtatattatatatagttccttctttttaatgaaattgcttctactctgcagcatgactaagtaataaatttacctacctgatgtcctcatttgcattcatggccattcaacatttccagatcaaattccacctattgtctttataaacaaaaatagaacatgtttaatcaattttgtttattttccaatattattttttctgagtatttttgttaatattatggtaattgatgccattatgtgtttctacccaacatatgtattctgattatgttaatgcgagtattctgtgctggtggtggtggtagggtcaagtaatctaaatagtacaagtagtactccctctaatagtactcccggtttttaacataggttactgttgatttttgtcgtacttctaccatttgtattattaaaaatgttaggtaattattattcattttattgtgatctattttataaaaaatactttaggcatgacttttttttcatatttgtataattgctgaaaataagacgaattatcaaatgtatattcggcaacaatacagtttaaaaaaacataggcatgaccaaaatttacagcttttgggttgccaaggactcaagtcaacacaatacaaaccaaaagcatgtctgtagtttgacttttcggaatcactattattatttcttctcgctgccgatttgatggaagcaatccatgcaagttttcattgattaggcaatggaataatcaactaatcaattttgcagaacgtgaagagatgttacttgccccttgcagttgcaggttttgcggacacactcgactcgattgtgcgttacatcatcgactatcagctttcatggtcgcaaagagaacttcattttacacacatacaactcgtggatgtggatcagttcttgaaagaaaatgcagcactatggtgttgcctgccctatctttgctcacacaaataaatcatacttcctccatttcatattataagactttttaatattaccgacatttatatagttgttaatgaatttagagatatatatacgtatatatctagattcgttaacatttatatgaatatgcgtaatgctagaaaaatcttataatatgatgaaacggagggagtagtaccgttgtatctttcgtaattgctccgggttgcaaacataatcgctagttttctttttgtttttcttactgggatatctcacggaatttcgatccccttgcgtcgctggtgaggtcgatggatattggttgcgaatctgcgatggagcggtgacattttggaccggcatgcgccgtttgatagtatgatggcctgtaagactgtttgggctgtttgcggcgcctagatgggcttttttgttttgcatgcggccaatcagagctgcgttcgaaacagaggatgtggctgagtttttcctggcaggaaaaatgagatgagtagcacataattaagtaactactccatctatcctaaaataactttaactttcaaataatttcatctttcaaacaatgattgtattgaaatttgagaaattaggaacacatgcattaggcctagataaaatgagagacaattgcattaggatttgataaagttgagggcattctaatctttttttctttatattggtatgtgtgaatgggtgaaaaataaagttattttaggatggcgatagaattagctattatacacttgaaattggatttatttgatttttaaaaggaaactagcaaaatacccatcgttgccacataatttaaaagatcacatcagagtattacagagaggaaatctattttgagtttcagagcttagtttcaggggatgctataaaaggaatcccgttcggatgggatggcaccggttaggtatcagatgatgcttaccaagtatcatacgattcttactaggtatcaggtgatacttgcattgcgaggtatcaggtgatacctttaagtatcatcttatatctaggtgttggtacctgttgataccacatgatactcgttgataccagagtggtacctacaagatattaggagccgagcattgaggggaggagtgactaggagacgaagaggacgttggtgacggcgtaaagcttggccgtgccaagttcctagacgcgggcgccgctgccacccttggtgtgcacctcctagatgtggcgtcgctaccatctccgtgaagaaatctattgcccgaggagctccactaccatctcccgcaaaaagaaatccggcatctgaggagctcattcgcacctgactcttggaccatcgccgctcggctattggacatggcgccactaccatcgccgcgaagaaatcatttgctgctgccataggagaggaagcaacactgcatacacaaagaaacctgtcgttggcgatgtggtaggaaggcggcactgtgtcgttggagggaaggagtggttgggaggtgagaaggacactagagatcttcgacttcctggaggagtgggaccacctcaactgggcgacctcattgtcttcgtgaggagcgggtccgccttcatcccctccatgctcaccatggaattagggcaacccgtgaggaggatggtgaacaggatcccgtcccccagcatttatgtagttttaaattaattagggattgtttgttcttatgttaccagtctcgtaaaaaaataatccagttattagcggcgtgcaaggatgatcatgattgagagctccagggtctagtcgtgacttctactcttctattgtatgtttgatttggagtgaaaatagacaatataagatgatagtagattcaccgctcactaccaccacaactaatccctttgagaataaaaggttatctttaataaatatatcgtttagtagttttgcgaagtgtgcttgcttaagatgatagagtagctcaccccaacttgtctttagaatgtgtgttactagagggagctttttccacgtttatcatgagcacacttctctaaacactaaacggtatgttttccgaaaacattctatatcgaaggtctttcaaacatcagataaattaaaatttcaagttctcaattgatcttatcctgatcacttgcaccgttttattatgtgtagtcgataaagctcacgtcgattcttgatttgaacataaccttagactagtgagagcacacataataataaaaataaaagatgatgtaagcaagctatacaggctgtagaattagatttgtgctgaccgctgtgttatagaggagaaaagagaaacaaactactactactatctataaccaactagtaactatataaagtacagggtccaacgagctttacgagaaaagagaaatgataggctagatattagcagttgcctatactttatactccctccgtctaaaaaaaaagacaaaccctgatttccgtgcccaatatttgaccgtccgtcttatttaaaaaaattatgaaaaaaattaaaaagacaagtcacgcataaaatattaatcatgttttatcatctaacaacaataaagatatgaattataaaaaaatttcatataagacggacagtcaaagttggacacggaaacccagggtttgtcattttttgggacggagggagtagatggcaaaaagcccgaggcccgacggcccggcccacggtacggtattttggcccgatccaagcatggcacggcccgaccatggggaccgtgccagcccggcccgaccgccgggccgtgcctgggcctccccaccggcacgttgggccagcccggcacgaccgggccagcacggcatgacgggccggcatgccaggcctggcaaataaagaatagggagtagaaatagacatattatataccactgtccaaataatagtgatgaaaaatagacttattttagctatatatatgctagcccaaatatgagggagggaaaatagacttattgtcattatatatatatccagcccaaagaagagggaagaaaatagacttattttaaaaaggtatgatgggccccgcgttctttcgggccggcacggcacggcccgactgctggtgggccgtgcctaggccggaggtgcagcccatgggctggcctggcccgacacaaagtgccgatcaggccgtgccggcccgatggctggtgggccttggctagccgtgcctgggccggaccttatggccatctatattatactttgctctgatttgggctgtgagcctcactcattcgacggccgacgtaatgggtgaactaataaggaaaaagtacactcaaggtccctcaacttgtcatcgagatacaaaatcatcctcaaaccgcaaaaccagatatctcgcatcccttaactaatcaaaaccggtcacaaaaggtccctcggtggttttgaccccgattttagcctacgtggcggctgagtcagcttgggacccacatgggccccacatttctttcccctcctatccctccacgtcatcatctcttttctcggctagcgacaggcgacggggaggccggcgatctctacaaatctagcgtcagcgtcggcttggtggtggcggcgaggcgcggggaggccggcgtcggcgtcgccctgtcggaggaatcacggtgcggcaacgtcgagcagtcggcttggcggcggcgggcgagcggtggcggggcc

SEQ ID NO: 75490 - DNA, 6269 bp, Oryza sativa
tttttcttccccatacccttctcctttgtcttgctacgttttcttttcttcccaaactcattgcttatgtccttgaccatattgtggacctcatctgcggacaaatctttgggagcaggctgaagttctctcttaccattaaaaattttcttctttcttctaaatgtgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcaaggtagttattaatggtgcaaaacaatagaactcttagcttgaagttctcctgaccatatgcatcccaagtttccacaccttctttccaaagaatctccagatcgtcgatatcattgccgggttgccttggaccttggattaacaagcacaacataatatatttccgtttaaagcataaccatggtgggaggttatagttcgcaataagaactggccaagtgctgtgagtactactcatgtcaccgaaaggattcatgccatccgtacaaagacatatcctcatgtttctagggtcagcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagataggacaagcatccaagtccgcatattgcttgtggtacaatatgcagtcgttgggacaagcgtgaattctacggacctgctttgcttcgtatgtcgtctcgggcaatgtgttctcaacaggaagcatagccttcaaaattcctaaaagatctgtgaaactcttgtctgtccatccactacttaccttcagcttcattaggtccaaggtaactgacaacttagtgtgttttgctttgcatccagcgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatttcatgctcattttcatcttcctgattatgcgcaccacttctgtctgctgctgctccacttcctgattcttgctctccatacttcacccaacatgtatagccctccatgaattctcgttgtatcagatgaccgtgtacgtcctctccgctatcaaacatattctcgttcttgcaatctgcacatggacaacacatataatcactgtttcttcttatccgatcctcctccgcggcgttcataaattttattacgccatttcggtactccgtagaatgacgtttcaaatttttggcatacatccaacttcgatcaattgctacaaaataaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatgcccccaacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaaggccatcaaaaaatagtgtcatctgtgacaggcaataaacttatctcaattgggcctctagttggagcccatcacagatgaccctcatctgtgacgggcttcttttagggcccgattgagatatggaaccctcatctcaatcgggcatcaactataacccgtcacagataagtgtcatccgtgacgggctttagttttatgccgatatactatggctgtgcgaccatatctcaatcgagcgaaacttcggcccgattgagattacttccttgtgacggcccgcaaattccagtcttgttatgggccgtcacagatggaaggatctgtactagtgtcccatgcatgacggtgatggtggtgtagatgtgtgtgggcatcgacaacggtccacggcctcgttggtccgtgcgccggtgttggtgacgtcatcttcatatagactcttcccgccctgccatttagcctcgtcggtggaggtaaagatggtgctcgtagtggggactagcatggcattggctggggtgagaataagatgacggtgtcggtagtggtgctgagctcgagtatgttcatggtggccatgaagaggtcatcagcgaaagcacaaatgacatcggtggtcacaaagaagtcatcttgatattgctaggagtaacagagacaccagtggagattccaagcttgtggtcacttgcggttggggtagaatcacccatctagcctagatggcactggtcgaccattatcatggtacatgagtcagcctactgatcgctgcagcacgcacttagtattgagtggttttatgggatgttaggggcatagcctagcctgggaacgatgagatgcgttccaggagctgggtggccctcttgtatatgcgccgacaatcggggctgaactcaaatgatgttgagccgtctccgatcgtagtgacttgactcgggagtgcgccgatggcggccatgaagaagccgtcatgtgtatgggcgctgcggagtgatagaggcaccggtggggatgccgagttcgtgatcactagacggtgaggtgaggattcatgtgaggatgacactggtggcagcagcgagtcggaggacttcgccggcagcagacgaacggtggcggggcatacatatatataactgtttcgttcatcgaacggatgaggttggcgagcgtgacgccatcgtcgttggcgtgaggatgactccggtagtgacgatggacgtgaggtcatcattagccggcggatactccaagcacgttggtgataacagtcggcggatccaaacttgcacgttggcgacgaatgcgcgattggcaccggcaacggtaacaaggccgagcttgtcatcggcagagaaacgaccggcgccaggacgatgaccagggacaggttcgccattggtggcagccaggagtatagacgccgatggttgatgaccacaccgacggcagctccaagcttgagagacggtcggcaggggagaaacggtcggcgccggcaacgatgaccaggatcaggttcgccatcggtggcagccgcgaggataaacgatgatgattgatgatgacaccagcgccgactccaagcttgcgcccgttgtcggtgaaggcacggttggcgccggcgacgatgacggggtcaagctcatcatcagtgtcagccatgaagcgaacacaggaggtcgacgatgcgcgagcacatcaccggtggtgacggcaggagtgaagacgccttgaccgtgcgggccggtgtgatgaccgacggcagcgatgccatgatatctcccaacagaccaccgaacctcgtcatcaccgatgatccgccacccttgcgtgtatgctagctgaaatggagaagacaagagacaaagaaacaaatagcattacacatggcaggtagcagcatcaccgccatgtgctgccgatcacgacgttccacctcttcttctctgtatgtgtgtctgctctcggcggcgatatggcggcacaacttgtgctgcgtgtgtgtcagtctctcttctcgtatgcctctgcgtttctgtcttctcccctcctccttagcacgcctcctcgccggacgccgagatactgcggccaacgtcaccggccgccgagcacacgcgttcccgccggacgccgagatactccggccgaaatggcgtgtgcctctctctctctctctctctctctgtgccttttcgtgtgtgtgttctgtctctgtgtgttgtgtccctgtgtttctcctgtccccctgtaaaatgaaatggacaatcttttataggggtgataagtcggttcacaggctagctcatacatggattagtatctgctcaaccagccagccgcttccatctataagccaaatttccatttagcaaatatcatgattatgataattccattgtattgtgatatgattattgaagcttccattctatggtgatacggagagtagtatttccatgtgaaatctcaggtgcttgctgctattatctgtttcgtttccaatctgacgtgatatggatcaattttccttgtatacttatacgctcacgcactgctcatagaaagaaactttcatatagagctatcttgcccttttgatttccttggtttccatgcaagcatgtacgtggtttccatgcatatgatgtgagagattaacggccggcaaatcatgtgattaacttcctctaatgacagtgatacagtggcatatgcttccattcccatgaaaacattcacacctttttccttccatcagccaaccatgaaattggatcgatcaccctatatcaaaatgtcgcgagtacgtatatactagagcagccgacggcaagtgtctcacaatattcatacgtatacgccatgtacgccaggttgtgttattagtgataattaatcaccaatttcgttattatatcgccgttcccgaaattaatactttgacacacttcatttctttcatttataaaaaaaatgtacaaaatatcgtcgaacataaagacagaaaaatagcagttaaatctataaatgatagccgatcggccagttgccgatgacatatcatctatctttgagccaatgttgtatttgagtcgatcgcaaatataaataaacaagaacgaactaaatctattcgatcagctgtggttattaatgaaatataatcctaatatcgatatatacttaaatcaaatgattgggatagatcggtcgccatgccgagacaatataaatcacttagatcgaaatatatattaacaagaagattataagcattcatagcgtagtcgattagatagatctagcatgtatcggctaatacttcgatacaactctatattgagatactaagacaagcagaatataccaaacaagaagcttaatatacctaaatgcagtaatatcttaacataaagggcagatatagcatatcaattaagcacataaaatatgaagctaaatcaggtaagatcggttgaaaccccgacactaccctaatcggcaaccaaaagcaggctagagattatgattctaatcacgacttataagatcaaactcaactgatacagctataagtatgaaaagaacaataaaaatctagacaatcaagccgttggttgtttcataggatggtagataccctatataatctaagttaacattgatatttaacctaatcggctgccttccaacgatagatgttagccgatttgaaggttagataacgatattgtcagagattatatagagcatatgataactcgacgaattacataaacaagattagagtatcataaagatggaagcactaatcctgagaacgcaagccaccataacaagttttacctctggttgaagatcgaaaccaatgcagctcaacccgaaagcaaaaactcgtcgaaagtaaacgaaaagtaaagggtagcgatgcgccgagattgttattgaacgtgtgttatttgattacatgggttcgggtcatatttatacccaagatacaaaatatgtccttgtcggacatgactcttatctctaacaaactctaagataccataagtctttgcggcagacttttgcctaaacttatctctaaggaaattacataaaatatcctaattaatagatacaattgcctcctcaggactcaatccgtgcatggcaatccatatgaagcacattaactcaatccgacaacgtgaaccaagtcatattgctggaataggcttaatcggctaatccttgttcgactcgaactctgctgatcctgattgcagccgattcagactttagccgatcctcgctctgtttccgtaacgatctccatcctggattctgcttcggttttatcttcatctccgata

SEQ ID NO: 75491 - DNA, 18489 bp, Oryza sativa
  unsure (1)..(18489): unsure at all n locations
ggccaaggaataaaataggatttcaaggaagtgaaaactaaaggagtttatttgtggattttgaactttagacaagaaattcaaaggatatggatctaaagaaagagattggtggactttttaaaatttggaaaagaaattataaagggatttctaagataggaaacctaagggaattttgaattgagagttttaaataaatttcaaaggagataaaatttaaaagagaaatgtttgaggtcttttgaactttataaaaagaatttaaatataaagtttttaaaacaaaaggggtttgaaatcaagatatttaattttgagttatagattttaaaaaggataaaaataaagatgctccaattttaaaagaattcaataaggatcaaaatgctccaattttatagaactcaataagatccaaatataaaacttgacgcaaatattttctttaatatttaaaaattaaaataatcaaatgggaaggaaaggcaataatttaatttctaactttggataaatttgtgatggtggcaaaataaatggaagggaagcaaataggactttagccccaatatatgtggtatggattctcggtgatttattggtgggctaaatgaaattggattttgtacggaagggattagaaataggtttcttagcacaagagcaatcattctggaaatattattctagtgccagaaagaatcaaacctaaactggcggtttgatttatagatagaagattttggatagtagaacatctaaaggagtttgtggaaggtgttgtatgaaagagaacaaggatttctaaggataggtctaggtcaagggttatatccagaataaattcccgcaaaaaggaaattataccggtttagccccaaagataaaaatggttaatgggatataacagagagtcgggtcaatcggggaaatattggcccaagctaaatagtagactttggaatcttgaatggataatttggaggaacaggatttcaaaggggaaatatttgtgggagtatataactggattcaaagaaaatataatttagagccaaagctagagattaaataaaataaatggaaaggttttataaaatttgggaaaaaacaaaatagagaataaaataaagattttaaagaagagaacttttaacttagcaaacaaaatctagatccaggttaaagaaaaaggaaaaagtaagattactccaacggaagaatcgagaagaacatgacttaaaatattccgcaaaaatttttccctgaaatttgagtccgttacacttttgtaccaagttctccacttttttgcagacaattgtcaagctctaaaggttgttgaccacttggctagattaggcttggtttgtctaaatgggattctattggtttcggtgttgatgcaatgagtagggttaatattgcccatcagaccaagaaagaaatgtgatggctcttgcaacatggggatcataatctggtttctaaggtactgaaaatagaaaaattgaggaagaagccctaagtatgaagaaatagaataggatgaagtatgaattacagaagattgatgagaagcaatggatttacctcagggacatcagaagtggtcgccatcgatcttgagcggagaggtttgccgtcagaaatttgcgtcgccaagtgttgatgtgaaaacacggcggcctgggagatctgcttaactccagtgcaggtccaaggctagactcgagtgtgtcaagggcgtgccagctggtttgatcctgcaatcagcaagagagataaaagcagaattagtcagacaatagccgatcagccggaaggttgatagtgtatcgttcgtggtctcagccgatggagttagaccaaatcggctatgtactgagtatatcaaagaatattaaactctaaacatgcctaatcggttgtcataccgtctatcaagtttaataaattggtttaagacaatattgtgaaagtagccgatgcgacaatatttagagcaagaaagataatgtactagctaatactctagtatgaacctatataaacagattgatatatataaacatatcaaatagaaatcaggcatgaaggtgcaagaaatctagccgatactgactaaagcttgacatgcatatataaaacgaagtatctatataagtggtgaatatacatgaaacaagtagtaaaacatgtatattaggtaagatcagctgaaaccccgatacttagggatgcaagtggggcgggcaagtgtgcttttttgtcccgcttatcccacttctaatttattttttcttctaaattttgtactaccatgcaaaaaatagactagcaagcgggtttttatgcgggtagtgggactacccacttgcatccctaccgatactatccttattatgtctagttgttggcttgtttgcatggttctaggctcgtttgcatggttctaagcacgactagacaatcaagcagttaaacacttttcaggatggtagatacattagctaatctaatctagcaagacaatttagccgaaaccagcataaaccctaaagcaagcagcggccgataaagctaaattgagaagctaagaatagtttaactaatacatatgatagcaatgactcgcgatatcgagcctaacacgtctaaagcaacatgttagccctgatagcgcgggccattgagacgaattagctcttgtgaagaaatcaccaaaaagaggaaaagtaaaaagggtggcgatgcgccgaagttgtattggattggctcccgtattacaatgctatggggttcatatttataccccgagtacaaactagtccattatggacacaactcgaacctttctaaagataagatacaaacaagaccataaatagtggtctcttgccaaatctctaacaaatcgactcaaactaacctaattaatagatacaattactttatccgagctctatctctaattggcaatgacggttatcctaatctaggcccatgctgagcccaaggcataccatatcagtcttctcaacttgttcaatcttcggccactgtttccagccaatgtggtatgcagcgatgcgtagtccaattctgagtccaacttggttcaacaccaaatccgcttcgatcttcttctttcttctccgaatctaatgcccgcaagttccgttgttaacaccaagaaatcaccgaagagcttgaatcgttggagaaatcaataagggctaacaaagttgttgaagcagtggcggaaaaggtgatggagtgaagttttcgagggggttcttgctatttatgagctaacggttgaaatggaaagccctaggattttgcgggattgaaagagatagtttcgccgcgtcatataacacagcggaattggggggcaagtgttaacaacaaaatttgacaagatagattcagattgggagttggatatcaaagcggatttgaaagaaattggatcttgccaaaacagattgtacatcggctgacagcatatcggctagaaatagagtcgaagtttgattgagccgatatggaaagcagccgatatagttcgacttgggcacgattgagattactgtcattgccatatagagatagagctaatttaagacaattgtattcattaattaggatactaatgtcgttttgagttagaggtatggtaagagtccaccatgtagacttgtttgtttttatctttaggaaagtttgagttgtgtccataatgcttgaattttgtactctaggtataaatataaaccttagatcattgtaaaaagggacgacaatccaatcaatataactttcggtgcatcaccaccatttacttttactttttcgacgagttcttacttcgagtcgggcatcgacagcgatctctcaacaagaagtaaattgtctcgatggcttgcactatcgggcctattatgtagctttagatgcattggtctttttattgtcggataaggccttgttggatcctgtagagacaaaagaccatgtaagatctgccgtgtaagagttttcgccgtgcgtattaaccaagccatgtgatcagaaattgagttttccaacttcacggctgggggctaggatcagtgcttgttcaaccaaggcaggtcaagggtccaagagccttctcctccgagaacgattctctgacgacaaggctgggggctagggagagtgtatgactcaacaaactgactgatcgaagtcggtaagagagaagacgctcatatacaaaacattggacccaccacataccatgtcttatacggaaactgacttcagatatggagggagttccggataaggaaagacaactagagttctacatggaaacgacaaggactactcggattgtatccatattggtttccctagttctacttggacaaggggacacctatgtgtataaatacaaggccccctaggaggagaggggagataatcaacacccaccacaatctacagaacaacagaagccacaacatataagccaacatatgccaagacaagacgtcggatattgacttcagggataagcacggctagtctcctacggtgtctccggatactgtcaggagagacgaaagcgctatccctgatctcgttgggcacggattcgaggaggaagactaccctattgtcgactacgagtcagatcttcagaccgccatgtcgacaacagttagataggctaccccaaatattgtactggtgtgattatgatgaataagagcaacaaccggcttcggccaacaggatgtagggttattacctgacaattcaggggcccgatcctgtataaaaatcctcgtccccatctcttttgcctcaatctcgcatatatcctagtaccaacgatccccatactatgcaaataccggaatcgtgacatcaaacgtcgacaacttgattgtttagactttaggtttctctacatactttgagttgcgtcaaccctagtcttgtctagaaccctaaaaactaacctggaattatacataactagtaacagcattggagtttcagccgatattacctaatatacatgatagtgcatgtctcataatctattttgtgtatatttgccacttatatagatagatcactctaagtaaatatatcaagtttgattgatctcgactaatccatcatatatggtgatcgattattacttgatatatttatctagattaatttgtttatataagtttgtattggagtaatagccaatacattatctattcttgctctaaatattagattatcggctatttctataatattgtctaaaagtgattgataaaaacaaaagagatagtattgcaatcgataggacatatttagggttttgttttacttatctatcataaagccgcaaccgatttggtttatctgtatcggctgggtcctgacgatacgtcgttggctgtattagccgatcggctatcgttcatctaattacgtttggtgtctttcttgctggttgcaggatcaaaccagctggcacgttcttgtcactcaaggaaagccttggacctgcactggagtgaagcaaatctcctaggctgttgtgtttctcgtcaacacgcttttggcacgcccagtggccggggccacttcaccattcatcattccaccatctttcactgaaatcacagacgacaacatcgtcctcgtcactattgagcacttgtctgatgaacagaaagcagagatgaagaaacttgttcaacagatgcaacatatgtgtcttggttgttacagtatgactcgacaagggaagctgattcaaaagaataaagtcgagttcccaaagcttattgaagaaaagactgataagaagcctgatggtgaacaagatggggatagagaagaatccaaaccaactctgcaagatcacattgactcagccgtgcatcatgcattgatcaaccaatctagtgtgcttgtcaatacattgacgggcatgatcaaatcagtggtagatgggtccattgatgaggagaaaactaaggggccaatatattttccaaatcttgtttttccatcttacaaaactgtaaggactaagttgggaagtggacagcatcaaacgactcctacatcggttccaattgcgccaggagttgatacaattttactcacaaggcaacagccgatatcaggggtgcagacatctaatactttggctctagagtagctgatgcagatgttgaagctaaagcaaccaagtactgaagtacaaccatcagccactcaaccaagctcaagtcagccacctttgattcttcagcagccagctcaacagccaattgggtcatcacagccgatcggcccatagtatgtgaatgtggattgatgaaccctgagttcctctcaacactcaaggctgttgttggcccgatctttcggtgagttgtgataactacgatttgggagaaacgttgacgatccgactacaaccgtacgagacgttatgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggttccgaagaactagcagacggacggtctagccgacacgcgcgctgcaagcaagtagcaatggctaaactttaatctaacaaaacccgagaaaccctgaaggggtaactagctatatatataggggtgggaggacgacctaggggtgcctagggtcgtgctccaccagcttggggcgcaccccacatgggccccacctgggccggggtcccaaatgaagttacaagcccataggcatagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagaggactccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcatagtccatttacaacaacctgtttcttccaattaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctcctttttatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgtggatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttacctatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactagaaacaactcatgcacaactctgatatatgaagttcagctcaaacataacagtattttctcttttctttctttcttctttcttcttttcttttttttctttccttttcttttctgtttttttttggtgcggctttttttttcttttttttttgcacctttctgcctttttttcactttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccagaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacatggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacaaaagctctgataccacctgatgaaccctgagttcctctcaacactcaaggctgttgttggctcgatctttcggtgagttgtgataactacgatttgggagaaacgttgacgatccgactacaaccgtacgagacgttatgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagaggactccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatggatccacaaggctataaatataaacctcaacagccaaatatgggattcaatttcaataatcactatcaacctttttcaccaatgaagcatcggccagaaggatctccttttgttcagttttcacctcaacctatgtataaccagtttgaacagcaattaatataaatgaggtgtgcaacagtagccattggccgatatgattgctgatgtgatgagagaacattttggccttaggcctaaggatagtgggatcatatatcggcatccctatccagaatactttgatagagtacctttgccaaaccgatacaagattcctgattgctccaaattcttagggctagacaatgtttcaacttatgagcatattagccgatttttagcacaatgtgatgaagcatcagctgtggagggcttgagagttaggtttttccccttgtcgttatctgggtcgacttttacttagttttcttctttcccatacaattctatcagaagttgggccgatctagaaaagcagtttgacaagtatttgtttagtggggttcaagagatgaagttgtcggatttgactgcaactcagcaaaaagttaatgaatcggtgccagattatattcagagatacaggaaataggtgctatagcttgaacttaatcgattcacaaatcacaactagctgatttggcttttcagggatcaatagttgcgtaagctgatcttgagttgactgttaagatgcctgccccctgcattggttgttgctaactctacataaatgtggaaggagccaaagaagagggaatagaagcaatcagttgcctatggccagccaactcagtcttgatggttctgtaaggtgggaaaatattatttagaaaatatgtatgccccttaactttctcctcaactattgatcatatctgataatgtattgaccaaaacaccagattggttgatcaaagcatgatgaactgcataatcactggttccttcttcaatcttcgacttcgacattgttacttttcccttttgtataattgttccttgtcaagtcatgctgaaggatcccaagtacatcttctgaaattgttgaataatttgttccatctctaccctctgctcatcggacagcttgttgggtgtaactgggattaaattctattatgtaataatcaggaatcatatgaatggcttgatgtcctattgggtgtgccaaaagtgtgttgatgagaaaacacggcggcctgggagttcagcttagctccagtgcaggtccaaatctcgctttcgggttcagggcgttctagacgaaaaatccgcgctcagccgatggtgccgggactgtgttggcatgcactaagtcgacgaacacaacgacctgggagatcttcttagccccagtacaggtccaaaatattgatgagatgcgggtgtgccaatcagtttgaccctgtaactgacaagatagacaaatatgttgatcaccagagagccgatcggttgacaagccgatggagtaattccagctgatgccgatactagtcgatactccctccattccataatataaggcacaaccactttttttaatgttccataatataaggcatgcatgtatgtaggcaattaactatggcctattctccattaaattattacttttttaaatcctccactctcatgttctctaattctattggatgcatgcattgtatttattaggatgatccaaactacaagatgataataattatttcttggtcattgagttaggggtggttatgccttatattttggaatggagggagtaggtttttaaacaatcggctatatgtccaatgtagataatgatataaagaaaatcagttgatgataataaaataataatataatacagtagaatccaatcggctaacaatgatatgatagaataagtgatcccatggttaaataatacatcagctgatggtatgatgtcattaaatccaaatgattagataaacaatgaaacctttgttgcgatcggctaaatccaacttatatgtaatccttataagccgatgcaataactcatcggctgaaaccccaatgaaacccttattttcaatcaaaagcaggttagtattttatggttctaagcacgactaaagtcgatacaactcgaagtatgcaaagaaacataaagtctaaacaataaagcctttgactattttttaagagtggtggataccttagctaatctaatctagcaaaacaatttagccgataccggcaaaaaccctacagcagatcccaaccgatataagtaaatcgagctactaaactagattaactaagatatatgataggtagttaggcaaatatatcaaccgaaccagagcgatccaagaggtcgaagccttgaacaacactaatgtagccgatacaattgccagggccgacggaacgtaggacttaccccttcatcgaagatcgaaaggtgatgcagccacgcgttaggtgccaagttccgccggtgataagtaaaaacctctaaaaagagggtggcaatgtgctgagagtagttgtattgatctatatgatagtttaaaatgaccccaagtgtacatatttatacccatgggtagttactagtccttattggacaagaaagaaactttcctaaagataaaaggaaaacataaagtctttgtcgaacactaaatcgcctattaggtatgggataatcaatcatgttccattggctatagatgcaatcaaacaagtaatccctaatctgatgtttctctgagatgtaagcaaacggtatagatcaaacttaaccgagacagtgtggatagctcttaaatcagatcaaatagattggagattacatgtgtttatattatagtcgatgacacaatacttaggttaaaaagatatcgtattataaatatattaagagcaagcttgtccaagatataaggactagcttgctcttaatatacttaggttacatgtgtttcaataaagacaatttagccgatgctggcaaaacccaagaaaaggcttggtcgatataggtaaattgaataattaggttagattagccaagatatataatagtcaataattgtataggatagattagaacatctacaatgacatcctaatctgctgatacaaaaccgatgcgacaagccatacctcttgttagaagatcaaaattgatgccctaactcgaagcaagaactcgtcgagaaagttgaaaaaagtaaaaaggacggcgatacgccaagattattattgaactgttgttattttcctacgagatcctgggcatatatttatacccatagaagttaacttgtccatatcaaacatgccacaaactttaaaaaacatactagccccttgtggactctaacatatatttctaaaatacataaggaaaactgaactcttattctaattaatagatacagtttccatctcaggaccttttccttgtttggcaatatctctgaagcctcaactccaattcgatacgaactcaaaatctaactttatcggctgaccgagtccgactttgtatcgaccgatacgatctccagccgatgcgctgctctgttttgggaaccacttcggatctatctttatcctcgcgtatctcaccaaattttgctgttaacaggagctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtggctcttgttggttcacacaggattccacgtttcccatgtactcggggttagagcgtaagctagtgatgctttcggctactggattttatccatccttgggacaaaaatttactaaacttggcaaaaaaaaaagatccaaaataacatattattaactagcacagaagtttcccatctcaaactttggaagttttacaatctgatatttcagaatttttggccaaagatttggaagttttcgtcctaagggtatttcggtcattaggaaaaaattatacattgctaacttgaccgcaatggtatattatagaagttaagtgaaatgcgatggtataccgtagaacttgacgaacctaatgacatattctaaaataggcacaaaatcagtggcacacaatggattctctctatttttttatgcttgttcacttaatactatggtacggcatttttagaaaaagtcaaatattatactatataagtcaaacattaaattatatacacttataatataattttcaaattatacaattcactattcacattttataggagaaatatagaataatgatttattgtctattgatttatgagaaaaatattagccaaaattaacatatacctaaaaaataaaaattaatatgaaagaatgagggaaaataataaaaaataagacatagtcatgatatatagtgcagtgagaaaaggagaccacaatcgaatgctttatcattgagcaaaattgagggtattatttttttttatctttttatagtagaagtctgtattgtcatgttttaacatatcatgagattattagtaatagttaagtagaccaacccaacaataccgcatagaaacgataaaactgtaatggcttagcatagcacgagactaccgactaatggacaaaaaatagtaaattcattttgtacaacatatttttaaaaattttcatactatatcattctttaatcattattttcatttacacaacggctaactttacatttttgtttcaatttagacaaccccattctatccatcttcaagtccagtgatttccaccattgcttcacctccaaatccagtgactctacaaccactccatacacacactctctcccctttttctttttccctctgatagctgggaactgccagatcatacgaggaggagcccagatctagcgtcttcgctctcggtcaggtcagctcctgtcatcccgagtccttgcaaggccgataccctcggcctcaacgatgaccatgacaatagcgtgcatgaagacacgagacgcggaaagacaaaacggtgattagagggtgcagttgcacatgcgaagatgaagaggaggaatgatggtggctcgtgaagaaagagcggtggttggcagtgcatggagcggtactgacataaatcctcaaccaaatttgttgtgttttttctctgtgaaccatcagtcattataaacaaaatgggtaacattactaaattcgacataaaggtgaggcactcgagtatcttcccccttcccttcgcgtgaaagagaaatcccccgactcgtctcctccgctccttgcgcggttgcgccatctcgtggctgaacagggaggggagctgatctccatctggcgagcagaggaggggatcctggtgagcatcctcatcctctttttgatgattcatctctctcccaccgggagtacttctgtctggaatttgcttgcgttaaccctagcttctcttgtagatctgaaagaagctcttcttcttaatttcagagccttaaccttaatacaagtaacagtttgtttgttcccaaaaagtttgggggttcaactgaaccctcatgtcccaagttggatccgcccgtgtcacctatcatgaatttgaagagcacaacacataaaaatatgctgctaggaagcaagatgaacatattgttctaaaaaaagttggtcctaggcaccaggtagctctcccaatttggcattatccattggggctcttgtgctgctatttagtgttatattgtccaatatatgtgtcatatacttgccaattgtttggaattcattagtcatgttggaccaaggcggtggctaagtgcccctaggcggctcttaccctgtcaaccctctagtgcctcttgaaccatggatggacagcaattgtgcttttgcaccaatgtacccaacacatttttttttcaaattaccttgagacttcttagtcctggatgcttttacacaatgctcaatgcgaagttcagtaactatagggtacatgcatagtaatggaatgtcataacaagttcaatagaaacatagaacagccaaaaatgtaacacatagtataattcgtttgctgttttctttagaacactattggtttgtgttattaacaagtttagattcacattcattgttctgaatataattttggaatccaaagcataataatcatagtaccataccatctaattagagcaactgtgacatgttgctgtgatgtgtgcttagtaccaggaaattgggaatcattataggtaggttatgattttgagtgattaaaaggggagtttttgttagtctgagttctagcagcatagtgaacgacctggtatgttagctgcatgttagcattcctcttggtattatcaatcagcataaaatgcaatatgactagcgagcttcactttgaagctttaggcccttctcttttcttgagctccaaacttcaacttcctagttttcgattagcacgctttcaaactattaaatgatgtgttttttgcaaaaacaatttctatatagaagttgtttaaaaaattcaaataaatctatttttcaagtttataattaatacttaattaatcatgtgctgatgagctttctcgttttgcgtgcgctaaagatctcgagaggaatcgaacacagccttaactacatattgttgaaatgtggatgttgcaatgctttcatcaaggcaatagatgtgacatggcagatcgttgtaaatcagttttactatggcagcagtatttccctgtgtcaatttctagttgcactttagtgtattgctacagtgattgctagctcagcaccacctttgtgttgtataaatactttgggtttattatatcttgttttatttccccaaataggactaattttcatgagatttggtgtgctttctaatgcagactgtttttgtgtgcatgtaggaagctgattttatcatctgaatcaagtttatatatctacaatatctgcacaaatggaattgggggacaaggcagtaggctttattttaaccttgacaagtctatccatctttacatactatactttctgggtcatcatcctggttagtaacttctaggcgtttttcatttcaaatataacatctatgattttatttctggatgataagctgttcctctttttttcaatatagccatttgttgacagtgatcacttcgcccacaagtactttctgcctcaagagtatgctattttgatcccagtgcttgtcggcgtgattgtcctatctttcttaagcgtgttcgtgggtcttgttatgctcaagtcaaagaaaaagaagaagaccacttgattgaatttaaccatatttgttatttgattacgattgcaagctctatacaagaaagcagttttctcatatgattccgttctatgtagtggtttttgcatgtaagtcgtagtttcagctttattattattattattattattattattattattattattattattattattattatttcatttttgctgttgggttgtgaactaaa

SEQ ID NO: 75492 - DNA, 61422 bp, Oryza sativa
tctctccctctctcccactccactcctctcctctcttttcctggccggccagtggctacagcaggcgtcggcaggcgatacggcggtagcgctcgcccttccctccctctccctcggttgtgggcgggaagaagggcggtgacagcaagctagggcggcagcgggcgaccacggcggcacgcgacccctcccctccctcgccttgcagatccggccgaggggaggcatgggggcggcgatgctcggcccctccctccctctccctcgacagcgggcgggaagaagggcggcaacaacagcagcggcgggcgaccacggcggcgcgcggtccctcccctctctccccttgcagatccggcggaggggaggcatgggggcggcggtgggaggcggtgggaggtggtgggacggagatggcccgcgccggatctggatcgatgtgagttgatgcccctcccctcccctgccctccccctgcagatccagtgaaggggaggggcgtcttcggccggcgacgggagcgggcagcggatccgtaggcggcgaccgtgggggtgacagcgacgggccacggctagggcagcggcggaggcggtggattggggttagggttttgtttttctttttttttgtttcgattttttattttctcgtgcgggtgaggcacccgcatgcgaaaatcgcgattttcccagacccttgggtgcgtgcgggccgaccatccgcacggaaaaattgaaatcgactgcacacaaaaatctttcctgtattgaaatggggtttctttaaacattttatcccaaaacatggggttccttgaaacaaatcacaataactggggttttgtgttatcgatgccccaatacccggggttttatgaaatttactctaaataattacattccccacgagaaatatgtaattcgcatgttgttaaacaatatgaaattttagaaattaataatcaaattagcaatgtttagcttagaacaaagctaaaacatgtaatttgaaacagagagagtatttggaaataaatgtaattgtgacaatgagtgtttagtactaaagaaacaacaaaacctaagccatgttgttttcaattgtttctacatacatatagtaaatttagttgggacttcatatatgtattctgtaacttacaatgttggtttgcagaaagatcgaaacacaagagaagtacaatgatcggcattctggtgcctgcaattgctttatcttccatcgtagcatggttttgttcttggaggtggaggagaagactagcagcaagaaccttagagctaagtaaatattcttagccattttattaaaaacgcagcacgggaactaatgaactatcctgatggcagttggctaaattcattataaactaggggatagccccattcagttttgcacggagctagataattcacctataatatataactctgaaattttatttctatatagataccattatatgtaaaagtacatttggattttatatacagcgcttagcttctatttttataaggtcccatatacaactcctcgattatgtttctataggcttaatttcatatgcaactctttacttctatttctatgaatatattgtattttgtttacaactatatcaatcaatctatatcgttataatccggaccgaccatgatctaactgtttagatatttttctttttctttgattaatgtgagaatttctagcctctagagcgaacattgggtctccttttaaggatgtcttaataatacaatagattttgtttagtcaaattctatcatctttttttttctaaaaataagtcacttgtcttaacattaaaggcagttacttctcttaacataatgcttcattgtttacttttctcttcctagttccaacggagtctagtacagatgacatgcaaagtatcggctcgctcattcttgatctgtcaacactaagagttgctacagatgacttttctgagcacaaaaggcttggtgaaggtggcttcggtgtagtgtacaaggtaccacttggatgtaattgtctgggttttctctcaatttataaagagaaattttactcttgttaaatagctaagtaccgacaggtaccgtacttttttctataaaattgatgtttttttatacggtatcttctggtaactatcaagggctataaaatcatgaggccataacttctcttcacctgcttgcagggagacctacctaaaggtcaagaaatagcagtgaagaggctcgcgaagacttccaaacaaggaatagaagagctgaaaactgaactacttttggttgctaagctgaaccacaacaatcttgtcaagcttattggcgtctgcttggaagaaaatgagaagatacttgtatatgaatatatgcctaatagaagccttgataccattctttttggtactatttctcacagctccctgttttccaaaaaaaagatctctcatcatggtaatgcaaaacatgatcaagtcacacttatatatatcgaattggtgttttcttgtgtgagtggtagatgcgcagaaaatcaaagagctcaattggggacagaggttcaagatcataaatggaatagctagagggttgcaatatcttcatgaagattctcaactgaagatagttcatcgtgacctcaaagcaagcaatgttctgttggattctgcttataatcctaagatttctgattttgggttagctaagatattcgaaagggatcaatcaaaagttatcacccatcgtatagctggtacttagtaagtatatgtccagtcctttaaaatgacaattttattagttatctggtaatgcagtaaaaataatgttattcttacagtggatacatgtcaccagagtatgcaatgcgtggacaatattcaatcaagtcagacgtgtttagctttggtgtcctggttttagagatcatcacagggagaagaaactttggctcctatggttctgatcaacaagattatgatctcataaatgctgtgagtacacgaacactatattaattaatttatttattctgggaaaaatatgtagtacaaacttcataaatctgaaactaccgtaggatgtacaaatggacgtctgaaaattactcatggtgacgtggataaatcttagagatgtccatttgtgcattctatagtagctccttggtttgcactacatatgaagtttgcagtacatattttccttctatactaggctatacttctcctagttagagttaattttatcgtacattaacccattgatttgatgtagacatgggagcactggactagcgataaagccctcgagttgatcgatccatcattgggaaatcactatccagttgacaaggtgctcaagtgcatccaaattgggctgctctgtgttcagccgaaacctgctgataggccattgatgtctgctgttaatgtcatgcttactggtacaatccgtctcccttccttgtccagacctgccttttggtttcaggagattggtgctagctcagatgtaaattcagagcagaacctgcttgacccacacaactcaacgaaaatgtatcaaagtgaagcaccgatcacagagcttgagcctagataaatcttgtaagatgagttgaaagaatatccgcttcttctttcatacagttaccgatatttgtacaacggactcttattaatctggctatctaggtgttgtgttttcggctcaacaaagtcaagtggaaattattagatgttaataatgtatcctgctgtcatcctgtttaaatcaacaggagcatgtttgcattgttgcacaaagatactgtagcaaatacgacacatgcttgatacactggtttttcttttgaaagaattgatgcactgattctttatgttattcttggttcccagttggcacttcaatatgcaaatcatcattacttaaaaaaaaactattttcgtaggtaagggttcatttttttacagccaaacagaaaaatatcccgcctgtaataatagtcgaggagctcatgcaggataaacccacatgtgaaaatcaacttttataggctgccattaaagaggaccgcttgtgaaaatatgtttatttttgctggtggtcctcctaattcactgcatgtgaaaatcgattttcacaaataataagtaaagagaaccacctacgaaaatcttcggccacattaaaaggccgatcgacccagcactgaggagagttcatctctccctcgcattcttactccctctcctagctaggcgagcttctccctccatccatccaagcctcctacctctactccctctcccaggcagcgataggcatgcatcagcagtggcagttcttgggatggcaagatctagcggtagcgggcaaggggacggtgtccggcggtggcaacatcatccacggtgtcctcagcccctccacggtgagctcgttcgcgacagcggtaagcatgcatcggcggcggcaaatgggacgtacggcatccggcagaagcagtgtcgtccacgatccacggtgtaattcgtccctcccaggcaagtttgtctctgtggcaactgtaggcatgaatcagcggcggtgacaagaacatccacatataagtggtgaggtgtcacgaattatgacaatctattggtgttgcgccaaatttggtacatgttgcggtagaaatcgatctagagatttggaggtttggggaagattgcgcagagatcagcaacttgaagtaggagttggtcatttgactttatgtattttcatcaacgatgaggtctccgatggtttttctatttcgcgaacgcgctaaaggattatacgccaatatattagaagaagaaaacagagtttagttacacaatgcaaaccggcagaaggtcgttggcagggaacaaggaaaaaagaaacgaaaaccagaaaaaacacaattaaaaagatttgctgggagggtggggtggggattagtccctaaactcaaaaaaggcccccaaaagcgtggcaccactaaaaccgaaggatggactctagcactactaaaatcaaagagagagagtagtcgaaaaccctagagttccgctccttctacgattgccaggagaccagaaagacaaaggagtctaataggtctccagtggtaaggcagctgcttatgtaccgcagtgtctccaacggcgtctgtggcacaagtgcacaacacgccggctcatcagcgaccaaacacacgcgctacaggctacagctgtgaccggaacatactggcccagcggggaagtatcgtgtgcaatcgcacttcccagtgggagaatgcaatcagcaaggtggatcaccagatgcgaaatgtgcggcttggattgaagcaggtcatgagctaggatcactttaaaatatatgcagatgcccccccaagtgtcagtgcgcattttgcacgcaacaccccataattcactctcttctactccatagtccccacgaaattcccctttcatctcatcgaatcaaacacaatagagatggaggcgaaatgtacgcgatgccgaacgactccctcgtcggcgccgccacggagtgggacaggcggcgggcgagatccaacgggtggctccgccgcgcggtctacagctccgcccgtgacctcgacgacgcgcgggccagccccatggccgcgcacgcgccgctccgcttctctgttgcgccaacggcagccgccaagcccaaggtcgtcggtacattttttaaactttcaagtttcaatgttccatagatctagaacaactacctttccttttgtaaaaaaatttttcagggattttttcgttatgtctaccgttggtgttgatatgatttttattacttggccgaggaggattcgaacatttttatccattcttcacacgaggtagaagcagatctcggtttactgctccagattcttgtgaaccaacggttaagcgagtgtaggttacagaatgagttatgtttgtaaatgcacttttttttgttcttatatatgatttagtttctttcgaccttgtcctgaaactttctgtaatgttccactctcaggaaagcttccactgaaaggagagaagttttctttgaggctatgtctgagaaagtagcagatagttcttctgagagaacgactagtcctttagaatcagacagcgacgcattttataaaaatcttgatcccctcttttctgtattacatttttgtaagctgttaagttcaaaaaaaattaagaagaagagttaaaagattaaattgaattctgcagggtaaaccagattaaaccagaagatgtggttgcccagcgaggatgaggctgctgaaatgtgctactggtggttattatgtcaaaacattagttgattatgctgtaaataacattagatgtgctactggtggatagatattaacgtttacataacattcttcttctttttgatcaaattgatagggaaaaatggtgcaaaacgacgtacagtgtgattcttcataacacatgtcagagttaaacgtgcgagtgtggtttgagtgagtactttggcattctctgatgtcatgcgataagtgtcagttatttaccataatttttagtaaaacatcttgcctcacttgcaagtagaattaacttgactttcatcggaatggcaaaatgtatttttgcaggttatgctacatctgggcgtgcgtactattcctcaatgccatattaatgatgcgatggaccaagaaagctcgtgactctatcccagcacaccttgggacctttccagatgatgttgggatggcccaggcaagagtattcaggcataatgttttgcaaagcactgcgaatgagatagttaggctcggtgatcaggataaccaatcttttgagattcttcttcgttatcttggggaagcaaaggaggagattgccaaagccgcttccaagatgtctggtgctgcggccagttttcatttcatttcatttcagatgttttcatttcagatgtttcagtctcttaatggaatccatgcaactgtacctttcgagcttttctaatctaattaatgtgaaatttgcaaattcattaatttctgtagctttcgagcttttcataatattatgttgaactctttttcgtccatctaatctttagtttaaccacttacatccaggatgcaattgaggttgcaggggttgctcttgttttaatcggaccaggtactgttgaaaaaacagtggcagtggcggcgacgacgacgacggcgaggaagagaaagggttatcactacgcttgcaaaaatggcgtctcctatgccaccactgactctgatgtgttgttgaacccctttttttttctagctgatctacaaagtgtgcagtacagatgcatctcttattcattgccatggtagtagccgtgtctggtgctgttgttcttcatctctctagcaaagtatatcttgttaatgaatttgggctcatcatgacaatacgatgaaagtaacatttatgatccacaaaatttatagaatgctattttaatatcactgctgcacacaaagatttttctggtgaagggcacattcagatcagtattgtgcacaaggacttctctgataatgagcacattcagatttaaggagaagaatgcaacagacaggcagatgaggcagcttacgtctttgtagtgaacgatatttatcttctgaaatgtttgagcagaacttatgacacagatgtattggatagttttccacatggtcatggatgacacatttgcacaatctgcttaaacttataaaacatttttgcaatcttgggaatcgaacatacaagaaaccatatgtatctgtgtgtggcgaacaaactatgcattcatttaagtttagatgccaaggctccaaatattttcagcttgcatgacaaggagagaacaacataatagttttgagtagcaggagccaggaagccaaatgcaagttaaaaagaaaaaaccatgctgacatgctaccaacattttgctatgtaacacaactagttcagtaggtcacagaatgaatcttagtacatgacataggactaatcgacatatcaaattgttgatacatcacacatttgattagagaacaaagaccaccctatataaactaggtagcaaaataatgaaattggaagtatggtccccgatgtttgatcctaacaaacttgtaaatgacagatcttgaaattgcagatcaccatcgccatgctccataacagcaaattgtaaaccaagataggctccaaggaaacctgccaccaaacgcaagtagttaaatgtttagaagcaaaccatgataggtttagataaatccacccacacacaccagcacctccataatacatagcagcaaattgtaaaccagggttgtatggggaaccaccatcaaatgtaaatagtgaaatgtttagaaaaaaataacatgacagattcagatagagttgttcaattataaacatattcacctgtagtgtttgcttggttgccaaaattaaattgccataaattgccaaaataatgcttctatcaatatggcaaatacaccaagataatcccagacaaccaaaagaagaggttacccaaaatgaatcatcataaacttgctccaaaatgacaaacttactccaagctaacacctgccatcaatttgaatagattaactacaccgtttaatcaaaggcaacaaaaacagaaaaacaaaaaaaagatggagcaagggcactaacttgattcatggatctagtggctttttagagccatttgccttccttttcttcttgttgttttgctgcacttccccttccttatcatcattactagccttttttcttgccttgcccttatccaaatgtcccaacaatctattgcacttccccttggcacgcacatcgttaggtgggtgaatgtcaatttgcgtaggaatgctacaaccaagaaattcctcgatctcgctaactctagtcctttgagtggctggcaccatctgtcttacttgttttgcaatgtcaagtacaccatttttcaagagttgcatgctatcaatggactgcttagctagatggattgtttcttccattgtgttgaatacatcaaacactaattttttcatcatagggtcagttgaggtgctctcactttcttccaacaaggtaccctcactatcaaacacaggttcctttttgcacatctttgtccaccttctgaggactaaatgttctggaagttgatttagcctagcacttctaaggacaagaatcacatggcggcaaggaattccaagagattcaaataacatacaagtgcatgaaatatccttggttgatgtgttgtataagacttttctttcccttagtgaactatcacttaccgtagtgattttcacatccccctcgatttcgatgttctcaactatgcatttctccataacagctacaacctctttctgaaaagtgtcaaatatctcatgggtgaacacctcccttccatgcttctcaaacccccattctgtttttagtttttggttagaatgaactgtaacattgtcattttctagctctttgtgacgttgttcttctagagctgtatcaaacctgagccaaaactccaccaaagcaagtttgaagcctataaaatgacagaaaaaggagttggtactctcagatcttgaagtcgttcgaagaatgccccaagagaaatgtccttgaagtaaactggtatccatgattcccggatacgatacctcgttgtcaaccactcatggtcttctagaccatagtcagaaataatggaagtccattgtgcctcaaattcctcatcagtttcagtacaccatacacatttgttaaaccgatcaaggaactctttgtcctctcttaggggatagcctaccttatcctttaatttcctcataatatgccacatgcataacctgtgggtgctcgtagggaaatcaacactaattgctgccttcatactagcacattcgtcagttattattagcctaggttcaacacctcccattgctcgcaagaatgtctgcagcaaccatctatacgactctatcttttcattacttagcagtgcggcaccaaataatacacaagaccgaatcgatccacttacctttccttctatctctgtcccagacctcgccgccaacaagctagcggcccctcaccccgccgcataccggccagaaacacgacggcgacgaggtgcactagcgcccaacctgagactgcgccgccgctcagtgcgacgagctgaatccacagtgtactagaaaccctagccctcaatggggaaagctgaaatgttttggagagagaggagagtcaaatgttcagccttggcttctgctataatagagggactggaagcattttggcacataacatagagacatttttgcataaacaaccaacaatgtgggaagtgcttcgatctgagcagtacacttttcatccgacggtccacattgaagattgaatttctcccaccgaatagtagtattgcactggatacttccccctggcccagcaacatatacgcacacttgcaagtttagaagttgtcctgccgtctcagacatggcacacatgacaattaggctaggaaaatttgcctcgtttgattggtcacatgcatggaaagagactcacatccaagacctggaagtccactgtccacgcatacatgggccacggctctacggcactccagccggcgtctccgtacgtatccggccccttctgatctcttcctcagtcacaaaccatcatgtccatggcctgctactacctcgccgccgcagccgccggcctcgccttgctgctgctccacgcgcccctcaccgatgcgcagacgctggtgcctttgtgtggtgacagcggcaactacacggagcacggcacgtatcacgcaaacatacagtacttagccacctccctgccatcgtacgcctcctcctccccctccctcttcgcctccggctcctcgggcacagttcccgatgccatctacgccctcgcgctctgtcgtggcgataccaactcttcctcctgcgctacctgcgttgccgcggccattcagagcgcccaggaactctgcccgctcgtcaagaccgtaatcgtctacgacgacacctgcatcctccgcttcgccaacgacgccttcccgatcagccctacctccaatagccaagggatggtcgttgcttggaaagcccaaaatgtcagcgcggcagtggctccggcttttgaggccgccgtcgtccgactcatcaacaccaccgccgactacgcagcaacggactccgtcaggcggttcggcacgggggaggaggcgttcgacgagacaacttttcccaagatctactcgctggcgcagtgcacgccagacatggcggcgactgcttgccggagctgcctcgaggatatagttgggaggatggtatctgggaatttgattgggaggatgggagggcgagttttgggcgtgcgatgcaacttatggtttgaggtataccctttcttctctggccgctctctgttgcaactcccggggccgtcgccttcaccggcgccaccggtgaccgcagccggaggtatgttggacatactttttttctccttttcttttatttatcacttgcctgatattttcctgtgtgcaaagtgtgttttcttcgataacttataaggctggttaaattatatttgcagaaagatcgaaaaacaagagaagtgcaatactagccatttcaatgcctacaattgctctagtattagctactattgcagcatggttctgttcgacgagttggaggaggcggagactagcaagaaaaacattacgaccaagtaaattcatcttatccattttgttagaatggaatatcacggaaactaattaatgaacctgtcttgttatttttatgaaaagttggctcaattcaagtgattcattagaaatttcgtttaatcaaattccattctctctttctcacacaaaaaaaaaatcagtatctaatattgaaggcagttatttctagttgccgtgttggaccacttttcaaagatgcttatatttagtctatagatcttctctatatatggtacttctcaattgtccgcacaataaaattataacttggagctaccaaatatttggacaaggcatcaatcaacatcccaagttatagttcggcgaaatctcctggtagctccaaagttagtagaaagacttttagtcatattagtgtcattaattaagatagtacttccatccttacgttctaattttttttctagtcaaacctatttaagcttaaccaaatttatatcaaacaaattagcaaaatatagtcaacgtttgatttaattagactaatttgatatcgtggatattgttaaattattctataaaccactataaatttttgttagaaaagatcaaagcatcttaatcttataacataaaatggagggggtacaaggactctttccatctgttagtcatatactgcgtaattaattatttacttctctcttccaatagagtctagcgaagatgagatgcagagttttgcttcactcgttcttgatctacaaacactacgaactgctacagataacttttctgaacacaaaaggcttggtgaaggtggcttcggtgtagtttacaaggtaccactcacaccatgtgtaacagtgtgggttttctctctcaatatatgatgaggccgcaacttcttttttcacctgccgcagggagatctaccagaaggtcaggaaatagcggtgaaaaggctcgcacagacttccagacaaggaattgaagagctgaaaactgaactacttttggttgctaagctgaaccacaacaatcttgtcaggcttattggcgtttgcttagaagaaaatgagaaaatacttgcatatgaatatatgcccaatagaagcctcgataccattctttttggtactatttctctcatctccctgtttcccaaaaagaaattaaatttcatgatgatagtgcaaatacgcctaactcatacctacatgtcataattggtgttttcttgcttgagtggcagatgcagagagaatcaaagagcttgattggggccagaggttcaagatcataaatggcatagctagaggattgcaatatcttcacgaagattctcaactgaagatagttcatcgtgacctcaaagcaagcaatgttctcttggattctgcttataatcctaagatttctgactttggtctagctaagatattcgaaagggatcaatcacaagttatcactcaccgtatcgctgggacttagtaagtatggccaatcctttaaaataatgaagtcaatagatcatgcagtaaaagttatgttcttgctacagtggatacatgtctccagagtatgcgatgcgcggacaatattcaatgaagttagacgtgtatagtttcggtgtcctggttttagagatcatcacaggaagaagaaactttggctcctacggttctgaccatgtggttgatctcatatatgttgtgagtacatggacccaattattctataccgagctaacttcttctcccaattataacttaaatcgaacactaacccattgatttgatgcagacatgggagcactggactagcgataaagccatcgagttgatcgatccatcattgggaaaccactatccagttgataaggtgctgaagtgcatccacattgggctactctgtgttcaaccgaaacctgctgataggccattgatgtcagctgttaatgccatgcttagtagtactggtacagtccgtctcccatgcttgtccaggccttcattttgggtccaggagattggtgctactgctagctaaggtgcaaattcagagcagaacccacacaactcaagaaaaatgtcgcaaaatgaagcgccgatcacagaacttgagcccagatgagtattgtaggatgagaattgaaagaacctcggcctcctcttccttgcatttaccgggaattgtacaacaaactcttattaagctgcgctagctaggtaccgagtttttggctcaataaaatcaatttgaaattgttagagcttaataatatctcctgttatcagcctgtttaaatcaacggaagtcatgtttgtactgttgcacactgatactgtagcaaataagacacatgcttgatacaatggtttttcttttgaaagaattgacatattgattctttctgttactcttgattcgcacttcaatattcaaatcatatcctaatctgttgcaactccacagccataaatgtgacaatatcttgagtcttgtgctgcagtaattcatctgttattttcatagtacagaatacggatcattttgaacggacgtaaagacacatttccctacaagcaagatcctgaccttgtttgagcgcattcgttcaaccacgtcacgtgatgccaagcttactaggattcgttcaatgttggttcaagcacttaatgctaaacattggagccatttactgagtttgtttggctgcttgctgtaatggtttcagtttccacccacaatgtttggatcgggggacgtaatttgaatgtaggcaggggattaaaaattgggtctaattcgacaaaccaaaacaagattgcatcaagcaaaaaaaaaaaaaaaagaagcaggaaattgtgagagcaacaggaacgtaaatcagcaagaggttgaacataaatcggatcaaaatcacccgaccaacatggtacaacgaaagaagcttcccctcgagatcttcctcaccggaacgtagcctgtaatccgggagttggaggtggtcgacggtgtcgttccgcggatgccggttactcgtgaagataacagcggtcgccgcctcgtcggcggcggtcggtggcggcggtttgaggtggcggtaggcggcgttgggtctcgtggaatcgagcggccgtgcggcgccatcgcgaggatcgaagcggcggcgttcgttggaggaggcggcgccgccttgccgggaacgcgattcctctccgtatcagtgttgtgttgcttagcaattgggccggtattggatcccacagtaccagataacggcccatcgtaagcaaacaattgtaacggttcctatcagcgctgggaccagatacgggccgaatttggcccaaccaaacacgtcccagagacactgccttgtctagaaatgaaaagcctatacgtactaaagtttctattactaaactcttattactaacactaggaaggtagcccgcgcagatgcgctggcaatttatttattgtttacaaatttaattggtaaattttgagatagatctaatggtttagaaaatttgaagatttttttcccaagagagaggaaaggaaagaggagatgaggagagtacgtccgtaccatggaagggtgtggagaaggtgggagcacatactttttttattcgatctaatggttaaaaatattggacccaccaatttaaaacaaaatcaatggatagattttagagtgtcacttggcttaatccaaacaaattaaaattaaatcagatctacttgaaaaaacacaactaaattgttttatttttttcgcaattacgtagtacatttatcaagtgatatttgacatcctaaaatatgatacgaaattatttaaaattaccgtaacattaattattatatatttgcccaagatgtggtgatgtatttagaaccgcaatataaattttataagacacaaatattttatttaattaaagaaatacaacgggatcacaaattggttatataatttaaaagatgaacgtttagaaataattgatttgacattttttatttatattatagatctagtttatatttgcacatatttgtggagtaatatatttttatatggtaaaaagttatattttaaagaccattgattttgttctgatggtaatatgtattatcgattttaatttattttgaatcttaaattgttggtttaattatgtatagagcaacagttagattagatatgatatgtgtagcttaaaataactgtggttgtttgtctttatcaaagctactcaaaaaatatagagagaagtggagggggcagaaagtgttttgcgtatctaatggtgagggtgaggtagaggggactttgtttttctattttttctaaatcatttaggtcaaaaaccaattatcatgtattttgttttttaaaatcttttttaattttaaagtcatcataatgacttaaaaaggtaatattagatacacctatttaagctggacgatttaactggagatggcttggttcgaattagctacgtaatatcacggtaaagccatgcaaactgatttaattagctgtatatgttatattaccgttaacctccttccacaaatcatgtataatacactaactaatttaatttgctatgtataatcttcttgttaatctcctagcttccttatatatatatattgccgtgcatataataaatatagctatgattagtagtaacacaatatgacagctaattaatctcaacttctaacaaccatagttactaatccttccggcaaaccatacatatgtacgggagaaaggtagatttaattcattggtataaaatagcgggtccaccaatttaagtgaaaatcaacggcaggtaaagatctaatctaacggtataaaataatgggtccaccaatttaagtgaaaatcgacggtgagattatattgtgccacatggcggcctaagagtatttgtaggagctccacgtggcggcttgagagcgtttgtaggaagtttaatggacttttagtatataatagatagaagatagatagatagattacgatgtcatgctgtaagcccatctagattgtctataatttatatctattaagatcaaactattgatatcattaagagttctgtaaaaaaaaagttagtacatgtagctgtgctcgtctagaaaacactaccgtcccaaccaactagtcttgaggtatgtgtgcatgatgtcccaacgagcgcaacgcgtccctttttaattataaataggcctagcccgttaatatatgagcttccagtctatccttaattatataggatctgacttgttcaacgtacgagtatgtaactttctctactatcttaaaagcggaattgtcttactcctgtctcctccttccaccgcatggaccgtgctcgcatacctagagtaagtaggtaaccactagattaaatattttatttcaaatcaatcttatagactatcgatatttatatggatatgacctgttacaacttagggatatgttactaagtcattttaaaagcacaataccaatgtgtgagtgtgacttccctctcacagtgatcatcgacggttgtgcgtcggtgggtttttttttttcaaaggtttgtgcgttaaaaagttcaaagtcgtatctccggttattaaacatctatcatttgcctatcattttctaacataatctattagcccaagtgcggaagtgccccgttgctgcgggcagttctcgcaagacctatcgacagaaaactccggtccaaaatgtcattctcatagtttatcagtggttgaatgtattagaagcaaacaagtttttcaatgtatttaatagttcaacggaaaaaatcagagctttccacatcactccgtaggtctaataacagcataattgacaacagtgacaattcatcatgccatacatcgtgatcactcctgacttttattatccactccggtcagtttcaatttctaagaaataccatcttattaattctaattacagccacaatggtggattcaataaataataatatactgacgtgatgcagtagggcatccccacgcatcaacctcatatgtaatatctagaagcattgtacacgactgaactaaaaattcaggattcatctcggcacaagctctgtgattgacaaatcattcgaagacaccactgttgaattatcagaatacccggaatgtcttggtcttggatagcgttctgaatacggattagagctgtcactggcactaacctcctggatgcagaacgccggcctggatagagaagggagacgaacagtgttgctgctaagcatgatgtttactgacgaaatcgtcggcctgcttgcaggttttttctgaacacacaacaacccgatgtggatgcacttcaacatctgctcgattggaggatggtcgcccatggatggatcaatcagctctacaacgtttccccttgtccagtgctcccacacctgcaccaaattggttgatctattcaagtaatatatatgttgagaagtttggttaattattcatgaacaaacttgaagtactcactaggtttaagagatcaacatcttgcccactatcatatgagccagtgtttcttcttccggtgataatctctaataccaaaacgccgaagctgaacacgtccgatttgattgaataattaccacgcatagcgtattctggtgccatgtatccactgcgacaaagaacattacattacaacctagtattatatttgttaccttaattttgataaatgttgaccatgatcatgcttactatgttccggcgattcgattagtgacatcttctgattgatcccctccaaatatctttgctaagccaaaatcagaaatcttagggctgtaatcaaagtccaataggatgttgcttgctttgaggtcccggtgcactatcttcaattgagaatcttcatgaaggtattgcaagcctcgagcaatcccatttataatcttgaatcttttcccccaatctagctccctgttcttgtcggtatctgaggctcaaacaagaaaaaccatagcattgtaatgtaactaataactctggcggcatttggcactagtataattgttcttttttttcttttggaaaaactactagtgagaaaaccgtaccgaaaagaacgatatcaaggcttccatttggcatatattcatagacaagtattttctcttgctgctccaagcaaacaccaataagccttactagattcttgtggtaaagcttagcaaccaaaatcagctcacttttcagctctcctattccttgtctggaactctggcaaagcctcttcacggctatttcttggccatcaggtaggactccctatccaagtaaagatacttactatataaccaacaaaaatataactgataaaggtacatgtggtatgattttctaccttgtaaaccataccaaatcctccttggccgatcattttagtatcagcaaaatcatctgtagcaactcgtattgttggtagatcaagtataagcgaatcaatgctctgaatatcgtctgaactaactgaatctgttgggacaaagatgataaacaagattaagcttatcaagaagtctggtttcattcattcaggaaaaaaaaaaaagggaaatatgatttcactagaagccggggacacagcttggcattaagattcaagataatgaaaataaataaaagcaaactattttcaattcaaccaccaattccctgccggtcaacaaaacttatccatttcttgctgtgctaacataccataatttttagcagacttacaggacagaaacgtctgttcttctggtcgtctcttcttgatcctcttccagcaacaaaagcatgctacaaccatgagcagtattgcagctattgcaggcataactatcgctagaactgtaccaatcctatttttcgttttctctgcaaataaatacaatccgattcagaatttcagaaagtgtgaactgcacttagagactgtatattttgccgtggaatttccacgaatttccacgaaagagtcatagttggtctttttgcaagattatctgcaattaattaatctgtgtgcctttcacacccaaaagagaaaagtggtttgtgttgctcacctccactggtcgccgatggcgaaggcggcggcggcggcgtctccacgaacgccggaagctgcagcagcgggcggccggagaagaaagggaacacctcgtaccggaagttgcaccacaccccgaacatgccccctcccgtcctcccgctgaattctttgggcagttgcccgatcaccgtcgagaggcaggtccggcagacttcgggcgtcttgtccggcgtgcactgcgccagcgcgtagatcttggggcggtcgctgtcgccgtcgacgccctcctcctcccccgtgccgtaccgcctcgacgagtccgccgccgcgtagtccgcggtggcgttgacgagcactgcgacggccgcgtcgaacgctgccgccgccgcggcgcccacgcggcgggagcgctggagggtgtaggtggtgacgaagtagtcatcgtcgaggaagaagtcgcggttggagtagcggagctggcagaggtcgtagaagacgagcacgtccttgacgagcgggcacctccgcggcgcgtcgcggagggcggccgcgacgcagcgctcgcaggcggaggcgttggcgtcgccgcggcacagcgcgaggccgtacaccttgtcggggacgtcgccgacggtgcccgtggcgtacatggccggagacgaggaggtgttcttggggagggtggtggagaggaggtcgaggttgacctggtacgtgccgttcttcgagtagttgccgctgggagggtacggcccgcacaggacccatggcggaggctcgtcctctccggcggcgagcggcgcgtggaggaggacggcgaggaggaaggttgcggcggcggcggcgacgccgtcgaggtagggacggtggcggcgcattgtgctggcgatggtaatggtaagttgtcacgaggcggctagtgtagaggaggttcgggaattcgactagtcgagtgataggtggggacggagtgtttgaccggagaaagtggtttaggcacatcatttgttttatataaaatcaacctctattaatatttaaattttataacttaattttaaatttgactttaattagtttcttcgatgtttatttttagtattagcttttaaattaccccacgcatatatagaactacaacatgacatcctacatggagaaatttgcatatagaccatccataagaattggtttcgttataatatcatcgtcaaaatgggattagatcaaatgccactctcaagcaaggggtattcgctaaaatatcattttcatcgtttcttgcatttccaaattatttttcctcaaatttattttctctcggacatttatgcccctagatgaataggttgaaccagaccacatttcatccctccattgtgtgttctagaaccgagtaagcgcgagaggagaccaatgtaacgtgtcgtgatagaagcacccatcggagtaggccgagaccatgatcgcccaggtgattccgctcttgtctgacatttcgttgaacacctggcacgctgcctccgtgtccccaaacaccgcataggcgagcaccagccggttggtgagaggcaaagggaggccagagacggcgaagttgccggtgcaatccttgaggaaagagacataggagtcctcatcgggcaggagccgagcgcttactcggtgaagccgttgtgctagtagttagtttccttctttcgtcttcgccacgcgcggtagaggaaatgacaaggccgttgttgttggaggtggtgggacggggaaactcagacgcaggtgtaggggcggtggcggtggcggtggcggtggtggtttggtcggttttcgcagagtcggcaaccgcaacgctcccctagcggtggcattagtggagagatggcggcaacgaggagagaggtgcagagccacagcggtggtaacgccgaatggcttggcgatggaccaatgtgccatggatgtgtgggttgaggcggtgaggctaccagcgagcaggtggtgggcgacaccggtgaggttgtgcggttgcaattgcaaactctcctctcgagcttgcttggttctagaactgagaatagggagatgaaatgtgatctaattcgacctattcatccaggggcatacacattcgagaaaaaaatcgaggaaatataatttggaaatgtaagaaacagagcaatggcattataacgaatgcccttcgtttgagagtggcatttgatcaaattctattttaatgatggtattctagcgaatctaatttttttagatggcagatatacaaatttctcaaggtgcggagagtgaaagggagagaaaaaagatgaggaggagacattcaatgttttctgatgcgacaaatttatggagccttttaactttacagagcataagcccctcaactccgtgacaaacaagcaagttttgtggaaaagaaaatgatcaacacatgatgacaaaaaaaaaagatccaagtgtaatctctaacgaaaatgggccttaaaaagactaggtaagtggcttggagaaaatctcatttcggaatttgccaaaatatcgctcagctcatctctcaaccagtgtgtcatctgctgctctcttcgttctaaaataagtacaccttattagttcaaatttaaattggagtgtgtatttattttagaacagatggagtattattttttttcgaattgatcttaaatcttaaatcttgcgtagccgccagtcccgccaaacaaaaactactctatctactcctgagcatcttcaaataatacaattacaatagtactgcagggaagcctcgtagtctctgttttttcctccttgatcttgacatctctgcagccctttcagatgctacatcgaagacaacgattggtcatcgagtctggttggcgtatatttttcatttttatcaccgtgcgccagggttcaccaccctcggtaacgagcgatattttgtgattctgcagaagccgttggtaaaccaataaaaaccgacaaaatctaaaaatttcttatcaaacaattaaattttagtttgattttttctcccctataaaaactgagctatttgtattttgacccggtccagaaatccggatttcctagttatcctttgcttttgtaaatcgtgaggacgcctactccctccgtcccataaaaaaccaagctagtattgggtgtgacacattttagtactacgaatctggacatatctatgtcaagattcattgaactagaatatgtcacatccagtcctaattctttttttcgggacgaagggagtaatggcctaggtatgttaaagctcagccgttggtgcgattttgaagaggtttttttttttcatgcgcaacttacgacctagttgacacaccttcaactctagctccgtctcttttggagcatgagtttaaccaaacggtttcaactttcaactctaaaaaaagaagtgaatcaagttgaagtggtctcacaaaatgaataagtagagttaagtttagacagcttcacaactacagtctacacttaaaatctagagttatattagccataccaaacgggccattagtccatcaaatttcatctgagattcaatttaatatccaatgtttcaatatataaatttatccttttcgaatacatctaaattcacttgtgccacctcgcgaatcatggttagttattattgccccttattcgcatcaattatgaaaggagaaatgaagaataatatgtgtgacctgggcaacggggatcaggtttattcagtttttcaaaatattgtttccttttgctacgttaatgaacaagggatacaatacaagagacctatattcattaatggagtgttgactagaattggtcaggtgacatctcagtttcgtcccaggatgatcttaaaccagaattaatactttctcttttaaaaaaagaattaatatttgtgagactcaaaataaacaaatcaaaatgtcgactaaattactctcttaagagagtctcatgaggaactcctaaatttaatagtggtgctcgtatttacggctaatttttatttcagtggtagacgatcgtgataaatcttaagatatattatctcggtcttctgaagatgctcctacaaataagttgtgcgtttgttcatatggacgagtgcacgtgcattgtgggtcactgtgtttgttctgtgttaaaaaaaaatttactactctctcaagagagtctcgctggctgacgggcacgtgtctctctctagtcaacacacaattctagttagtcaactccctagccccaccgctcttctatttcctctgcaactgcgacctttcctcgagcagctagaccaccatggcgacggcggtggcggcgacggccatgcgacgcgggcaacaccttcctctctctctttctctctgctacaacctcgccgcagtcgccctgctcgtggcggtgttcctccacgcgcctccgcgcgcgggagcgcagccgctgccgtggcaactgtgcaacgccaccgccggcaactacacggaggggagcacctaccaggccaacgtgcgcgcgctcgccagcgccctccccgggaacgcgtcgtcttccccggccctcttcgccgagggcgccgccggcacggcgccggacgtggtgtacgccatcgcgctctgccgcggcgacaccaacgcctcctcctgcgccgcctgcgtcgccaccgccttcgacaccgcgcagcagctctgcgcgttcaacaagcgcgccaccctgttcaacgacccctgcatcctccgctactccgacctggacatcctcgccaacgtcaccgacaacagcgggaggttcgtggcctggaactacaacaacgtcagcgcggcgaaggcggcggcgtacgacgccgcctccggccggctcgtcaacgccacggcggactacgcggcggcggacccggtgaggcggttcggcacgggggaggtcgggtccgacgacgcgacgtacccgaggatcttctcgctggcgcagtgcacgccggacatgtcggaggccgactgccggagctgcctcggggacataatcaggaaggcgacgcccaagtacttcgtcgggaagcccggcggcagggtgttcggcgtacggtgcaacttccggttcgaggcgtacgagttcttctccggccggccgctgctgcagctgtcggggccgccgccgccgccggctaacatgacaccaccggtgaccagtgaaggtgagttgccgaaacagaaaccacacatgatcgctcgtcggatactcggatgtcgctttctgcttttctcttttttttcctagtttcgctttaaggactggtttagttcctaactttttattcaaacttttaactcttttatcacatcaaaacttttctacacacacaaacttccaacttttccgtcacatcatttcaatttcaatcaaacttctaattttagcgtgaactaaacacaccctaaattttactacctccgtcccagaataagtgcaaccatgagtttccgcgtccaactttgatcgttcgttttatttgaaatttttttataattagaagttttgttgttataagatgataaaacatgaatggtactttactcgtgacttatgttttttttttcaaaatttttttaaatatgacgaatggttaaagttgggcgcaaaaaaccatggttgtacttattttgggacggagggagtataatggaatcgctgagcacgaggcgcatcaattttgggtagacattaagtggaatcgcctccaacttaggacttaataatttggagttgaaatttagtccttgtttagatcccaactttttttctcaaactttcaatttttccatcacattaaaacttaactttcctacacagataaactttcaattttttttttaaactttcaattttagcgtgaaactaaacacacagtaagtagtaacgaattgaccatcaaatcgccggcaaaattcctgcttattatcgtttatctccggtgaggcggggaagaactactactggaaaatctcgtgtaatcgctggggtcctgcttctgatatttgtcacctagttatatatcatgaccaagatgaaagcagcctttcttgaacgtacagtactcaactgctaataaagcggaaggttggggaagaagccaagaaggtgagattggtcaagatcgaggactaattttcaaggttggctacgaagcaggggtaggtggctcaggcggccatctgtgctacgggggcggtagagacagctgatgtcacaaacgcgatgatccacaggaggggtattgatggccaaaaggcccaggcccgtcagcctggctcagggcacggagttttggctcggcccaggcatggcccgacctgactgatgtcgagcctatatggccggcccaaccgttgggtcgtactttggcctctgtcccggcacagtacagtccaataatggggaggaaaaatagacttatttagtcatataagatatagcccaaagaaataagggatgcaaaatagacttatttcagctataaaggacacggcccaaagaaataaggacaaatagacttattcagaggaatacagtgggcttccgtgcctccgggctagcccaagccttattgagccgttagtgcaacccgtgggcaggcccggcctagcccgtcatgtaggtcgggtcgtgttggcctgactgctctcgggcccaggcctagttgtgcccgggcccatttggccatctataggtggggtaaggttgttgggcaattgaagatgaaacttagacttcgattagaagttctgcattatagtatgcatttgtttgaccaggcttcaggtacttgatcattgtttgatggagttagagccaaaccaaacactactaatcctcaatgtttttaagagtatagtaggtgattagcttcacaaaatagatagcaagggtagggctcagcttcacaactccagctcaatattagatttagaaccctaccgaacatgccttatgtatctaacacaattactactttaagattcgttttattaagccccgatggtgcaatggttgagttgcaggggtttatatctttgtgccccacaaatatcatgtacatgcgagtgcgtttttaataggaattctatcgggttagagatgtctcgctgattcccgtttcttaaaacatgtgttaggagtacactgatgggtgtgtgagtcagtgtgacgtgcgtgacggtgtgtttgtatcttccgtaaaaccgagaaaaatgtttactacattcttttaaaaagaaagagaaacattaagcataaccaatcttagtcgtactaactggtttcaaactaattcaacgatctctattgtaggaaaaaaaactttttttgaattactgtacttcctccatttacgttttaggatgttttggtctctttatatatctctcgtctatattcaacacctatatagtaatgtggaagagagaagataaggaaaaacttttacggtgtagacgaaacagttatttgcactttgctgtggtccatgactataacaccatccatggatacatttacattttattgaagttctcattttgaaactagccaataacccgtgtgttcagagtactttgtttatatatgcttatttcacttataaataatttagttttattaatactttcaaatttaaaactggtacttacaaaactgtacatgcggaggccatatggattagtaaattaaagttgtacatgtcttgtattctaaatttaattagtatctcattaattcgattatgaaaatcaaaataaataattaaggaacaaaactgacatggagtcatggactactttttataatctaagttattataattcatttccacctagatgatagccagattttactaagactatctaataattataagatttacttcggtctaacaaaaaataccttgagatatcggtacctcataataccaaatcgtttccgatcgttagatttaagaatgcctatcatggctagctagatccaacgatcggaaacaatttagtaccgtgaggtactagtacctcgaggtactttttcttggaccgaagcgaatcctaataattatacgcatgatttgtttgcactttgcaggaagaacaagccatagaacaggacggatcttggccattactctgcctattgctggagcagcattagccttcattgccttgacatgcttttgtttccggagaaagagaacaccagcaaataaggcctcatcactgccatgtaagtcctcttgcttcaggatattgtacttgtaacctgcaataatacagttcctagaatgtgttctttttccaaatcctgtgagaactttaagtgttcttttcagttaaatccctatgctcatctaaggccttacttggtctggttacccttggaggtagggaaatggccctttacttgataaaacatttttttagagaaaatctcattaggcaaagttgattatttcatttagcgaagttcgtagtgtactaaagttaaacaatcgatggcatttagtttaactaaattcgttgcaaagcaagctagctttttttttttttttttttttttggcgggggcaaagcaagctagctttgcaatatgagtcatcgttcacctgttatcttgctacagtctcaactaatccggatgatattcaaagcatcgactcgctccttctggacctatcaacgctacgggctgcaacagacaacttcgctgacagaaataagcttggcgaaggagggtttggtgccgtttacaaggtacaaatcaaaccatatgtaacccttgttcatctttttattagaaagtgaatacattcgtgttcattattaacaagtttatctatatattcatgggagtggattataatccctcaaggggatatcccctcgtatacctttttctttcaaattcgatgcaaatagttgtgaaaaattctgaaaaaaattgacaatgtagagtataatgatacctactagtccaccaaaattcatgttcaaattcaatctacacatcgagaaacaaaaagacaaatttagatataaacagtgcactactattcatacgctgaatttgtcttttttatatctcgacgtgtgagttgagtttggataagattttgtgaagttgtatatatatgttgtatgaatgttatcaaatttttccagaatttttcataaccgtttagatggtttttgagcaaacgaggaaaatcccctcgagggattagaatagtttcccatatattcatctgtacacagggagttctttctgaaggtcaagaaatagcagtgaaaaggctctcacaaagttcaagacaagggatagaagaactgaaaactgagctagttttagtcgcaaaacttcggcacaagaaccttgtgagccttgttggtgtttgcttggaaggagatgagaaactacttgtgtacgaatacatgccgaataagagcctcgacaccattcttttcggtacaatcccctcactgcctttgcgaaatcgaagcgttcctctttttcatacatgaaagagatacatgcatacataccattacactataggacttgatgctgatttcctttgtgtttgaatggaagattatgagaaaagcaaagatcttgattgggggaagaggctcaagattgtaagcggagtcgctcgaggcttgcaatatctccacgaagattctcaactgagggtagttcatcgggacctcaaagcaagcaacgtgctgctggacttcgatcacaacccaaagatctcggactttgggttagcgaaactgtttgagtgggatcaaacgcaagacgtcaccagtcacattgctggaacatagtaagtatatatatatcccctgcaattccatggcacggtattatgaaagtaggtacaggttcattacaagatcatctcctattattttcagcggatacatggcgccggagtacgccatgcgtgggcagtattcagtcaagtcggacgcgttcagtttcggagttatgatcctagagattgtcacgggaaggagaaacagcagcttctccaactcggagcaatccattgacctcttgagtcttgtgagcatcattaatctctgctcctcctcattaccatgagacctgatcaatcaaacatgatacgaaaaccatcttcttaattgaaaatcatcctgacaaatttatcctgattatgcatgcaggtctgggagcactggacaacggggacgatcgaggagctgctggatccggcgatgcgcggccgttcagctgacgatctgctgaagctgatcaacatcgggctgctctgcgtccaggacaacccggcggacaggccgacgatgtcggcggtgagcgtgatgctcagcagcgagacgttctccatccaggccccgtcgaggccaacgttctgcatccaggagacggacagcgccgccgacacggatctctactcgagcgcgcttcggtccaccggcgacagcaagacgagagcagtggcgtcgccgaatgaggtgtcgctcaccgagctggagccaagatgagtgtttgttggagcgatttgtgcagatgagtagatgactgcatgatcttcttctcaataactaaagaatcaactcatgggtcatggcctctgcactcgtttgtctataataaagaatagataaaaggaagtgtcatagtggttatgcagaatgtaactcagtttgatactggttgtaactctgcaaagattgttcccacctgtatattattatagttacaccgtccatgtcgattacagcaatcagaataattacacctgtatatggaatgccgcatgttagagattgtaccgaatacgtgtatatgacccgtccctcgagacgtgcaagataaacgaccgtttggaccctagatattagggccttcaaaaaacccgtatgtttcactctatgctaatgtgttatggcatatttaaaatctcttcactctacttttaaaatagagattttttatcgtccagcagaatgtaccgagtggtactggtatcggtcggtacggaaattcatccaaccattgaatctgggaagggtaggatcgggagagaaaataagctagggtgcgctcggtcgatgactatccttccacacgcgccacagtctttgttccccacgcgcgtgtgcaccgccgcctccttcatcgcgcctcacccgtggcctactccggcaccagctagtcctcctctactctgccgccaccggagcggcttctcggtcgccgcaaccacatactccgtcgccggctcatccgcctctgcctccactgtcgctgatggtgcggaggccgatcttgcaacactgaaggagaaacacgacagcggcagggcggaagaggaacacggtggcggcgtggaaaagggacatggtggcagctgatcggaagagaaaggcggcgacgcggaagaggaattctagggttcccgtccattcctcccattcattgcacgcgaaattacatttttttcccttccacctctgttctccacgaggtactgcaccaaggacagaattggtacctcgcggtaccaaactctaccagcttttggatcgggccagatccaacggccaggattttggtatcgaccgctgaaccgtaaagatgctctttaaagtaacaacattgtgaatgtgtgttccaagcagtaaggattcctaataagtgcataaaatttttcttatatttggccaggtcgtcacctcaagtagttaggtgagtatttttagcatagctctagcacatcgtcgacattatatataaggtctcactttatatttagcccaggccccagattcttaaagacaacactgtgtagcaattgtatggggtagttatgccttcactaaaagatcgagccacgtgagatagtgtcgtaggatcaagataggtttagtaatatgtcaagtgcactattgttaatgccatattacgagatggatggagtaatttatctatagatgagaatggccttccggcaattctcaattcctggtgcttgaaggttgcgtgtagagtagatttttttttcgggcagtgtagagtagatgttgtcaagttaggaattggctttagctcagattaggagtttggttttgtgatcttgttagtgaaaaacatcatgcaccccctctctctcttagtcctgttagggtggctcaagtgccctcgggggtggttgtgttcctgtcgtgtttctcttccttgtctttcctatgtttttttctcttattctccagggtttctgcgcttgcgtagtttgaagctttgtcttgtgtaaaatcgtttgacgtaatatattcagaaggacattttaccccccgtgacccgcctaaaaaaaacaatcttgcaactatatgcagagctccaaccaaccatcaacgagggcatttatttattattatcgacaaacaagtgcagaggccacacgtgttgattctttcgttattgaagaaaaaccctgcggtcatccgcacaaatcgctccaaattcgaaacgctcatcttggttccagctccgagagcgacaactcattcggcgacgccgccgccgctgctctcgtgttgccgtcgccggtgggctggaacgcgctccgggggtacgctcccgactcgtagagatccgtgtcggcggcgccgtccatctcctgaatggagaacgttggcctcgacggggcctggagggagaccgtgtcgctgctgagcatcacgttcaccgccgacatcgccggcctgtccgccgggttgtcctggacgcagagcagcccgatgttgatcagcttcagcagaacgttcactgcacggctgcctatcgccggatccagcagctcctcgatcgtccccgttgtccagtgctcccatacctacatgcgtaatcaggataaattcttcaggatgatgtctcgattaagaagatggttttcgtgattgatcaggtcatggtgatgatgatgaggagcagagattaatgatgctcacaagactcaagaggtcaatggattgctccgagttggagaagctgctgtttctccttcccgtgacaatctctatgatcagaacaccaaaactgaacgcgtccgacttgactgaatactgcccacgcatggcgtattccggtgccatgtatccactgaaaaataaggagatgatcgttaattatactttcatactaccgtgcgatggaattgcaggtccacttagtacttactatgttccagcgatgtgactggtgacgtcttgcgtctgatcccactcaaacagtttcgctaacccaaagtctgaaatctttgggttgtgatcgaagtccagcagcacgttgcttgctttgaggtctcgatgaactaccctcagttgagagtcttcgtggagatattgcaagcctcgagcgactccgcttacaatattgagcctcttcccccagtcaagatctttgcttttctcataatcttccattcaaacaaagaaatcagcattcgaatctatagtgtagttgtgcgtgcagatttttcatgtaatggaaaaaaaaatgttccattttcgcaaactgttagggcagtgagagaactgaactgtaccgaaaagaatggtgtcgaggctcttatttggcaggtactcgtacaccagtagtttctcgccttcttccaagcaaacaccaacaaggctcacaaggttcttgtgccgaagtttagcaactaaaactagctcagttttcagctcttctatcccctgtctggagctttgtgagagcctttttacagctatttctcgaccttcgggaagaactccctgtgcaagtggatgtatatgtagtattaataatggaattatggatatgtattcatcatgaaatctctattagtgaaaagcgaacctcagaatgcaactagtatgagccacattcatctgattaatattagccgtcagattcacaaagtgacaaaatagataaaataaatgatagccttagatgaaagagggtattttagaattttccgacgctccttcaatgtagcaaagagataggaatagtagacactagagagcaaagaaataaagaaaaagagaaaaaaaagttgaaccacatgctacagcaccgagcttgggcctatgcccagttaattgagttagctgactgactgacgggtgtaaaatttatatgagatttgttttttatggtccataaatgtatatgagatttatttcttatatggttttcttttgaaagataaaatagcactaattgatcccttgtgaaaaggggatattaaacatcccaacatctatctattatattgttaaaatagctttgaaaggaggcaccacgttcgctgtgggagctagaaattcccacattaatcagagaaaaagaaaaaaagaaaaggagagtccaagtagaagtacaatttaaaaatagctgaaattcggaattaaaaataagcaatattgaaaaaagtttccatataagaacccaatatgagattaatcaaaattcgaaataaaaataaaataaaatccaaaataagaaaaggaaaggaaagtccaagtaaaaatacaatttaaaaatagctaaaattcggaattaaaaataagcaatattgaaagaagccaatacgagattaatcaaaattcgaaataaaaataaaataaaataaaatccaaatttagaaaaggaaataagagtccaagtaggagtacaatttaaaaatagctgaaattcgaaattaaaaataaggaatattaaaaagaagagtccatataagaacccaatacgagattaattaaaattcggaataaatataaataaatccgaaattagcaaaagaaaataaaagaagagttcaagaagaaatataatttaaaattagctgaaattcggaattaaaaataagcaatattgaaagaagaatccatataaaaacccaatacgagattaattaaaatttagaataaaaaaataaaataatatccaaaactagaaaactaaaagagagttcaagtagaaatataattttcaaacaactgaaattgaaaataaaaaataaaaacatcgaaagaacacaatacggtattaactaaattttttttaaaaaattctgaaattagaaaaaaaaagattttaattaggaatgcaatttataaataactaaaatttgtgataaaaataaagattattgaaataaaagactatctaaaacacgtgacgagataaattaagtaacatgcctataaagaagtagagtggaggcggttgatacgacatataaaaattgttaataaaacaccaaatagaatcctaatgacgattaaaaggaggaacatcaggtaggccgtgaatcaaacgagtaaggcggttgtcgagacttctataaagtaaaaaaaaaacacattgatcatcatattcgatttttaaaatctcagtgacaataaaaaggagaagcagcgggcagggtgtataagagtatagttgcagagccgccgacggttgacaggacttctagaaaataaaaaaatgaattccaataatagttatgtttgatttttagaatcataatgacaataaagagtaggcagcatacgggctgtagaggggcatagtggcatcgtttgatgggacttctaaaaattataaaaaataaaattacaactccaatttttaaaggttcggaacttctaaaaagtaaaaaaaaccaatgataatcatgttcgattttaaaatctcaaatctcaatgacaataaagaagggaggcagcgggcgagccgtagaggagtacagtggcaaagccgctgatggtttagcaggacttctagaaagtaaaaatgaacccaaacgataattatgttcgatttttaaaatctcaatgacaataaagagaagagacagtggacgggccgtagaggagtataatggcaacgtttgacgggacatctagaaattataaaaatgaaacccaacgtgacaataaactctaaaaactataaaatccaatttttaaaggttccaagaagaatgaatagaaatagtggtatatcaagcaagaaaataaagaaggagaagacatgaggggtagtaactggtgtgacttttaaaaactatataattataaacatgaggatgataaggtttggtctttcaaagtcttaaaacaatgagatagctatttaataaattttaagtaaaatcatactaaaaaaatatatgattttgtttaggtgctagccgcgcaattgcgcgggccacccagctagttaataaaaaaaatcctagatctctgcatcaagtacgaataacaagaaacttatactttatcaatggaaagtaattggacaccactaaattttacgtacacatctctattcatggatgtcatttggaaaattgtacttctcatctacgcagtcagtctacaaaaatatggaatttccaaacgataggtgtgattttggaacaccaaataattccacctcaatgttaaagtggatagatgaagtacataggatcaattatatttgtggacagataaagtacatagtttataatcggacacgtgaaccggccacattacaaatcagaatatacatgttattgttataactacgtttcttgcaaagtatgttctacaaacacttattttagttggttactataaataatattaatatgcttcactaagggatattatggtcgcgtaaatgcatgacttaataagctagtaaaaagatgagcacacgtgcaggtacggttggatagtacaatttgattggtataccttgtaaacgataccgaaccctccttcgccaagcttatttctttcagcgaagttgtctgttgcagcccgtagcgttgataggtccagaaggagcgagtcgatgctctgaatgtcatctgggtttgttgagtctgttgcaagataacaggtgcacaacgactcatatatattgaaactaattagcccgctttgcgataaatttagttttttattcaaagatttgcaatgaatttaggccgagtttagttccaaattttttcttcaaactttcacttttccatcacatcaaaactttcctacacacataaactttcaacttttccgtcacatcgtttcaatttaaatcaaactttcaattttggcgtgaactaaatacacccttagttaaactgaatgccgtgggatgtttaattagtagataatgaacttcaagaaatgaaataattagtttgatctattaagatttccttaaaaaaaggttttacctagtagaggacattccaggctaaccggactaagtaataaaacctaagaattttaactgaaaaaaacacttcaattctcattggattcgaaaaaaaaaacgttctaggacgaaccttacttgtgatgctttaattagattatagataaaatatcctgaagaaggacaacttacatggcactggtgaggccttccttgcaggtgttctccttctccaaaaacaaaagcatgtcaggacaatgagtgctaatattgctccagcaataggcagagtaatggccaagacacgtcctgttctatgtcttgttcttcctgcagacaaatcatgcatgtgagtattaagtaatttctcacgttgattagaggaaatgtaaaaacaatctggatatcatctaggtggaaacgaattataatgacttggattaaaagagtagttacaacttgcttttatttttctgcaacatactactaaatttagaatacaagacaagtacaacttcatatttactcatccatatagcagcatataattttgtaagtacaaattttaaaattggaggtattaataaaattaagtcaaatgcatgtgaatacatgggttatagtattgactagtatctgaaatgagaacttcaacatggaaggagttatggtcatggactactgcaaagtgcaaataactattttgtcacaccattcaaatttccgtgttaaaatatttcaaagaaaatgtttaggtcttataatagggatcattgaatagtttgaaacaagttaccactgattgattttttaagggcatgtttggggaggttatgagagtcagagattcttctagaagctgctattactagaagctgcaccaaaccgtctagattttcactcagacggtaagaagttactttttctcttcttgaaagaaaaatatgagaattgtaagcgatatcactgaatctctacgcacccaaaactgatgccaaaagaaaatggaagcaaaactgcaaacccagaaagggacgctgaactcacctcccatggtccccggtggtgatggtggcgccatgttggccggcgacggcgccggcgccggcggcggccccggcaactgcagcagcggccggccggagaagaacgagtacgactcgaaccggaagttgcaccgcacgccgaagaccctgccgccgggcttcccggcgaaatactggggcacccacctgattatgcggccgaggcagctccggcagtcggcctccgacaagtccggcgtgcactgcgccagcgagaagatcctcgggtacgtcgcgtcgtcgaacccgacctcccccgtgccgaaccgcctgaccgggtccgccgccgcgtagccggccgtggcgttgacgagccggccggaggcggcgtcgaacgccgccgccctcgccgcgctgacgttgttgtagttccaggcgatgaaattcccctggccgtcggtggcgttggcgaggatgtcctggtcggagtagcggaggatacaggggtcgtcgaacatggtggcgcgcctgttgaacgcgcacagctgctgcgcgtcctggaaggcggtggcgacgcaggcggcgcaggaggaggcgttggtgtcgccgcggcagagcgcgatggcgtacaccacgtccggcgccgcgccggcggcgcccttggcgaagagggcgcgcgatgaggaggcgttcaccgggagagcgctggcgagggcgcgcacgttggcctggtaggtgctcccctccgtgtagtttccgccggcggtgtcgcacatctgccacggcagcggctgcgcttccgcgagcggcggcgcgtggaggaggaggaggaacgccacgagcagggggactgcggtggcgaggcggctgtcgcagggagtgagatttcgtcggcgtcgcatggccgtcgccaccgtcgtcgccatggtggtctagctcgaggagagagaggtttcggtggccgagggggaaaatacgccaccgtattgccactttgcaagtacgccataaatactcggaagaagaggaaaatatgtggtggaaacgataaatacagtggattaaaaaatggtgaatagctaaagtggtccttcaagtttcatacaatgatcagtttagttcttaatgtttcaatctgtccatattagtccttcaagtttttattttaattcaaacttatccttaaacccacataaccaataactctcatgataaatgacacttatacctcctcattcacatatataagagaaaaattgcatgcaataaattctttttatagataatgcatagcaatatatgtaaaaaaaaataaattatgtacttgcaagtgtatacggtagctattaagctcaagttttatatgcacatgttgaaataatgggacgtatttattcattttggttttttttccggtgtatagatgtatacaaattaagggcaaaagtgacattttctaaaagaattatcgactaaaaatagccatatggtatattaagtgggtacaaggatgattttaagccaaaacaagtacttagaggatctacgtggacaaaataaaacctgaaagactaaattgagctttcggtgaaacttgaaggactaaatggacgtttaagattcatccacgttattatgtgcagtaaaatttttactcattagtaaatctgtgagtaaaatatttagtcgggatgacgtggacgaatatcggacgcccatttttcgatccaacaatagtttctaagtttctactgtctacaaggtttccaccacgtattttcccccaaagaagagtggtggtgggccagggagttactgaccgaaattgtgcgttgaccagacacaattacgttactgcgaagggagacttaaaaggagggtaatttcgtcgattacatttcaatagggtctatttgagtctaccaaatattcattcttgtttaaatcatcctcggatgcaagtgtgactgagatgccggctggccaattctagtagtcagcaacgtcactaataaagtataggaaaattatagtcaaagttatgcaccccttgttcacatatgtaaacacgaggaaacataaatttgaaaacatattgaataaactcccaagctcactatccgattctctattgcctaggaccagaggcgaagccaaaattttctcaaccctaaagcttaattaaagtaatcatcataggttattttttcttttaattttcaaaatttggagtgttattttaatgagtatttagggttaggagtaaagctttatctctaactgccctactcctgttccgccctgtccatggcatttatcaagcgaagtacggtgcataggcatgggttcaaagtcaaactcaatcattttacagttttttcttttaataaattgatttatatataaactttatggtccatttatttctcttattcttgttatccctaatgatatggtttcactaactaaagatgacatattgtattatatagtcacgatagtttataatcctgtttcaaataagaaatgtccatcatggactctttcttataatattatttatttctcttatttttcgttggagtgagttgggaactaattccacggagtgacccaatagcatagaattaattaagtattagtattttttttaaaaaaatggattaatatgaaaatatgcgctagtgtgtaaattaaattactcctttcgtcctttctagaggatcatttggtactttggcacctattaaaaaccgaattttgctcctttctatatcagcttcaatggattttatcctatcaaaatattgtagcaatagacaatcgtttggcatgtgtggagatttgctcaaacgttgtaaacaagaacttgtgtcatcttccatccatggcgtttaaaggctgtggtactctgctagtctgctgcataagatggtcgggcaatctctagccaaaaaacaaaacaaaaaaagaagaagaagaaagaaaagaaaagacagagagcatgtcaaccatatctgatgaccattgacaaattattgcctttgatgtagcagctgaaaggacttcagagatgtcaaaatcaaggagataaaaacagagactaatcgctgattactagaaatatttgatgaccaggaactaatcgttggagtatatggctggcgggaccggcggctatgcaaaattcaagatcagaaaataagtaatactagatgccctaggtggacggtcgattttagttgagagctattttggcaatcattcgattcggagatgagtttttccaaggcaatttaaatgttttttctgtcctttttttttctttttcaaggattgtttccgttagagattaattagtatgattcacagaccacatgcgctggttgttttgacgacgttaacttttaatatatctttaaccattcattctattcaatctttcacaaatatgtaagagtgtaaatggtgcttaaaatacgtttaacaaaaaccaagttacaaaaaattaaataataattacatgatttttaataagatgaatggttaaacatatttttagaagtcaatggttttacatgttaaatatcaggatcagtacagtactataaatcgctaaaatacatagaatgattcttagagtggatttaagttgatttttcatattgtaggttgacatctaagctagctatgatgtgtactccgacaatatgctaccggcaacgacattttcttcgtcttcgatcaatcattgaattagggtttacggttagattaattcaaagcaagggagctcatcgctgactctagatatatttctgtcactgtttgattgctcgcatgattcgaaattcaatatttctgtcatcactgtttgattgctcgcatgattagagaaattaaatgaaccagcggtttcaagtcaaactctcaggtaggccaacctccgatcctctcgtgacagctttaccattgccagcacaatgcccgcggccgcggcggcgcaccacctcgccggcgtcgccgcagccttcctcctcgccgtcctcctccacgtccacctcgccgccggtgaagacgaacctccaccgtggtacctgtgcgacccctacagcgcgagcggccgctactcggagaacagcacgttccaggccaacgtcaaccgcctgtccgccaccctccccaggaacacctcctcgtctccggccatgtacgccacgggcgccgccggcgacgtcccggacaaggtgtacggctacgcgctctgccgcggcgacgtcgccgacgcccacgcctgcgagcgctgcgtcgcggccgccctccgcgacgcgccgcgggtgtgcccgctcgtcaaggacgcgctcgtcttccacgacctctgccagctccgctactccaaccgcaacttcctcctcgacgacgactactacgtcgccacgtactcgctccagcgctcctcccgcctcgtgagcgcgccggcgccggcggcggtggcggcgttcgacgcggccgtggccatgctcgccaacgccaccgcggagtacgccgcggcggcgaacacgtcgaggcggtacggcacggcggaggaggagggcgtcgacggcgacggcgacagcggccgccccaggatgtacgcgctggcgcagtgcacgccggacaaggcggcggacgtctgccgggcctgcctcacgacgctgaccaccgtgcagctgcccaagctctacagcggcgggaggacggaaggtggggtgttcggggtgtggtgcaacctccggtacgaggtgttccctttcttctccggccgcccgctgctgcatcttccggcgttcgtggaggcgccgccgccagcgacgtcggcggcggcgaccagaagaggaggtgagcgacagatggaaaccatttttacttgtttgcatgtgtgaaatcgccttagcgcatttgaataaattaatgcaaataattgaacaaaaaggttttgtgtgactccgttgactgcttgtagagttagagatgggagatgcattttcatcatttgggagcacattgcctgttttctgtacgtcaacaaaatagttactcctccactttagagtataagtcggtcttgattttgattaaagtcaaactatgttaagtttgatcaagtttctagaaaaaaaactagtaatattttataacccaagacaaatatattatcaaaatattcaatattaatttaatgaaactaatttggtgttctaaatattactatatttatctataaacttagttaaacgtaaagtgatttcagtcaaaacaacttataagttataatccgaaatggatggagtattattttttctaaaaaaaaagatatagtgccaattagcaatctggctctttgtgcgtttctgtcaagttttattgtcagaatctgtggaaaattccctgaaaaaatacacatgctacttgtaggcaaatggttttctttcattcaggttctggtcatagttctaactacagagatactatctgaatcgaacagtatttatttgcagagaaaaagaggaataagacaggtatagttctagccattgttatgcctacaattgctgcaatgctgctcatcgtcgtagcatacttttgttgttggaggaggagacgaccagaagaacagacgtttctgccctgtaagtcagctaaatttatgatatgttagcatgccaagtaattgataagtttatagacggcagggaaatggtgatttgtttaaatgttatttttatttaatttcatcaccttgattcttaatgtgtcccagcttgtagtgaaatcacatttcccttctttctctctcttttttttcttgaataagtgaaatcatatttcttgttaagcttagtctttcttttcatctttgtccaaacaacatcaattggttcagacgatattcaaagtattgattcgcttctactcgatctatcaacactacgagctgctacagatgattttgctgaaactaaaatgatcggcagaggagggttcggtatggtttacaaggtacaaatcatacagcgacatgcaactttatcagtcggttatatttttgttgatcagtaagtatgtttacatggatagggagtcctgcctgaaggtcaagaagtagctgtgaaaagactttgtcagagttccggacaaggaatagaagagcttaaaagtgagctagttttagttgctaagctttaccacaagaatcttgtaaggcttattggtgtttgcttggaacagcaagagaaaatacttgtctatgaatatatgtcaaataaaagccttgataccattcttttcggtacgattttctctccagtactccatgtgtttcttacactttaacttttttactaatcattttttagtttgataaaatttgtagataatataacgatatttttgacccaaaacaaacatattaacaaaatgtattcaatgctacaagtaatgaaactaatttggtgttgtcgatgttactaaattttatacacttgatcaaagctaaagaaatttgagtagagaaaaagttaaaacgacttgtaatataaaactataaaactaatgagtagtttcttttaaaaggcttaattgacaacatcaattattaatagtatgtttttttcttgtttgaatgacagatatagacaaaaacatagagctagattggggcaaaaggttcaagattataaatggaattgctcaaggcttgcaataccttcacgaagattctcgattgaagatagtgcaccgagacctcaaagcaagcaacattctattagactttgattacaaccctaagatttctgattttggcttggcgaagatatttgatggggatcaatcaaaagatatcactcatcgaattgccggaacatagtaagtagtaagtatgatatgttaggtttgaattttaacatgatcatggccaacatttatcaaatatggtataccaaatataataggttacaatgtaatgtttttttacagtggatacatggcgcctgaatacgccatgcatggtcattattcagtcaagttggacgtatttagtttcggcgttttggtactagagatcgtcactggaagaagaaatagtggctcatatgatagcgggcaagatcttgatctcttaaaccatgtgagtactttaagtctgttcatgaataattaatcaaacttctcaacatactacttgaataaatgaaccaatttggtgcaggtgtgggggcactggaccaggggaaatgttgtagagttgattgatccatccttgggcaaccatcctccgatcgagcagatgttgaagtgcatccacatcgggctgttgtgtgttcagaaaagacctgcaagcaggccgacgatttcgtcagtaaacatcatgcttagcagcaacactgttcgtctcccttctctatccaggccggctttctgcatccaggatgttagtgccagtgacagctctaatccgcattcaacagcggtgtcttcgaatgatatgtcaatcacagatcttgtgccgagatgaatcctgaattcttagttcagtcgccaaaccagttaagtgtacagtgcttctagatattggattgatgcatggggaggccctgacccctgaatcctgcattatggctgtaagcctgtaaatagaattgttaaaacggtaggaactatctatatattagtcggtagatttttttttctagaaaatcactcggattttataagcaacaggttggaaacgtattgctcagatcaaattaagcatgtcataggctgtcaaacactaaaaacaacataatgctaagaaaatgtcaaatctctagcaacatgccagcaccggagaaaacatcatacctaaattatttaacgtcaattataacaaaattacactgaaaaagaaaaaaaatacattctactacaactagtaatatgcccgtgctaatgcaactgtacatttttcataattaatgtaaatcaaaccatcaatacatgattatatattttgacaatataaatataaaatatttcaaaaaccgaatatccaaacaaagatatacctgtatttgtgcgcacaataaaggatttgtgtatatttggtttaataataattttatatactcataaacttattgaattgtatagacttttggattcaatcaccccatagacattattcgtaattcattcaacttaatttttaatttgtataaacttttagagtcaatcaccataactcattcaacttaattcaggcatagatttgtcaggagtatttatatatttggcattacacccaatgtattgaccttcatcgcaaaaactccagttcttcacttagagtatattcaattacaactttaaaacaacaacattgtggcagatatttttcagaatctaatgttgtgaacatttagtgtattatgtaaagggaatagtataaagggaagactttaatataattgagagctgtcaccacctctacacccacctcaaaccaattatgggatacgaagcaatcgctgaaaattaattatgtagacaacgcgtctacgtaattaacaactactctaatgccggccaaacactaaagcaatcactatattttactgaactatagtgaaaaatgatcccgcacgctaattagaaactaatcaagagttaattctcaacgagcaaatcttaagagtaaattacactagcggtccttaaacttgcatgtaacgaggtttcacttaagttcacgaacttgcaaaacgcatatcgagatccctaaacttggtttaatgtatcatcctggtccaaagcatcgtttgaccgtggtgttgcctacgtggcatgctacgtgaacgatgacatggaatttttttattttttctcccttcttctccctttttttctccactttgcctccttcctctcccttctgccccggcaaggctggcgagggggcgcggaggccgacggtggcagcgacgtcatcgataggaaggagaaggaggagaggaaggggaagggccccgctccggccggccgcaggcgcgtgcggcaaacggctgcggcagctgctcaagttcgacgagctcgcctcctcttttgcggagctcattgtcgggccttgccgccccattgttgccatcaagctcgctgccgccaatgagctcgcactctccccgctcgcgttgagctcaccgacgcctccccctacacgcgcggcggcggtcagcgacccctcccctaggcgcggccggcgatatctccccccgcgcgtgcctcggccgcttccgcatgaatgacacgccgccgcccaacgaagtgcgctgcccccctcttcgccccctccggtgccggttgcaaggccgcgccacccgctcctcaccatcgtcgtcatcttgggcggcagagggagaggaagtagagggagaagttgcatgtcgccgcagcaggaggagaggacccgcaggcggcggccgcctctccctctcctcccctttcggcctccgcccacgactcctctcctcccgccagccagcgcccgcactcgcgcgccgctcctctcctcgccggccgccgcccgcgcacgcgcactgctcttctcctcccaccggccggcgcccgagcatgcgtgccgcccctctcctcgccgtctgctgcccgcgaacacgcgccactcctctcctctagccggcgcctgagcacgcacgctgatcattgccggaaacctcgtccaccacgcgaggtaaggaaggagagaaaagatggggagaaaaaaaggaaaaaaagaaaatttagccatgtcatcgtccacgtggcatgccacataggtaagaccccggtcaaaccaggctttggaccgggatgatacattaaactaagtttaaggatctcgatgcatgttttgcaagtttgtgaacctaagtgaaacttcgttacaagtttaaggaccgctagtgtaatttactcaaatcttagttactcagaatgataattctactaaagcagagtaattaacaaagtataggaaatgagagaggattaccaacaactctggaattcctccgacttcttctactctactctctccctacttctagtatacaataaagtacaatagaacctcttataattcagctcatactttggtgtgtgtgagaatgagggaggagaagtgtatgtatatggtggaagtgccttgggaggatagagtttcttccaagcatccaatgagtatcttcatcctcctagtgccaagtttcccttctactgatggttagagtgacggaaacagtcacaaccgtcattgagagatcattatctgccgaactgaacttgggcctaggccaatggcctctgtcagggttcggccgagccctagccagcttcattggccccggttttcggcctagacattcattttaggaccctcaatccatattgccatggtagatgggaccatttgaaggtgtttaattggttttttgggtgcaagactccataagtttggatatgagtttgattctcctccttcttcacgtatattttctctcaactttggtagtttgtcacctatgtccaaatatacatcaacactcgtggaaattgttagaaatataccctatcactatgttggatgttttatgctttccattttatacatatattgacggcgtgaatttggtacttaacagccgtcgacagtgtggagggggagggatggatgggcggttgtgagacgcactaaacaacggtctatagtagttctcactaataaaatcgtttatacaccattaagtctactagtgtaaatggatatgatatatgagatgagataatacaaaatgtctacccttgagatcagctattgactcgttacgtggtgacttatgagcctggtctccattgttcttcgtaggtggcgtaccgtatggaaaatgctttggagagaaaaatcgggccctctcttcttactgtcacatatatacagataagtgctaagatagtttcccttctttcttttcctcactttaaatgtttttttcttctgaactatttatttgatttcaattcgatcacaggtaccgttatttttgttataattcaatttttacgacaagatatctcatgattatattcaataaaagaaaaaatatatatatttcaaaccattaaaacttaatgtttcatacgtgataacgacatgtttcatcatctgttttcactgtgtttcacaaaatttatttaactacttacacatactctttctccactccttgcatgcatgcatgcatatatgtatttagtgagctccaaaatgattttttccctaaactacttatccgatctacgatccaatcacaccattatatttgttgtaattaaatttttaaaataagatatcacatgattatgttttaatgaaagaaaaatatatgtttcaatctactaacacatgatgtttcatacacgacaacgatatgtttcaacgtgtgttttcaatctgtttcacacactttttaaatgtttcgatgatttattttgtttgttttaccatgtataacttaatgtttcaccggtggttaactgaaacatttgactgtctaattttttgagataagatcgggcgtccgattggaagtttataattagaagaaaaaattgtttgaagaaggaaactatggatcggtcatccgattcctaaaaaaatggggcagtcaaatgttgcagttgaccaacaagtaaaacattaatttatatggtgaaataaaaaaaatcaacaactgaaacatttaaaaattttgtaaaacatggtaaagatacacgttgaatcatatcagtactatgtatgaaacaacaagtgttaacagattgaaacatatatttttctttcgccaaaatatagtcatgcgatttcatgctttaaagatttaattacaacgaatacaatgaatacaatggtatgattggattgtagattgaataaataatttaggagaaataggtatttaaagagagaaaaaggaggaaaaaaaactaacttgtgatatacttgcatgcatgcagaaccggacacgtccgatttttattcatccaatcgggcccctatcctgagcattacgggcagctgactacgtcaaccctgctgaaaatatgaactgaccgacgacctatgggaggagaaaaactggtccatagcgaagaaccaatggttaatattgattgaaattaatccacgcactggatttttagatactcgaaggcaaaagaacacggaaagagatctaaacactcaagctaagctatataggctctggccgtgtttagttcccctcaaaattttttttatgtatatggacgcacatttaaagtattaaacatagaataataacaaaataaattacgtatttcacctgtaaactgcgagatgaatttattaagtctaattaatccatcattagcaaatatttactgtagcaccacattgttaaattggcgtaattaggctcaaaagtttcgtctcgcaatttatatacaaactgtgcatttggtttttttcgttcacatttaatgcttcatatatgtgtctaaatatttgatgtgacagaattttttgaagttcgaaggtaactaaatacggcctctgttcggaagctagatactgcggctcaacagtgtttctattgttgattcagttattacgatgtagtgctgccgaacacagccactccctctgccgtgaatataagggattttcaccattaaatttatcctaaaatataaaggagtttcacgatctaagacagtactatggacctgtttagagaagtttaagattctgagaagcagctggttggtagccaacttctgagaatctgcaaaagctgggtttctcagcttctggcttctagttccttctaatttattttatgtattctacaactacagcttctcagaatctggactaaaagctggactgtttgagggagcttcttattctgggagaagctgcggcacttgaaactccccaaacatggcctgtattccccatctggcatctaccaacttttatactagtttatttctctaccatctacttttatactaatttattctcccacctacacttttataatactgtattctttcacacatcaccttttatctcatcacatgtctttgtactatttccttattaattcttaaaagaaaaggtataatctcttgtagtcatggatggagattatggtcgtgtctagttcctcctccaaaatttttttaacgtatacggatgcacatttgaagtattaaacatagactaataacaaaacaaattacatattttgtctgtaaattgcgagatgaatttattaagcctaattaatctgtcattagcaaatgtttactgtagcaccacattatcaaatcatggcgtaattagcctcaaaagattcgtctcgtaatttacatacaaactgtacaattgattttttttcatctacatttaatgcttcatacaacacagcctatgtcacagtcttgagccaacctaaaattctagccagtcaactccttagcccgctgcactcttttagactaggagtagtatgagtattgtgcgtccatatccgctccgttttcgtcctataccatccggtcggcgagcgcaacctctcacctctgctcgaggctcggggagtaccaccatggccggtcatcgactacatcttactttttggtacaacctcgccgcagttgccctgctcctcgcgctcctccacgggccgctcgcggaagcgcagccgctgccgtggcagctgtgcaacgccaccgccggcaactacacggaggggagcgcctaccaggcgaacgtgcgtgcgctcgccagcgccctccccgcgaacgcgtcgtcttcccgggccctcttcgccgagggcgcagccggcacggcgccggacaaggtgtacgccatcgcgctctgccgcggcgacaccaacgcctcctcctgcgccgcctgcctcgccgccgccttcgacaccgcgcagcagctctgcgcgttcaacaggcgcgccaccctgttcaacgacccctgcatcctccgatactccgaccaggacatcctcgccaacgtcaccgataaccggggcatgttcgtcgcctggaactacaacaacgtcagcacggggaggatggcagtgttcgacgccacctccggtcagctcgtcaacacctccggcgactatgcgtcggccgtgtacgacgccttttccggcatgctcgtcaacgccaccgccgactatgcggcgaagactcagtaaggcggttcggcacgggggagatggggttcaacgtcttcgactcgccttaccacaatattttctcgctggctcagtgcacgccggacatgtcggaggccgactgccggagctgcctcggggacataatcaggaggatgatgcccaagtacttcgtcgggaagcccggcggcagggtcttcggcgttcggtgcaacttccggtttgaggcgtacgagttcttctccggccggccgctgttgcagttgtcggggctgccgccctcaccaccaccaccagggctgtccgcaccatcggggctgccgccctcaccgccggggctgcggccggcagcatcaggtaatattaataatagagaaggtgagttgctgctcgatcgctgtgtcttactgtggcttgcactcaccatcaaacgaacgtcaaaaatcgcacctccactccttgttcttcgcccggcgagccccggaaactacagggacgctaggtttgatgttggcctgtggggcagccattagagccgtgtgatcgcgaattgagaaaattatttgcgtggacctaaccaacctccatccccaagtggccttaattcgttctgtacacacattttttgtgctttgcttaatccccgtacacacctgaattttggttttgactagaaaatgtgctgtgcgtgcacaagttggcacgtctgtcatttagcccgcacaacatcgaagattaacaatatacagtttcaggttgtgtttggatacaaagactaaattgtactccacactaattagaagtattaaacgaagactaatcataaagacaattgcataaatgatagctattttgcaagacaaattttttaagcttaattaatccataattagtacatgtttactatagtactccctctatctacttttgatagtcatatttcatcttggcatacagatcaacgataagtaattctacttatcacccatttaaacatgctactagttattcctcgtaaacaagcgatacattaatatttacatttctcgatgcccatgtagccaatcttgtgtggaagaatggagagtcctgcattaaatccgagaaagttattaagaggataggttgttggattgaaatatgcctatcaaaaataaattttttatatttagaaatatgcctatcaaaaatagatggagggagtatcacataggctaatcatggattaattatgcttaataaatttgtctcgcaaactagtctagaattatggaatggattttgtcattagtaaaagtttaatacttctaattagcgtcaaacatcagatgtgacaggaactaaaatttagtccttgatccaatgagggcctcaattagatgaaagtttagaaaaaaaaatctaataaaactaaaatctagcaaatatctaaaacataatccatgtatgctaaaaataattcatgagaattgggttcccttttcccattgatcctctcttgcatgagcgtggtcgtttgaaaacacatgtttctttatagggttaattcgatctatgccattgcaaatatggctattaaaaaaatgctattacaattcgtctattcgtgagtgtgtcattcaaattttacgaaattaaaatcatgccatcaccgtcacatttttcatcttcctccccatctacacgtggggcccatccgtcagattcatcttcttcctccatccgcccctcttcttgtttttcctttttttttcttacctttgtccttccttattcggaactccttttatatacgagatatgattccgtataagacttggtatatgatgggacctaccgagtttagtcaactactattagctatgtggtatccatatccatgatagcttttaagaaaaatcgtctagtgtcgaaatttttaaaatatattaaatttattcttataattaagtagataatccgcaacaataatctaatccaaattaaataggacctaagatgttttatttggagggtaagtttaccctattcatacatagaaaaatagttttttaagggtcatatatagaaatattgtgtgagtttataatactataaattgtaataaaattcacaatattaaatttaagggatttgctaaattcaatcagctagatcgggaaaaaaacatcatgtaaaaaagtctaacacagtacgataaggtaactctccaagttaatatggacacattttttttaagctgtagattaggactgcattaattttcagaaaaaaaaaatctctgtttcataatgtaaggctttgtgtctaaatttattaacatcatctatatgaatgtggagcaatgctagaaagttttacattatcaaaccaaagtagaaacacgccaagcaaaacagaaacttggttacttcacccgcttaatggggagaaaaagaaaagaaaagaaaaaaaaaaggaaacggcctcaaggcctctcgtctccgtcgttagacagaggatgccgctctgcacttcttctcttcgttctccgccgttcgtcgacctccccggagttcatgaccgtcagatccggtgaccacaagttaaaaaggttgtaagatatggccccttggaactgaagaaatttacatatctttcacccataaaaactggcttcgctagaatgccaatgtcaaaatgtgattcaatcaaacgccactctcaatccgcgggcatttgctgcaatgccattttcgtggtttttttatttcgaaattaatttgcctcaattataatttttgtcggacgtttatgcccctgggtcaactggttaaatcggacctggtttcttctcgatctctctcgtctaatcgagcaggcaagcgtgagtgcaagaggagaagaggcggcgacaccggcgtggcccaccaccactattccaccacgccgcctctccccattcccccaccgtgcctcctctcccaccaactgtgccgcctctccccgccgagatctcctccccgccaaacgtgccgcctaccccggccaaaccctagctgtcaagccaagcaagaggagagaaagacgaagggaggggagaccacacctgcaccgctgccttcccccaacctcaggtgcacttgtgccgcctcccccgccatccgtgcgaccgccttccccaatcgcgctggtgcaacccacctcgttctctgccgccttccctgaccgtgccggctctaccaccacgagctcgatgacacgtgccttgatggcgccctcggagaaatcccaaagtggcgcaccctcctggcccgctgacgtgttcatctcccggtggccgggggcgaggacgacgtacactgccggcctcgcgatggcagcgctagggaagagaaaggcgggtagcacagccggcagcaagaggcaatgtggcacagccagaagaggcggttcggcggtgcggcctagttggggaaggcagcagcgcccggaatagtcacccctcctgctctgctggcgaggtcacgcgtcaccacctgagctctctcctctctggttcaacctattgagccaggggcataaacttttgagaaaaaaaaattgaggaaaaacaatttggaaatatcacaaatatttggaccgaaggggttagcaaatattatattgcatttggcggtattttcttttcccatcttaatatttttaattagcagacgaataagcactccctttaatttgtttactgctccccgaaaagaaaggtactcccttttgttcactgagaaatagctagcactgcaatcatgcatgaactcatacaggtcacccatgatattatcactttttttttccagtaaaattgcaggtagaaataagccagggacccaaattctggtaattattttgccactagtggccatttcctccgttgccgcaatttccatctgtatgtggaatatacgtaagaaacgaagatggcgaagagcagagaatttatccgcacgtatgtcatccgaacaatttggcataaactcttaacaaattccaattagaattcttcatcatcaatatttataacacattaacatttctatgcaaaattgccagctgatacggctgaggacttcgaaagtatcaagtcaaccttgctgtctctgtcatcactacaagtggcaacggataactttgacgaaaacaaaaaacttggtgaggggggatttggtgcagtttataaggtattgtagtctttaatgtctacataagagctacttatattagaaacttttttgaatggttgatactttattttgagaaataataagttcatgattttatggtgtgatgagtaagccttaggcttagaaatacgagtgacatgcatattagtgcgaaattgctaatttacaatatagtatcttaggctttaagaaattcagctaattactcggcaacccatgcattagcgattttagatgcatcttttacttttcgtcactaatatttttgtaaaattttattgaacaatacatgttaataaatataaacttatatttatgtacatactcatacaaaaataaactttctattatgtaattattggctctattttttgtcttaaacaactattaacttattgacttattaaaggactagaaaaagaagcctccacgttcgctctcatgttataaaattaatcggaaaaaaataaataaatagtccatatagaattataatttaaaaatatctaaaattcgaaattaaaaataaggaatataggaagagaagactatagtgcataccggtatacaatagaactaatgaaaattcagaattaaaaaataaaaaaattaaaagtagaggttagagtcgatatagaaatataatttagaaataatgaaaattagaaattaaaaaataaggaatattagaagaagaatatagagtccatatagaaatacaatttaaaaataactgaaattcaggattttttttaaaaaagaaatattgaaagataagtctagagtgcatatagaaatataatttataaataatataaattaggagttaaaatatgaaatattataagaagagtacagagtacatgtaggaatttataattaattatagtatagaaatatgagtttagagtcctaaataatacaattagaaataatgaaaattcaaaattggaaaaaaaggaatatttaaaaaagagcctagagtctatatataaataatttacaaataatggaaattcggaattaaaaataaaaaatattggaagaggagtctagagtacatataggagtataatttagaaataaatgaaattttgaatttaaaaataagaaatataatagaaatttagaattagaaaataaagaatattggaaggtgagtatagagtcaatataggaataccatttagaaataactaatgttcgatattaaaaataattaataactatcacgtatatacaatataatatgaatattacacattagatattttttaaaaagtaaatcatttcaattttttattagttacaaaaatagtaattaaaaagataaattaatcattttccacatagttgaagtatttcctctattttcccacaaagttgagtggcttttgctaaaatgccacatggctcaaaaacgtttagcatagactatcaactttgaggcaaaagagaggaggcactttaactatgtggcagatatgcaattttcccattaaaactaaatatgtgcctgaattctatatcttgatttccacattatatacgaacctttttttttgttgattcaacacaattcaagatttccttgttatattaagtatgagccctaatgttacttttttatgaataaatgaatttgaattcaaaattaatgaatacatagttgtccttgagttggagtcttttttatatattgtttgttgttgacttagatcccattcatttagaagtttcccgaaatcggtaagaggttcttctctccatcggggcaacaggtgttcaatagatcaaaaatcataaatgtgccactaatgattacaatgacctgagcagtaccccaaggtcctaagttcaaatcttcataagagcgaatttcagattgggttgtttgcggagctaagttccctatttcaatggccgtatatattcgattggatgtagaggcaggtaaaaaaaatacccttctctaaaataaataaatgtaccactaataattaacacgttgtgccacatatggattattcttttaatctaaaccaacatgagttgttcccactaattggatggctagatctttttttttcattattgagttgtacgaatttggaaagttcccactaattgtacgaatttaatttttagttgtaccatgtcacgcccagaaattcccgaatagaattccaagcagaatgtgcattaaaatccccgtccaggaccagccggggtacacaaacgacaatgttgacattcagatccacgtcttacaaacatcataaaagtcttacataaatgcagcggaagaaaaaaaaagacaacaagagctaagccttgactaaactgcagcaggaacaccactccacaggcatcctcgacggcacggacaaagcctactcctcggagaaaccttcatctgacccgaactcgaactctgggggttgggaaaagtagagcaagactgagtactacccactgtactcagcaagtcataccggaataggggtatgatgcacggaaaatatcaaagaagagctaaagtggttcatttgcataaagcgagcatttataaacagaaattgaaagatttaaacagttgtaattattaattaaacatccactgtccaacgctaacccacgttgcgacaggcccaaccatccacctaaattatccaaattcaaaaggttacactaaggtgagactaatcacggtgaatctggttgaccgcccgtaaccgcgggcacggctattcgaatagttttgctctgatcagaggtgtacaattgtacccacaagacacagccccacgacacgttttcgtgcgccgacatgccaccacgacatatcggaaagaggccgtgacaggacccttcgcataacccctctctagccaagcacaccacacctcaggtttcacccccgtccccagcgggccacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtagtttattttaattaacccacgccaaagcggtggcactaatccaacagaaccattggaaccaacagtctaaacattattatgcttttccccattgtgaactagttgaactaagcatgtctaagcaattcctagtccaaactctaatcatgttataccccaagctaacaagggagcatggtattcaaaaaaaaaaaacatggccgtaacgataggtaaccatcccatatttaatattataaaacaatgcaatatttgaaagaaaacaatagaacatttgcaatataggatcaacatgttcaagtgacaagcatgacttgccttgctctgctgctggaggaacctcggcgactatctcgaagtacaccggagcgtcggaggaattggaatctagcgacatacaaagtaaacattgcaaacaagctataagactactgaaacagggaacaaaaccaattttaatggattctacacatttttcttgatttactgagacttgaatgggcttaaacggagctcggatgaattagttatgaattttagaagattcactgtgtttattactatacaagaaaaaccttaaatcaattattgcgcaatatattccagggctgacgtcagcacaggggaagcggcgccgacatgcggggcccaccggtcagcggctcgggagagggaggaagggcgccggcacgcgggcccactggtcagcggctcgggagagggggggaaaggcgccggcacgcgggcccaccggtcagcggctcgagaggaaaggggcggcggcacccggctcggcttggctcaaggccggccgaccggccgcggcgacggcgacggcgcgcgcgcgaacgcgttgccggcgacggcaaccggcggcgaaggcgacggcgcaaacggcgacgcgaaggcggctgcgctaagcggcggctaggaaggggagggaacgggcgacgataaaggcggccgccggctcggctcggcatcaaagccgacctgccggccaggcctagcggcgacggcacgcggccgacgacggcggcgtccggcggcacgggaggcggcggcggcggccgaaggcgacggcgcgcaacttgaagcggcggcgcggcactaggaggagaggaaggggaaaaaaaaaggggagggattcctcaccgagggtggccggcgcggaggaagacgatggcgaacaacgacggcaagccacgggaggacgacgtcggcgggcggacgagcttcggg

SEQ ID NO: 75493 - DNA, 25067 bp, Oryza sativa
  unsure (1)..(25067): unsure at all n locations
tggaaaaaaaactctatattttgggagttaccctattgggaattcttggacgtccgccacgcaatcgacgtgatgcacctcactaagaatctttgcgtaaaccttcttctcttcctaggtatatatggaaagtcgaaagatacactggaagcacgtaatgatctgaagcatatggaacaacgcggtgaccttcacccggaaccaaaggagaaatgaagccattacttgagtccagccagctacactcttagcaaggcagagaaggaaagtatgtttgaatgcttggagagtatcaaggtaccgtctggatactccacgaatataaagcgaataataagcacgaaggagaagaagttcacaaatctaaagtctcatgactgtcacgtgctgatgacacagctgctaccagttgtaataaggggtatcctcccagacaatgtctgggcaacaataacaaagctatgtgctttcatgaacgcaatttcgcagaaggtcatcgatcctgatagattagaagccctgcagaatgatgcggtgcaatgtcttgtcagttttgagttgatatttccaccttcatttttcaatataatgatgcatctgctttgtcaccttgtcaaagagatcggtattctcggtcctgtgtacctacacaacatgtttcctttcaagaggtatatgggcgttctgaaaaagtatgttcgtaaccgtgctcgtccagaggcaagcatcgccaaggggtatggaacagaggaggttattgaattctacgtagaatttatcgaagaccttcgcccaatcagggtacctgaatcacgccatgaagggagactacggggaaaggggactcaagggagactacggggaaaggggactctcggaaggaaagcaataatgacggtagacaacaatttattccgtaaagcccatttcacggttctgcaacaatcttcattggtggctccctacatcgaggaacacttggctctaattcgcgccagaaacatcagtaagtccgatgcatggattacaaggcatcacattgatactttctccacgtggctgcgacaacatctcatgggtaacaagacgattaaccaacaactggccttcctggcgagggaaccatctggcttgatcacgacattccagggatatgaaatcaatgggtacacattctacacgagggcccaagacatgaagagcacgaaccagaacagtgctgttcgtatcgatgccatgggacacgatggtacaactggcacgtattactgtgccatcgaggacatatgggaacttgactatggacctctcaaggtccctctgttccggtgccaatgggttaggttgactggtggaggcgtaacgaatgatgacagtgggatgacaacggttgaccttaacaaggttggatactcggacgaaccttttgtccttgccaatgatgtaacccaagttttttacgtcaaggacatgtctagcaaggaaaaaaggctaaagggcttgacgagccgaagcgccacgtggttctcccaggaaaaagaaaaatcgtcggagtagaggacaagactgacgagaattacaatcagtttgatgggcaaccccctttcacggtgacgattgaccctagcatcctcctatcaaatgaagacaccccttactcacgtagccatcacaaggaaggaacaatagtgaggagaaagtacgtgcggtcaactgtcaccgctgatgtattgccgtaattgttctgtacacgatgtaaactatgttggatgtactgaatatccatacaaatcaattgttgtatggcatatgttaaatttgtatgattattagaatttttatcaaattgaaatcatccatatgctagttatatatgattattagattttttattaattatgtataattattagaattttaatcaaattgaaatcatccatatgctagttatatatgattattagaatttttaaaggttttaaatcatgcacgtggtatttacatatgttaattataattttcaacagtttaatatcatgatatgctagttatatatgattattagattttgtattaattttaaatcatgcatgtgctatttacatatgttaattagaatttttaaccatttaatatcatgcatatgctaattataaatgattattagaatttttaacaattttaaatcattcatgtgcttattatatattatccacgtattctagtacatacaataataatttttcgaaggttttatcattaattgttcgactttaaataattgtaatgcattatttactattttagaaacacatatgcaatgaaattcaagacacagctgctattatctttagtcccagttcctaaccctaaccgggtttaaaaagaatttgaaaatagcgggaaaagatctttagtcccaattggtgagaacaaccgggagtaaagatcttttatttagtctcggttgttgttacgaaccgggagtaaagatatttttactcccggttggtctcaccaactgggactaaagatccgggggtatatatattgccggtgcgccctcgtcttctccaccaacacttagacgtttttcaatcttggctcgatctccttcgccgccaccgtgcctagggcaaccctgcgccgacaccgccgtcgtctctcgccgtcgcttggcggtcctcgccgcctctgccgcagacgccgccaccgcatctcttgggtgagagccgccgctgcctctctctctctcgatctcgatctcgatatctctctctctccacggccgacgaccggcttcgacgcggcggccgtcgccgccgacgccgtcgccactgccattccgccgcccccgcctcgagctcgccacgccgctgcgccacgccacgggactgctacgccacgccgccgcgacgccacgccgtcgccactgtcgccgcgatgccacggcgcggccaccgcgccgccacgccactgctgcgcgcgcccaacagtgccgaacgttaacgaacgtgattgaaacgtgaccgaacgcgaacaaacgtaacgaaacgttaacgaatgcgaatgcaaacgttaacgaacgcgaacgaacgtgaacgaaacgttaacgaacgcgaacgagcgtaacaaaacgcgaacgaacgtaacgaaacgttaatgaacgcgaacgaacgtgcacgaaacgttaacgaacgcgaacgaacgtgaacaaaacgattacggaacgcgaacgaacgtgcacgaaacacttacgaatgtgaatgcacttgtactaaaagtgtgagaacgaacgcgtttatactaatacgatttactggtaatacatatatgattatatatgtaacttggcccgtttagactaatacattttcctggtaatgttgcagagaagacgtcgttatcgtaccttaagccaaagtggtagctagccatcgaaggaattcgcgcaggcaagtgatgtaaagaagtgattgttagatatttaatataagacggttagacttagcatacatgattattacaattttaatataagattgttatcgatttaatataatattgttagacttagcatatatgagtgttagagatttaatataatattgttagacttagcatatatatatatatgactattacaattttaatataagattagtagcgatttaatatgagattagtagagatttaatataagattgttatacttagcatatatatatgattattacaattttaatatgagattagtagccatttaatataagattgttagacttagcatatatatatatatgattattacaattttaatataagattagccgcgatttaatatgagattaatagagatttaatataagattagtagcgatttaatataatattgttatacttagcatatatatatgattattacaattttaatatgagattagtatccatttaatataagattgttagacttagcatatatatatatatatgattattacaattttaatataagattagccgcgatttattatgagattagtagagatttaatataagattagtagcgatttaatataagattgttatacttagcatacatatatgattattacaattttaatatgagattagtagtgatttaatataagattgttagacttagcatacatgattattacaattttaatataagattattagagattaaatataagattgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtttgcacagatggctgatcgcgatgaggaacagatactatacgacacaatcgcagagggaagcagccaatactggaacgaaggagaggggaacgaggatccaaaccagtacttgaacgaggagaggaacgtggagagggatgcggaggggaacgaggaggggaacgatgaggaggaggctagtggaagtcttccctccgctggacagaagagggcacgcggacaacgaggtgccgcgaagaagatagagggtcagcacatcataactgaggtggaccaagaattttgtacgccacagcggttgggttgtgagggacaacgtgcctgtcagcatggtgtactggcacaaaacaagggcacacggggataatgacagctttgtcccggactcggagaaagagatgctgtggaccacaatgctcgagacgttcacactacccgcgggtacggagaacatagtgaaacagtggactctgtagaaaatagcataacagtttcagagcttcaagggagatctctacaagaaatacatcctgaagggactaacaccgaacttcgacgtattcccaaagctaagggatcattgggacgagttcgttgcttacaagacagggcaacaagggcaagcgatgatggccagaaacaaagacaatgccgccaagaagaagtaccatcaccacttggggtcaggcggatatagcgtcgcaatgccgaactgggaggagatggaggcaagtttgattgagaggggtatcaaaccggccaccgctaaatggccggatcgatcgaagttttggtactatgctcacggtggaacgcttaacccagttgatggctcccttgtcttcagcgatcagatacgcgaggctgccagtcgactaacggacgcagtggtagactcttctcagggcacattccgacccgacagaaagaaggatgagctgtcactcgccctatagactcccgagcatccagggcgaacatgagggaaaggcgtgattccctggaagattggatttaaggaggacatccacacgtacaggagtcggatgaggagcaagagagataccgaggcgaagattgcaaatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgcctcaacggggcaggtcggatcacagagcatggacgccatgcaaacccaggacgaaaccacctgccccgttgatgagatcacgcagcggacaccatgtgagctgtatattcccttgaagaacttatcaatcaaggtatgctcgtattttaatgatttttgacttgtacattccgcaagttgctgcttaggttgattactaatagataacctctcatcacgtgaaggtggcgtcgggaatggccatcccaacggaccctttcgggacttaccactgcaggccgattccagcaggatactcgagggtcgaagttgagctggtggaagccgcgtacgaggatctcgagttggactacccaggaggagacggtgagacgcatctacgagacacaagccacgccatcatactatggcgcaagcggtacatcatccttcctgggctacaagcggcgtctcgtgcaccatctcctccggctccgccatcttctcctgcaccatctcctccggttcctccgccacgtcctcctgcaccatctcctccggctcctccgccacctcctactgcaccatctcctctggctcctccgcctccaccgtgtccgcctgcacctcccaagacaaggtctcgccaagctccaccgcctgcctgcacaagggcaacgaagaaggcgaaagttgacgccaccaaaaacaaggagccatcgtacgattgcagtcaagaggagcttgatgcttatgtggcaggagaggtgaagaggcaactcaagcctcggagtcctgaaaagaatatacctattgacccgagcgtgaagaacttcttcaagggaatgtccacaacaaacgaggcgttacagatatcggactatgaccaaacacttcagagagcctatcacaagaagtccaaaccagtccctcagcttggagaacaaccaaaccaagaggttgggccattggtgaccggcgaagattttggcataacggaattcatttcagacaccggtctaactgtggatcagttggttggaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaatgggaagatctctggatccatttcaaggatctcttcgatctgtaccagttggacgccctcgacatctctcttctgagggcatggattttgtgagtatttttgagttcgatttgtttcgttcaataattagctcctggcatatatgtaagcaataatactttcctttcatcgttgtagaatggagattcaaagggcccgacggcggagggtctacgatactgggttcatcgacccttggaaaatcaacaccgaaatgatcgacaagtacgagaaagacacagaggacaatctcatccatctcctaacgcagtagcatttcaagacgtacatactactgccgtacaacacagagtgagtttttattgtcgttcgaacaaattttgttcccatacatatagcatgtacattttcgatcatatatatctcatctcacgcatattccaaattccattgggtcctgttattcttcgacttggacgcatgcagagctatgtacgactcaatgaataaagaggagaagatttttgacaaggtcttcaaactgatagacatgtaatataatgccatctattccaaagtcacggggaatctattgctattatgttgatctcaggtaataattaattaatcatagcttgcaactgcatatgtagggcttgggatcggttccgtcaattggtccgcgggacttggaaagaaaaacttggacggaggtttcattttccagtgagtacatgcatgatccaaaattatattgaattgaatatctaattacagttaatataaatagtatattaaatctctcatcgtttctcatgtagtgtgcaaagcaggaccagggaactaacttatgcggctactacgtatgcgagtatgcccactgcctattaaaccaaatatgcacaacacgagagctcgatgtacgtatacataaaccattcaaaatttcattgctcgatttgttacgttgtttattaatttcatatattgatacgtcattatttttcgaacgatagcgtattcacatgagggataatctcccacacaaggattttatcacggctgttcaagaacaactgatgggattcatcaacgaagaagtccttaatcccgacggtgaattctactatgacggatcgacaattcataacgtcggtccttcctcttctgacataacgccggcgtcgaagtcgtagttatagctaccaagcaaatgaattgtactatatatgcatgtatatatatatttatatatgtacacatttacttttgtgttaatatatattttggtaacatatatatatgcacataaaatgttaagtgctttaaattatacatatgtgtgtgtaatatatgatttatacacacacacacacatatatatatatatatatataaaatcaaccatgcagcaaacagggccatgcaaataaaaaaaaatggtgcaccaatctttagtcccagttggtaacacaaaccgggactaaagatggtttggccggccacgtggctaatcgatctttagtcccggttggtaacacaaaccgggactaaagatcgatctttagtcccggttatttcacccgggactaaagataactatctttagtcccggattcgtagtctcggttggacaaccgggactaaaggggggttaccaaccgggactacaaacggtttctccaccagtgggaagtgcttggtgtacacggtgccgacgactccggggatcccggacaaggcctcgaacatggacgcggaggcggcgtgggagtccggccaccggacaaccctggtgaggaggacggtggtgatggcggcgcagacctggacgatgatgttgtggcaggtagagatgccgaggccgaagcggcgggacacctcgcggagtgggtcgccggtggcgaggcgccagatgcagacggtgacgcgctggggcacagggatggcggtgcgcagcgtggtgtcctccttggtgacagcggcagccaggtcgtcgcagagcttgtcgaacaccgcgcgcggcatgcggaaggctcgccggaagtccgcctccgggcacgccaccgggtccctcatgcggtcccaccattccgtgctccgctcccgcacccacacccgccggccacctggcctttccgccgtcggctcactcccctcgccgccgctgccatcgcagttggacagtgagctcgaattccttggcgccttcttcctcctcttagatgaccgggacacgacacccatggcctcgccgtcgtcggcatggaaactccgcttcccactggcatctcctccgcctgccaccacctccaccgacaccggcggctggtcagcaagaaagtcaccgtccatgaggaggaagtcgtcagcggcgagcatggatgtgtactcaaaatcagcatcatcggggatctcaaagagaggagtggagaagggctcgagctcgaggaaggcgttcatggcgatgggagaatactcaacattcaacaacgagtgattgtgtgggcaaatggccagctgatgatcaggcctttatatatacgtattgggttgtgtaaactgaggcagaatctgagacggagggaatagttgggttattgtatgtcatctaactgcttatgaaattttttttttaaaaaaaataacaagatagattaatatatgataggccactccacaaatatgcaagttaaaatttaactcttacaagttaaaaagaattaaattatgactagttaacatatattcacagtcaaatttgttattttgttgcaacttgtcgaagttaaaattagctttgtatgtttgtgaattgatttatcacatattaatctatcttgttaaatattcttaattttttatcatcattagctagatgacatgtaaataacgagtagatataagtttagtatagcttaagcccaatggctgcttggcgcgcggtatagtactatactgagaaaatagctaagatgagcagggctgtttcacatgtgggcactgcacacgcaacgcggcccacctcgtacgtctagccacgtgtctctcggtgattcgttcacagagttggttacgccttttcttgttacttttggtggggaaagggttgtttgatcgttagggcattcacagtgcaaggacgtacgtggcgctcagcccaatggtaagaaaccgaatattcgacgccacatcatcaatccatggtaagaaaccgaatattcggagctgtggacgaggatccaccatccgggccctatcaaagcccgttgtgtccatgctataggacctattgcctctgtcggatctgtgtcctaagttaccgcattcgatggatccctggcttctgagcaccgtcaacgccggatccgcggccaccggatccgcggttttccatcacaccggcctccttccgcggtttgccacccacatgcgtcctatcgccgacgcagttgctgtcatagagagctggcgcaacgaaggtggagaagctgaatgggaggagggagagggagtggtaaggaaaaggagggggagagagggagccgagagaaggcagagggttaaactgctacaaaacccctcatagatatcggttcataggtaaattcgacacctatgaacctcttcccacctccgtgtaatgagaaaaaaaatataaaaccaacacctatgtaccttttttttaaaaaaaaccgtcacctataacatattataggtaccggttaattaaaactgatacctataatatattatagatgccgattttttaaagaaccaacacccatacaaaactgagccgaccactcagtataaattcgagatcaagcctcctcattcctatcctagtgtccttgtccaatccccccttctctcgtcctcaccccctctccatcctcttatccactatgtcgccttcctctcaagcttgcggggccagctagctttagggggcgggggggggggggggggctcgatcaatatgacggctattttagagtgcagcaccgccatcgctgaagccaccgaatcgggagctcctctcctctctccttctctaagtcctcctctccatccgccacccctccttctcctcttgaccctcccctcccccctcctcctttccatccggtgacagtggcagtggtggacaaggccggcgtgaaatggtgagctgtatggaaaaatttttctgtataagagtttcttaattaataaatcaaataagatttattttttaagttaatacttagtcatattctaatattctaatagatctcctcgttttccatgccaacattatatcagctcattctatcctctcgggcacgtacagccttcatctctagccctctcccataggaactgaaccaagagcgcgctacaagacggggaacctggaggcagcagtgatgctttagaaaattattcaccaaaaaatatgttgacatcgtaccaaccatagagtaaatttagaaactagcctgcacctatgctataaacagtcacagagccaatggcatgattgtatatatatcccataaaaactaacctagaactggatgtgagatattctaatactacaaatctagctagatatacatctgtttaaatttattgtactagaatacatcataagattcgtttgtttaggcggagggagtatgtctggacgagtaagagtatttcgcggtggccgaacactttttacaagcatcaatctcattcgacaatgagacgcgccagcagctcatacagctgcccgatcgaccagcccagaaactaagctctactaatcttgtggatcacctttcgtaactctctgttggaaatatataatgcaaaatgtcacgagcacaaatataacgcatatgcccgtactagaaaatccatttttccagacgattgtacttttttccaggcgagtagtcctcttggagctaaatgaccgcccgcgaaaataacaaccgtgggggaaatcgttatccacctgcgaaaataccacttaagcggtcgacctgcgaaaatacctttatttttgcaggcggacttcttaactggtccacctgcgaaaattggcgtggcatataaatagacgtgggagagacaagattttttctaagtcttggctctcctctcctcagccgtggaggggaagggaagtggcggcgctccactgccgtgggcagttcggcggcgagggcggcgggatgtggcgacggtgacgcgcgggatcggcggatcggcgacgacaaggcgcgggggcagcaggatcccgcgacggtgacgtgcaggggcggcgggatccggtgacggcgacgcgcgggggcagcggcatccacccccggcgcggctcccctcccctccctctagatccgaccgaagacggtggtggcggcggcggttcggtacccaccccgagcggcagcagcgcacctgcagcggccacccttaccttcccttcctctccctctccctctccctcccaaaactctaaccttagatcagccggaggtgggtaggggcgcgggtgggggtggaggcgattttttttttgttcctcgagagcatcttcgcaggtgggtgactggaaagtatacgaaaatcgatttttgcaggcctttgcatacaggtggacctttcctccacctgaaaaaatgatttttgatcgcctgaaaaaacgatttttctacaagtgtgtgagcatcaacagaattttacagatcagaagtttaataaacatgccgccagatctgcaaaagttggcggagagacatgcattatcatttaaacctttttgcatacaaatttattacgagctctggtatcttgtttcacagagggttctttataaagtccaagctttgaaaatttattggaaattcatattaggtttgattgaggtaaatcaaagtttcctgagatccttataatagtttctttaatatgacttagtaaatgaataggtcaatttttttagtatttttatcactagtgtcaacttacataaaaatcgttttttcgatgtttctcttaagaatactgtcctaacataaaaaaaacataatatttcatataaagtacgataatgataaaatttatatgaaaattgtagttctcaatgagctagctttgtagtcgaattggttttattttagatcgtttagggtcccaaatgttcgttacaagctgcgagatctattttagaaaattcttgagtttgagtttttcaaacgagctggattgagatatcctttggacgaaagaagatttaagtagatgactttttcatttgttgtcattaagagctcaaattatgtgttacaagtgttttagagagttcaagttaaaaaaaaatagcatctattacataattataaattgattcataggtgggataataaagatgttacgcgaggagtgggaggtacggtcctggttcaaatcctatataccgcacgaacacatttttcagtttaatgtttgcaactaagaaaaataaaaaattcaaaaaatgtattttcgcgggcatctccggtcctcttccataggaactgaagcaagagcgtgccacaaagatcttgaaggagcactgcaagcagcagtggccgtgagaacccacgctatatatgacactatttcagtacattattgatcaagatatttcgccatcatgtccagacataggcaatcagcattgacgtactagtgatgaaaaatggaagaaggtaatcgttcgcaaggaccaacttgtattcgtaccttcgttaaacaatagttgtactctcgtaaattgtaatcaactttcttttccataaaaggtaatagtaaattttataccatatatatttagagacaaatgtcacagggtcgcatcaatttttaatattctttttcacttaattaaccctacggttacaattattgtccgtaaccatgatgttaaaataatgaagaaaatacttattgttaccccatcgcatattagttgttgttataccttatatagcatagattatgttatgagaaaaaagtccatactatccttattaaatgatgtatgtgtggtcgtgggagaatagttgagggtataaaaaaagagaaatttgaattaaaagtgattgattggataagtaaattgtgataactattttgggacaaagtttaaatcataaagagataactaatttgggatgaaaatagtacattagtttctaccaggggcggagacagccaaattaaaaagacgccagggtcaatgtaaactagtatttgcaataccgattaaaaaaaccatgaaaaccgcttggttttttcaatccgctagttttgaatccttttcttatatagagttgacgaaaaaaatcttcgaaagtttattagttttaaatatttgttctaagctacacgaaaatcattgatttttactagccaacaaaccttatgaatcagagaggggaaaaactttatcaaaaaatgataacataaatacgtcttaagacttgcatgtaatctctccatcccaaaatataaaggattttagttagatgaatcatattctactagtatgaacttagacagagaaggagggagtagcatctaataatgtatatataaaatattgagaagaatgtactgatccattacaagtttgcttcctgccaatttagtaaaaacaaaaagttaaaagatacggagtactagtgaagaagatattcatatgggctgtgaacaacagatatcggttcctaatttcgttacttgaagttgtgctgaaaggaacattgaacctaagctgcatatactttgccatgtgatttcaaagggacctgtcggcttgtgggccttgtctagttcacgtgggcaatcaggctaatgggcttgcaaaccagccggctaatcacaaagatttaacggaactgctagccgactgtcaaattttttagccattgattccgctttaagatttatgctgagatattttacgatcggatctaaatcctcttttcacaaactagtcatatcatcacatgtttatggcagatttgttcaagttatatctaagttgcattctagttacatgctagttacattctagttacactataattacattgtaactatatacagtgtaactacactataactacattgttatctctatataaattagatataaagttacatatattattttaatacatatatacaagttattattattatagtatagttctagtgaaattatatactatatttagatttgaaagttttcctctcaagaaaacactcgacagttttttagctagtcccaagatttaattagtagttgtgctcatacaagatgatcagatgggctgggtttaaatcaacaattttgccggggtcacattcaactacaccataggtatcaagtggaatttagctccggccatcggtgtcctaggaccccggtgcaacaacggtagctccgtccctggtttctacatatgttgtattctgaaatttactccgaaaaaaatttgtgaaatcacatctatctacaacatgtgtttcttttagactaacatgtgccacatgaaagcaacaattccactattcagctacatgaaaatagtccgaattaccttccgaactattagacagtatgaattaccctcgaaccacaaaaccagacattttaaacctcaaactattgatactggatgaattatcccccccactctatccagagagattttggtcctacgtagcatacacatggtgtcaacgtgtcaatccaatcagaaaaggaataaaaaaccataaccccccacttgtcatatacctcacctgtctcttttttctctctatcggctcttggcgcttgggaatgaggcgggcatgggggtggcaggcaccaatgaaatagcgttgcaggcacgacagcagccgagagggcactacgggcatgggtgggaaggacggcatgggcggtctgcacatgcgagtagggcagtggagatggcgggcagcggcacagtagggagaacattatgggcgacgaacataggtgaggaggacgctagagactgtgggatgtgaagaggcgggcagcagcaagcatggctgaaggcggcgggaaggcactcctcgaggaggaccttgtaggacgctcctcgaggagtgtggctcaagcttgctcaggggacatccgtggaggcggtgactcgtccaacattatggtctggtacatcgaagcttggggcggcagctcgtcgaagctttggggtgatgaagcacggatttacccgatgggtaacgggtggcagggaggcagcaccgatcactggtcttcagtgtcgaggtcgcactgctctaatggttgttgcaccacccaaaagccaagttcccgccgtgtcttgccccctcccaatccaagctcatccagccaatatctcttaggcatccccatcgccgcgagtagatgcatggccaccaacgaagaagcaaggaggagatggtggagaggccgccagccggccggcgctaataggagcagaataaggaggtgtgttagacgtggagagaggggagaagaagaggaaagattgacaggtggggctggaccattttattttttaggccttttaaaaacttacttttacaaatagactttaaaaaaacttatttcagtaatggaccattttcccgatcctagggtcattagcaccgaggttcaatgtttcaaggccaaattgatgtgaaaagggttcacgccaaagagactaatgctcatgatatatttcaaaaataaattatatggaaatggttaaaatataaatatttttttaccataaaagggctctcggagctagccttttggcacgtagggtctattttgtaagaaaaaaaaattatattttgacatattctatataatttttttacagataggtctctttgtcaccaacccatctacttctnccctggtccaggggcgaggagtcagtgttagtgtcatcaatgctcagacctgggacatggtgaaaggtcactggcaactaggaaaatatcattcctaaaataagattgtataggggtttatttataaaataagtttttaaaaagaaccaaaatattaaaaaattatagcttaacggggggataaggatcgattacagtcgaatgaactctactggttacaactttatcttgttcgattttcttcggaaaatggaaggagctctactggtcactgtcgaagtcgctgtatgcctcttctccgcatacagagtatctctttttctcgcaacattgtcccaattccttgcaccacacgtcacttgaatagaatttggcaagtgtatgtaaattaattaaaccggcttgtagggctttaaaaattaacttgtggaagatataaagaagtgtgaaaaaaataaataaaagaactatatagactccctccatccctagaaagtataacggaattgctagaaaacttctgtaagttttttgctcctaaaacattcagatttatggccatcggtttgtctcaagatttgtgcaagaagaaaaatattgctagaaagaaatttttacacatgtcatgcgtaagatcattccttaaaaaaatagccagccaaaccatagttaaatataatttttatataagttatatcattccttaaaaaaataaattatatcgtaattatagtatagttatgatgcagttacagtgtaataacattcagttatactgtagttactaataacatatgcgtgcggcagttttttaagatactcccaaaatatagtcctagctaggctgtagctacatagaacagaacagtgttttataatgacatggaccgttgctttttgatccatcatgagtgcatcaccatcagccaaccggccgcgactgctggctagctggtgcatggatctcaatcctaggttgcagcttggctccagttggacttcatttctccaaagtattgatacaaaatcccgcagtaacgcgtggggttttaactagtttaaattatttataagtcatggtcaggttgatcgtacatagtttcttattcaccttttcttttttttctcctgaggctaatcaatctattcgaacagggatatggatacttggcttgcattgtgacaaattaacaacaatcttatcgcccacatgcataccaattaactaattaattaatcaattaagtgtgtccatcattagtctgtgagattgttggaacttcttgttttgcatcactcatatttgtaactggatataaaataaggagatgcatggatatttaaagatcgatacatgccagagaaaaacagtgaagtatataaaagaaggaatgtttagttgtttacgtgtacaaaggagtatacatcaggattagatgaatggatggaccttttacagtgaaagcatcagaaattgcttgaatgcagtaaagcatattcagctacatgaaagatggaccacgtcgtatgtacatgcaattgcctaatgcagatgccattgcttcatcgcttgctgcagcattgtatgttatagaggacttctatggcatgatacagatctgcaaacggtgcagcacgcgctgttgttggctaccggcaacacatggtcgctgagtgaaatttcgatgattatagctcattgatgatatcgcgtcgacggctagggatttaatttagggactaactaatttggattgagttaagcgtattgaaaactaactctaactgtttctacttgtgattaaaactaatccactttttcggataaaaataaatctagtccgttattttgttttcatcgaatgctggttgaagtccattaatctgcatgtactccggtgcgtaaaaaaaaatacaaggacttgacattagatgggctttgttccacctgattaaaagcatgttagatcgacgatcatgattatatcatctgtctaattaatggttagatttctctggttaatgtaagagctcgtagaaagtgcccaattagtataggtatagattagagctgcggttttgaagcttagttctaaacttctaatgtgttcttggctttagtttttcattaattgggtataaacaaggcaagcaattagcatataattaaattggttttaatatatcttctattatatactaactttctataaacacttctaaactgacatcatacacaatcgtttttcttattatagtctcttatataacgaatagagcgagatactacttcttttaatattcttttttaaacaataaataagatgccgtgtatttgcgtgaatttcctttctcgttgttataaacatgaaacatatatgtttattagattttataaacaaagttcaatatatataaaaagttttttttgcaaaaaaaactaacatttaatagtgtgggaggtgttctcacaataaacgacaaaacgaacgaacgcataagagctgcggtttacagcttttatattgtcccaatatgcactctgtttcgcttatgcgtaagaacatgacacctactgtaggtggtgtcatgtacaaaacgatggctctctcgttgttccggatgtgtccccctacctataaatgacctaatacactgtatgttctcgtttgatttcttctattgaaaactagcacaagaaaatgtacacatggaagagatatttctcgtataagttcgtggcatgcattagcttggtcgtcgatcatgtgttggtgttaataaggaaattgttaacaaaaacagttctggctagttggctctacagtttttcactaatagagaaacgatttcctactaccagactaccagacccataaatcttgagaacttttacgatacattctactgctagtatatatttggtatttgttaaaaatctgaaaagggttgtttagccatttataaaatagatattgttttagtttttttatcacaaatagagattaactttcccgtggtttttttttccctggatatcgtcatcctcgtcttcctggcgaccccagcgacgtcgctcccaccccggcgcatctctgttgttgtacctctgttgtgctaaagccatgacagtgctttcttccatcggcagcttcggtatagggcttgttcacgccgtggcatagctatggccagagccatagcattcaacaagagggtctgctctgcgacagccatgccctgctgctgctgcggcatgctgccctcttgctgctgcgccatgctgctctgccgctgccacctaccgccggccggcttcccttgtcgctgcggcaggcaaggtccctagcaagcgtcgccctcccgtagacccagcagcccgcgccgattttggctcccagtggcagcggtgattgtggctgtcggcggcgggggcggcgccgacagaagccagtggcggcggtcgcccatgcgagcggagcagattcggtttagactctgtatggtcaaacggatctgactaagtgagatagcatgaatttaccaaaataccccccaacgcaaaaagatagaaagacaaatataccctattcaatttatactgcagcataattggaaggaaaatcagataaatttacaccgtcagatcaaatatactgctagtatatactagcagtagaatgtaccgtaaaagtcctctaaatctttgcaggtgggtcttatttttggctgcggttgcttgcatgcgtagatgtgggagaggagaccgatggccagccgcatgccgagatcaatttttgtagtgcggatggcttaagggggcccatctgcgataatatctcttctcttcacagtcgagcctctttagacctgcttgtgaaaatcgatttttataatcgcgatggcaggagcaccgattgtgttaatagtgagggtgttaaaatagaatatgctgatcaagccagccaagaggaaaccaaggaaacacctcaagtccctgatatcatccctccttgctccctgaaaattttggtttttaaatacggaattaaaaattcggaataaccaaaaaatattttgaacttccttgcatactggaatttattgtattttatttcccgttttcttgttatgcatggactaaaggagtgtattttgatttcaaatattatttacttaaagaaccatgattatgaaatatattaatactagttattttctgtcacgtcctgataaattcatcccgaattaaaaatcattctctaaaaggaataatagaattaattaaaattcgaaaagaaattggcaaacactaaaatatgtacaagaaaaattcaaatgtgacccggagaatttttgttaaattctccttggtctaaaaggagccctcaaattttagtggaattttcagagcacaaataataattattaagaaataaacaaagttgaaaaggttttataaaaagaaaaccctaaaagaagtcttcttttccccccttcccttcttgggccggctaggcccacttctctccctctctctcctctcccccgcggcccatcggcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgccgaatccgccgcatcccgccgtccccgcgcgccataatgaggggggaatcattccccgcgattccctctcccgattcccccgcttttccctctctctctccctcggattcgttcggagttaatcccgcaagtttcgccggcgtcttcaagggcggccgagatctccgcggccgattcctccccctccggccgtcctctctctctcccggcgctatataagcgttccccgtgctctcctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccttcggcttcgccgcgtcgtcgtcgaccccgtccgctcctccgatttgctcgccgaccgccggagcaccgtcgccctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccgatccaccgtggaccgagaggctgacgcgtgggccccactcccgtggacccggtccgcgcgccctctccctcggctgacgcaataaatgagatttttaattaaaatttaaatgaagaaattcgtaaatatccatttaaagagcatataaacttcaaatggccatatttggccatttgaactcggaattggaccgttcaagtctctaatttttccttaagaagtcaagaacccatttttgtgctttgtttctgctgttatttggagtttattagagtaaaagccttttcttttccgttggtcgtgtagacgctgcagcttcggaagatccgctcttcgtggaagttgaagccggcgtttgggaaagcgagcaaggcaagtcacatcatccttgatcatattgaatcccagtttgtaaaattatgttgatttaaattattgcattaccgctttatttaaattcccgcgttatcactgttttatctagccatacctatttacctttgttatgaccttattattattgttattgttattattactttgttcaccctaggttaaacaaaaccccaactagtgagtactctattcatggttccactagtataaatttaggtagatgcttcgctgattaattaggcaacattaggtggttttataactttagactttgggaattctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagcctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattacccccttgtactcctttgcattaattgtgcatctccggtgtggcttgctgagtactgtggttgtactcattcttgctctatctttctcccctcttcagtaagagaagctttggagaagatgtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcctttatatcatgtttgtgtggtgtaccccggcttttcctgggacggggattaatacactggcgttcgggaaaaaggcaattttcccggtcgcgacattttcctaaaaaccgttctctatataatagaacccctctgacatatttgctctgtaaaaaaaattgtatactactattatgaatgaacactacgggataattcattagaacgaaaactattttacaaagggaatgtgattccgattattttctaaagaataacagctattaaaaactattttacgggataattcctgaaggctattttaaaaagaaacggcattctcagataaagtctggttttcctatggaaaggcctagcctgatttgcataataggaggatttgttatttatttgtgtgtgcttaggtactgtgccaaaagatttctattaaattcttttccctaaatgggctgtcttctgttcgacatccttccgtttccttatcatctctgacagttgattaagcgcttcggtgcgaaattaatcaccactactacaaaaatcgtttttctgtacgagggggtcggtaggttccatgcgggccgcttgtggcggcgcctgcaaaaaccgcccccccggggcgggttgattagccgcatgcgaagatccattatcgcatgcggctggttaagacagccgcatgcgataataggtctattttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactatttt

SEQ ID NO: 75494 - DNA, 21935 bp, Oryza sativa
ggcatctaaattttggtagagtagagagacaagccaacccttgataacagtataagaataggaaatatcaccaaaacataaaactcagtagtatctaacttcagacagctgctatttcgtcctgaatcaaatatacaaatgtaattcctttgttgtcaaatacatgaagcctgtttcgcgcctgaatactttaccaaaagccaaaaaaaaaaactaccacagatactatggaaatttttattaagcacggattagctaacagaccttaatagttgtcatagatgtcactgcacctccaggtttttgtattgacactatctggtctgaagaatcgagaacaatagtcacagaagtctctattattgattcttcttcagcagttggatccgctagaacattatccttgtgaagtgcacatgtaagggaaaatggaacattagtaatcgtaagcttcctcttttctctgtttaccaattcatatttggctttgccttcattgcccccaacagtaaatactctaccatcatcaccgacagataccaaaggaatttccactgcaaatataacatagtattagtaatgaaaattaactaaagcaccttgagatgttaacatgaagaaaatggaacagaccaagaacttcagatgcacaaactttctataaaatggaaaatgaacaggcatagagcagcgagttttgaccagataatacttccatgtcaaatctaacaggacttgccttgccatctgaagttttttgttgaatttcaagaatcataaatgaccaggaaataatcagtaatatcctgtacataaaaatctctttgtacctacaatgttttcatctttttttttcaccaatgcagggttggttatgataacaggatcacatatagcctcactccacactccgcccagagctcataaggtcaaaacaaaacacaccttccattactctatttaggcaagcttctcacgcacataaaccaccaaacataagaaaaaggtttgtgagacagccacatgaaaccatattaaatgaaagaccacttaacatcttcattcacgacatcgactccaacattacaatctttcaaatgatacaaaacagaatgtggatcaagttaccccaatcttgatgagtcccgtttctcaatgtttactttaggggagaattttccattgaaaattttccccgtcaacaaactttacaaatctaagaagtatggcaagtaatactccctctattttatttagcatataagaaatcatacgagtttgcataagattaaataagtctataaaaccaacagaaaatgccatgatatgataaatgaggaaaaactatacgccatgtaaaatgaaatagacgagggcatatatttatggctattaactagttttatatatacataaaaaacttgcggtcttcctgaagtttcactaggtagaatagaaaaatcaacaatatttacatgttaaactactctattttatatggttctcatctaataatctcaaaatgtgctatgaactgtctcataaaccaatgcgtacaatatttagatgattagcaataaaaaattaaactaactatggatgtttaacactcagtcacatgcaccaaccagttcaaccaaaagcttaagctgatggagaaggatggacaattcacttatcctttaacactcctcgtcaatctaggatccctcctacctcacacttacaaggcttgccagcgttttatttaaacagtgcctgacaagatttgaactcaagacctcttggtagtgatacaaaattgaattgcatgcaccagaaagttcacccaaaagcttaactaatggagaagaataggcaattccatgagtttgtagttatcaaaaagagtatttaatgggggcactaaatctgtaatttgattcatactgactgaataaagcactaactgctagcacatattacaatagcatatttacatttcaaaatgaagagtaattaagtagtgaaaaatgtcaaatcaagataagctatcagaaataaggaacgtacaatgtgtaaatgcagcaacagctgagattagtgcagcgtcgaatagagacccatcagcattcaaacaatagacatcctgtaaagttgagatgtcaagaaaacaacagaagtataaaacacatactttttgcaaacttgtttttggacgggcattgcctgaacttatttttatgccattgtttgttcctttacaagagctgtggttgtataaaacacaaatactttttgcaaacttgtttttggacgagcactgcctgaacttatttttatgccattgtttgttcctttacaagagctgtggttgatgttgtactttacacccacctctattaaagaccttcagctgacagatgtacgtagaaatgttgtgttgcttgcatttttgcaatatcttccattaaaaaagtgtattcttttaaacatgtgtgtgttgtttgcatattgcaatatcttctgcaaaaattgcaattttgcaaatatgtgcgtttaggttgttgattaatctcatctagtggtatatatgattttctgatttcagggtactagttggcatttatcacaatgctcaggtacaataatagtatactggcaaatctcacatcatgcgctcagttctattgcagcaagcaaccgcagataacagatttggtgctgccacatgaactgtattttagggaaacagcagggaaagtccctgttggagtttccgttaaaaaaggggcatatttgttcaatgccataaaaaggaaattggagtaggaaaataacatcaagaaaccaaagcttccaaagaccattaacacagaaaattcttgagaataccatccccgtaaacttttttcatccatatctaatgtttccatcctactaggacaaagataaaaataaaagatacaggttatctgacattctcctcatctcttgacgttctgggagctgctatagcgtgattgaggacaagcaccgagcatgcgcgaccacacatgacgtgctccaatgactgaaatagcaacaaatggtgagcatggcatagaacacgacaagaaggttccatttttatggacatatagaagagatcagagaaaaattgacaggagcagcatggaggtgacatggcaagattggcaatacgttctaatgtcatgcggcagttgttgagcaccaaggaaatgcgacaagtggcagtggtgatctaagattcccactttgtccacacccttttacatcatgctacagaactccagtcgctggatccatgtcacagataaaggcagtacgatgttgccagccaccatgcttgaggacctgcccaatgcggaagtcatcgctgtcatggccaagatgctctgggtggacgccaacgccatcatgaaatctgacctcacatttgctcttggtgacagtggcttcacaggatgtggcagctgggagacgctaatggcatcatcctaccacgcaccatggggagaagaggtctgtggccatgcagcatgagaagaataggcacgtctatgtgatatgaattacagagaaaaaagggaagcacatgagaaaggaggaaaaggcataatgtgggcccacctagtagaaatataagaagaaaaaagaaagaatgggtcattaacaattaggggtgggcgttcggtcaggaccgacatttcggtccggttttttcggtctttataaaaaggaaaccgaagttgtctcaagaaacttgtggaccgacagttcggttaactgatacttcggtctcggtcttcagtctgaccgaccaaactgaagtatcctttgtggcactggattgcagacttgcatatagggacgagggcgagaaaaaaaattagtatgagatgctagtcgaagcaggtagtaaatcacaagcatacacacgcaactattgctcttaagcacaaaaacccagatctgacaaaaatggaattcaatcgttcaagaaaatgggattcaatcattcaaagattacgtgttagaaatctgaaaaaaaaaacaatcgaaggatagagagtataggagaaacaatcatcaacgagagagacaatcctctcgacagcaggccacggcgctactgacaatggcgctcaggctgcacacgcacagcaggcaggatatgagcaagacgacgacgatgacctcaccgctaccgcaccgacggagacccctcagcagcagccacagccatcatcttgtgccgtcctgccaccagatctcgcgctgcctctgtggatcagatgaagcgccgccgccaaagacgggagggagcaggcgccaagctgctaaccctagcactggcggcactgccgctctactcccctttcttgttttttttttttttagagatgttgcccaccagctgaacgtatatgtgctacgctaatgggcttgtgggccatatatacgtgagcaagagaaggtattgggccacttcggtcagtccggttacttcggtcggaaaggcctgatgaccgaatacaccgaactaagttcggtctttaaaatcgtacaaccgaactagtgaccgaagaccgtgatttcggttttttcgggttcgggttcggtcttttcgggtctggtcttcggtcctcggtttttatgcccacccctattaacaatcatgggaaaatgcactggtgatggtattctccagcatttgtggggttcgcgaatggtatttggcagcatgtcacattcactatggcattttccaactccaatttctatgcgatggtattgagcagatttgctctaaaagatttagttttatgtacaagcctagaagggaaaagaaaaagggaaaacagggtagcagactaaagcatatcattattcatacattttccaagaaaatattcagcacttttttagagaaatacttaaggataggaagcactaagaaaagagcccaaataagatatttatttagttccgacttatctgggggacaaaattcactaataataagtttgttgtcccagatgaaaagtttgttgttgcaagcaagttacttcgtgtcgatcatccgagccataaaacattggacaacttttacagtggttctattgaaagtagaactgatctagaccttctggcttttttcattaaacggaccatatttgtttatagtactgactcaataccagtggtacaaccaatgggggtataattgtccaatgaagatccttataaagctgtgagttaggttgtttctactggtagtattactggaagtagataaattccagtagagaccactatgaaagtgctctaaacattaatgtccacaatcatgacaaaataactatcatcccttgaggaaggctattgctgactacttgacattaggcaagcagcaagcaattgatgcttggaccaggcttcaaggatgagaagccttgcgcatcttatttaatgtatcacgactagatttcaggtgaagcttttcaatttgacttattggagatgcccagtaagccttacaaagagaaggaaccaataatgaaatcagtgattaccaggtatgctaaccaagatgccttcccactgatcaaacagagctccttcaaatttagcatccctgagctgcacgagaggattaaataaagccacctctgtatatgccatgtatgcaaacggatatagaagtttcacgggcatacagaaaaatagataagtcatatgatcaacaagactgattccacaaaattaaattccccatttctggttttctactaacaagtagaacaagatgaaccagccccactgtacagtatgcaaacgaactgccattttatcatgcccaatcctacatatagatcatattggctagctaaaagcgaatcaacaaaatactcttcaatagttccatttgtgctaatgcagtttcacatgactactttgctgattaaaaaggaaccccatgattaaactctaaagtccaattgctacaatatagcaaatcagcatgatttactgcagaaaataaataaattaaattcactcctgcagacaggcattcatccattcaagcaaaatgcagattatacacatggaaagcacaatgatatgcccattcagtcaaaggacatggtacgtgacgaatggagcaacagcaaggcacgatatacctcatgagaatgtcctctaggttcttggagatgactggcgccacctctgccggccgtcctggtctgacaagcggggaacagataggcggcatgtggaactccacagctgcagaacaccacggcaccacgccacaatagaaacgcagataaattagccaaacgcgcaaagcaaaagcactatgagaagataaatcaacggcaaacataccaatagatccttcgtcgggggcctcaccggagggcgacatcacctcgagcttgatcgacgcgagcatggcctgccgcaaacagatacgggaggcatttcgtcaaataggtggtgcacggacgcctaaatcaggaagagtggcggggagagggaggggtggagagcggcggcttggggggtcgtacggtgtcgccgaggcggacgagggcggagccgtgggcggaggacacggcggcgagggcgacggtggttgggcgggcctcggcggggcggcgcgcgtcggggcggacggattcgcggaggtggcgctcgaggaaggcgagggggaagaggcggcggtacgcctccacctccatctcgccggcgaggccgccggccgccgtggcttgggcctccgccgccatctcacgggtgggtgggaaaggagcttgggactggctttgtcgacaaagggggttttctttttggtttggggtgaacggtcccttgctagggtttaaggctcttccttttttgggcatcagttcgtccggtttgcattggggattttgataattttatgtaactagcaaaatgtcggtgcgttgtaacagtaaagataatatatgcatcgtattatgttatagatatagctttaaaaaaccatgatggttgtattagagggctagaaattcttacattaagaattagactttgttagttagattataacggtgtagattaatcgatatagttgtacatctttatctttacctattataaaagtttaagatgtttttgtcaaaaaaaatttcgtacgttgtccgactctatccacgcgcgcagttatttttcttcccttttctttttaccccgcatacgggtatatcgcggttcattgagatcgacttttttccgtgtgatttccttcccacgcgttggatctattacatgcaggccccaaatcgattgtatcctggcccatgtcccacatcccacgtcatccttcaattccatccttcagatgacgtggtgacctttttttcatctatccatatctctatctccatatctactgttataaaaattagaaatgtttcccctaaaaatttgatgcgtcatctgtgtttgaatcggttttcattttatgttttagttttaatttaatgtttatgtcaaatcctttccttttatcttatgtcaaagtgtccctcttatccgagacgtgcgtgaattaattgggcctgcacttttcacgtgtcccttgccgcacgcaatgccctcacgcccgtgattttctgcatgccagattaggcccgcaacgccctcgcgtgcgcgatttgcctttgccgcatgttcgattgagattgtgtcgccctcgcccgtatctgaagatgtttttgtcaaaactatggtacgtcgtccgtatctgattcccgtcacacgtaacattcattgcaaagtaataactcgtgagtgaactgcgaaagagagttcgtgtgatgtggataccaagcgaatgatactcacagaatccgtgtggatatcacatgtattgttgctcagatcatccaattctatttgtattataagacacgatttctaggatatgttagcatgatttcaagtcagtctccacacatgattgtacgtactaccagggatgtcgttacaataaactgtaataatcaattttactttcgaaaagaacatgccaactgaaataaaggatgatcaaagttgctgatttcgtccgctatcaattcatgcccaacttgagataaagctggacaacaaatcgagctcgtgtttgaaggccttattgtttggcttatgcttattcctataagccaaattttaaattttagaacttatttacacacaaatagtcttttatttgccaataagtgattttggtaagcacatgaatagatgaaacaatgggctgtgattatttttccaccgatacatatgtataaattaaattggctctacccgttgcaacgcacgggcatcttttctagtaaagtataattttatttaaattgtagaatgggatacaattatatttatgtaaacaaccattataccaattcaataatatgttgttccgtatagaaactatgtttcgtatagaaactaaaatttccatatttaaagccagcggataactaaatatgaagccagcaggtttccaaggttgttgatatttcttaatgatattactaaaaatataatttctagcaatgacacccgaaatattactcggtattctttacggttacagatataatctgcaagcgcgcggatacaccgctgtagcattttacccagaagtattttaaggtatcatatttatttaatcctaggaaaagatatgataatagagtactatgctagaaatttatatcactcgtacagatcaaagtctaatgcaggggttcatcaattcaaggatagatagattaacacacagaaggaactaaccagaatactctcactaaaataataatctaaactaagtggagaaagaataataacataatcatttttgtacttatagtatatagtcattttagtctgcacttgccattatacaattatgtagccaatatccccaaactatgccctcctggtatttcgagaaaccacccctaattgctgagtttcttacgacaatctgttatggccattcaactggtaatagatacggaagagtacccacaccaggaaaatctcttagccctatatacgcacatggaggaatactcgtggcatacatcaccatttaatgttatctaataatctaagcaccacgattacattactaaatattactctacatctttgcagatgacatagagaaatcatataaatgaatatcaaaccaataccattgcatatctccagtaagctagctacataattattacgagacaagtatgaactaaagtaggtactcaaataattatataaatgaagtaaaggaccaaaactatacaaagaagaatatttcattactgaattaaatcttacaagagagagaagagttactagagtcatactcaaaatctccagaagacttgaagaactaataaattattctaattctactccacaagcactagacacaaagtaaataaactagagaactcctgcttgatcctccttggtgtgtattgaaatggagagggagagatccttaaatagcctccatatgacggctgtggtggttggaaatgttctaaacaccccgcaaccgtcattggggagcaatctaggacgtccacatggaaggcaaggatcagaggcgccggtggtggttcggccgaaccctggtgtaggatcgagatgtcgactagaggggggtgaataggcgatttaaaattaaatgacacctaatcaaaactaacctaagttgctaggcttggtaagggataagtctaactaagcaactaagttatgttttgcaatcctagggtgaaagtggctcaaataaaagtaaatcacaattcctaagtctagtttagcaatcctagggtgatatgatctcaagtatgtctctaggaatgtaaattgcacaaatgtaaatgcaacaaataaatgagacaaggagacagtagatttttcactgaggttcggaaactcgccggtttcctactccccgttgaggcgagcccaactccaccgctcaaccacaaagccaccgcacgcccccttcgtcaaggggtgggcaaggcgggagccagcccacggagaggactacccaagcctcgatcactcggggtagttcttccttcactccgaaggtggtgaactccaaaccagtcaacaccggcgccagggcctcctccacaatcttcccagagaggtcaccgggaaactcctccacaagttgtctaggaggcggcaacctccaagagtaacaagcaatgacgcggctcggagaagatcaagtgccacactagctctacaatgaagcaatgcacttgactcttggctaaatcaaccctcaaccactacaatggatgaacattaagctcaaatgtgtgtgagagaggtgcaaggggtgtatgcaattgaattgggtgccaagagagaccccttgctgctggtgggggagtatttatactcccacccaccaaaactagccgttgggggcgaaatcccccaactcagtgctctgccggtctgacctgaggtgtatggctggtcagaccgtgctagtctacaacagctagaatacaacttctagttttctagccgttgtaggcctgtcattgggccccattgccctagccggtcagaccgacgttgagtggccggtcagactggcctcggctcggtctgaccgaatacggctccgtcggctctgtatcgtccaaaccagagcaacaccatcccagcctccaggcggccggtctggccgcacaagtgccgccggtcagactggccaatcatgccggtcagaccgccactaggtggccgatcaaaccagcctctgacctgtggtcagaccggccctggtcagggcgaacttagtgaaaaggtgtgtgttgtgaaatgtgagcacaagtctagatgcataatgacctaatgtgacaattaaaatcatctctttgctaggtcattacccctcttaatagtatggcaaagctataaataaacaagcacaattttgatcacccaacacctcgatcaatttaaaatgaaaacactagtttaccgtcttctcttccttttgctttgcgccgtcaattttaatccatcgatagacatccatgcgcacacataatgcgaacctaacttaaaatatatagctcaaaagaacagttagtccacaatttgtgtttatcattaattaccaaaattaacatcgggggcttagatgcttcacctgggttggcccatcttttctcccgtacctcgcttgatggatcctaagctcagtggcatggtggttgggcccaattgcaggtgttctagtgggtttgtgggcccattcatccataagtctgccacccgtcgagctatgattgattgaacgattattttccatcgtttctcctccatttatatgaaaatctcctgtatacaaatactttgacaagtacaagtaaaaatagattatgcttaaaccaatatgcatgcaagcattgctagttctcctttatttccatatgtattgatggtcgaaattggtatataacgaccgtcaacaaaggtccaatttgagagctgggccataggtttgtagcctgttgggctttggctttgaccatgttatgtgtggctgtgtgagcagctaggtgcagcaggctcacgtaaggagaattgactcctccgacgatcaacgcatggccgttcgttccacatggttatggactaggacttacggacacaagtgatcgtaagacgtaccaaagctcaagcacgaaaacagaacgatcgaatcggagacatggcaaagtggtgggttatacacggcatgtgtgaggatgtgaattagactggggcacgaacgacgtacgaaagtaccggtaaaaacatcttcaatttttataaagtaaagataagtccgctttgttttatttaccacctaatccgcgtgcctcccataacacgctatcgggactacgaattgttctatttggtaccactttctctacttttactgtattttcacctttttttattccattttatttatttttcacatgtttctggacttatttgcccttggccccacctgtcagatccagagaggatatcctcctctctttggatcgattgatccatccatccgccccattctttggagaaaacggacaatatgctactctatttgtggggtttcaatgaaatgccacccactaaaaagcaaaggataaaatgtcacttaataggttacctttagaatactttgccactttgagttttgagaccaaaatatccctagttgtttagaaagaggatatccacatatttgttgaagctctcgctgaaaataaagcatttgaaaacggacaatatgctcataatatactgtcgggactgtgaattgttcttatccttttcatcgcgttgaagctctcgctcgtccaaatgtctctgatagtcaagctacccattgttgtttcctctttctagtgtttgagcttcaccttgttctcgggacaagaagcttcgtcgtagccaaccaatgcgacgaacttgatggcaccagagacgtaggcgatggaacgattgtgcatttgcgctcaagaaatggcgaagtttgtgggggacatcacggcagtggggcaacggtacaaacactagcttggggccttccggcgacaagatgttgtcgcaaatctgaacttgtatgacttggttatgtataatatgggtcacattctcatatttggttaagtaatctagatggaattctcaaatttggttattcaacttgtttggcttcatgtatgaatacatattacggatacaagctgccaaaggttttcataggttttctttagttaattgacatatatgttatattatcaagaactaaacattttagttctcatttcaggtagctggcagtattgcaatatcctgtcaaaaattgatcattgcatttagatagttcccatttctttacaggtacatgctatcaaaaagttgcatttgagagcaacactgtacaacatatggttacactatacatgctaccagaaaattgcatacatcagcttgaaagggtatcatgtacacagggcaaatgagcaaaaatgaaatcaagcaattccttctgccaccatcttctcttccaattgattttgggagcaactagaagagagcatgcggcgtcatgctgcgcgaccgataaagtttcatacatagattgaacagccatttaaattttcaaagactgagaagagttgtatacaaaatgtgaacaaattggtgagaggaggttaattatcagtgtgcacagagagggccacatgtagtcgtcggtatacacagcgcgctcctcgaatgacattggctcgccgtggagcttcacccaggttgtgacatcgttcggccgttgtcgagcatgtaggtttcgtgtagtcccctgtggagaggaggagaccatggtgatatgacctgtggtgcatggtccaagcgacatgatgtggcagctcaaaaggttgcggtaagggtgaccatgtctcgccaatgccagccctggcctagtcaaccacctctaagctcggttccgtaagcaagcttgcaaattatgtctttgtggtaaatcttgctatcgagcttgatagcgttgtacttggcgaaccggtgaacactttccctgagctggtgtcagtgatgtcgctctcaacattgttggcgccgttggattttccggtgatgccgatgatcttcgaaccaaccttgatgaagtccatgccaataaggtgagcgatagggggtttggtgagctcttcaccaatgttgaagatgctatgtcaatgcagtgtgcacgacatagccgaagtggtcattgtggccatcttgcaagatcagctagaggcgtaaaaaggcttcttggtcctctaatgatggtagagccgctgatcctcatgcatcggtgttaccatctgccacaaaccagagtcgccaaagtttgttgtctagcattgaaccccaaacaacggtgggactctggctcagggaacatcaaggagatcaaaattcgtggtacatgggtgatagtgaacaccagcaatacccatagtcactatcgtcagagatgggtgacagtgaaagccagcaataaaatcgacgacctcggaagcttataattgtgtaggcgagctcggactcagagatgaacaatcatcgtcagacgctgcactcacgtggcaatcgacgcggacactgagaaaacatcttctcatacgacgtggtgaatgttggtcggagtactcctccatcgtcaacaccgacgacgaaggtgtgcacgatcctacaaaccaccgatgcaaatggagtgatagccccaagctctagggtaaagcttggaagataggcacattaaggtagacgcggtggaggaactcacctttgtgtgtaaggaaacacaagcaaacatatacgccaggagaggaaggaagaacaaacaaaattgtgacagcacacaaaggcggtaactcatcctcatctaagctagccactggactagccaatcaaagagaaacacagggagtagtaagttccaactaacaaacaaaccggcatctgcacgtgatggtaaagcagcgatgagcaacctgatgaaatggtaaataactcacccagatgtaaataaggaaaaagaaatgaagacgtgtcgcaccgtgagacaccaacagagaccaaaatctatctattgaaaaattgaaaagaaaccagcaactttgccactatcttctcttccaattgctgctttgcccttggggcctgctcctcgcctcctcttctcaaccaagggccactgcatgatgatgcgacggacgaggcgttgagatggggatagcgacgtcgggctgtgcgctcagtggctagggcagcaccaccgcagggcgcacagtggctggggtgatgctcggcggcgacagactaagattgtgaatttgggagagaacatttctttgatatgacatgtgggacaagggcaaaaatgttgacaatctaacaaggaaacaaaaaatggaattagaaaatcagaaatacataaaagaaaaggaaaaagtggtgtcaaataaaacaattcgcagtcctgattgtatattatagaaggcatgcaattaggtggtaaaaagatcaagacgcacgaattagatggtaaattatcaaaattcatgcttgcaaaagtgacagaagaaaaacttctaaatacggagtatatagaaacaatttgatactagtaatttgctcgtgctaacgctacggtaatatttagtaatacaaattaaataatcaaaggaatacaatatatgtttttgtcaaacaagcataaaatagaaggttcaaaattaaacatgagttattatatgtttgtaaaaaagtttcatgtttcgaaaacatatactccctttgttacacactgtaagacattttgacatccttgtcttgattcagtgatatgcatatcaatttggacaaatatattaaacatatatgtagatctctctatgaatctattcaaaatccaaaacgtcttattaccgtgaaacagaggaaataattcctaatgcacaacttcacaatcagtgcgtagacataaaaatcgaaaccatccatcaactctaatgtttttttgaaacgtataacggcaaaagacttgcaggatatattagaagaaataaataaaggttacaaaaaatcgcagactctcatgtagtaggggcctgtgttacgatattacaaagattgtgagcccccctaaacagatctctagctcaagagagtctagagctaataagatggcctatattttcctttatagcaaaggcgacctgcaactcattttgtgagacatgttggaagattctacggtttcgctccaaccagacattccaccaggtagttagcacggctcctaggatttgttttctcatagcggttggcattacagaacttaggatatcccaccaatctgttgtgctttcatgagtcgtttgttgaggaaagaaagaactatagcccatctaacttgaggcgtggtgccaaactctgcttgtgaaaggacactatttagctaggtgatttgaatcttcaaaagcacttctacagagactgtatatccaatcacatggccaatgtctcttgagaaggttttcagttgttagtgttctttggtgcaggatcaaccagccaaaaaaacgatgctttggttcagaatgcgttgtccaaagagttgagaaatttgtatgtgttatctccccttgaaattgcatttgatatgcactctttgccgagtattctctatttgcagtccacttccaggagatgtcgtctgttctttgttcatctaaaatgacaccctgtattttgctccctagctgaacccgttcctcaatctccgaaacagatgtaatcgggttaagcatggcaatccaatggttgtcttgcagttccacctggagattatttccctttcttttggcaagcttgaaaatagagggcgcaatgtgttgaggtgctcttccatcgagccaatggtctgtccaaaacctgattttgttcccatttcctatcgagatctatgttgccgcctgaaaaagggcatggtcgattttttcgcagggtgtctccatgttaacccacggcttagtttcatctttccatccaaaccatagccagcgaagcctgagtgctctcgagaatttttctaggtttagaataccaagcccctccaaatactttggtttgcaaaccgagttccaatttagcaggctacaacccacggaaacacttccggatcttcccctttccacaaaatatgccgtctaaagcagtcaattcttttgtaaagccatttgttagaaggaatgacaaatatgtggtaaattggcatagctgagagagtttatttcaccaagaccttgcggcctgtagctgtgaagaaacatcctttccaccctggaatatgaccccccccccaccttatcaattagtggttgtaagtctaatttcctaattttcttgaagtgcagggggagactgaggtatttgcaggggaaagatttcaggcttcctgtgaaagaagggagaaggccttcaacatcaataccagagcatgatattgggaagatttcagttttggtgagatttgtgtgcagtccacttatttgagcaaagagggaaaggatcttcttcagtgcttgaaggtcattttgtgatggtgccatgaagagagcaacatcatccgcatataaggagcatcggaatcttgcctgtctttgaggaagattagtgattacaaaggactcttcctccttctttatgatctgttgcaaaggttccatcacgagaataaacaacgttggtgatagaggatcaccttgcctgagcccacacgcgtgattgatgtgttcccctgggattccattaagcaacactctggaagatgaggttcccagaaggttggagatccagtttccccatttttgaccgaaccccagattttgcagggtttcgagaaggccttcgatatgtccaccttgatgaagagagtgccttttttctttcgatgaagcagcctaatcacattttgcatgtagaggaaattgtcatgaatagcccttttttttatgaaagcactttggttttggaagaccaaatcatttagcttgggttatgatagaatttgttatctcatttacttttctgtcatcttgcaaaagacctttgtctccgaaaaacttagcattctctactcaatgtctcgatatctatgatgaacatgtgcgtttaaacatcaatgataaggacggaacaaaagaggacctgtgtgtgtgccagcaatatttgtcgacttcaacaacacacacacagatatggttaccaatgaaaaaaaaatgaaaataatgcaattcatgtatcaaatatgaagcattatctcattaccagatggttacctattgagaagttaatatatataaaaaaaatcaatatagtaccaacactgagtagtatgttgagaacatcatcatatatttttgaaacagaaatcaatctaccatgtttgaaacaatgtaattgtatcccacaagtatatggcacactacataattgctctgtaccatatgctatgtcagtcaatactttccttgtagcctatgctatgtcagtcaatactttccttgtagcctaaaagcaagagtgtatcaaaagaatgtattaataccatgtgaggaacaccattgagctttaacattttaagaggccccatcacaaaggtcagaccgttgagaatccaacccattgctagccaagatgcagttgatgttatcagatccttcttatcatttggttgaaacagatgactgcttgtgttgaagtgtgagcctgacttccccaaactccttgcaagctgcaggcatgaccccaaacaaggaatttagtgcgacattacaaaataacatttgtttttagtgccaactaggccatgagtgtagcagcaagattgcctacattgttttcctaaatgaatctggttgttgaattgattcatgacgcaaacaattcccagaaaatcttcccaatcaggacctcggctttgagaaaaaaaacagtgagtgaatgaatattgaaaaaaaccattatgggttgctctcattgaattttgcctttgtgaacaaccatggatgtatatatcctatacaccatagaaaacaaatcggatcacttgcaccaccattggttaagaccaatgccatcactgttgcttcctccatcattcaggacaaatggtgttggaattaatgaatgggccttagcccactcgaagattaattctttggaaaatcacaaaagctcacctcatgggatgacatgcatgtggagtttagtaccaccttgcttattctaggagaggggggcctccttaaaagggaggatgccctcctagccacttaaagcatgtgtggtggagagaagaggggggaacacacgcgcgcgctcgctctcctcgcctcgcctggcagttcggttacgcgcagtggagatcgtgcgcgcgccctgatcaagcgacccttctcaatataaaccgacccgtcgtcttcacgcaatatacgcgaaatcaatctagggtttgccttcctactctgtgctgcaccgtcgctcgtagattactccatcccgctcgccggcgtgcaccggcgatcgcgagagcaggtctccggaacctctgcctttgacgtcctgcaccgggagaaggcggcaataaggtttttgggaagtgctttgcgcgactgctccctgttcatccgcgacggctcgtcttcctcttcgctcgcgtgctgcgtgccttcgtagacgcctgcgaaaagtttcgatcaagcagccagtctttccgccacctcggtacgtgttcaatatgttgcgcatatttgatctgttcatgttatactgtgtagtttacaagtgtagatataatgatgcgttcatgctaattttcatctgtaatgtcatgatttatttatggaatagattaaatcattatatgcctataatctcaacaatccaaaaacttattataggcactgtgattttactatggctggttttgccgatgcactgaggccggataaatttaccggtgtgcattttaagagatggcagatcagggtcactctgtggctgacagctatgaaatgcttctgggtgagtactggcaaacctgaaggagttcttactgctgaacagcagaagcaattcgaggaagccactactctctgtgtaggatgcattcttagcgttcttggcgatcgtctggtcgaggtgtatatgcatatgaccgacgcaaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaacttgaactccttaagtgtgttttacccgacaaatttgtggccaggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaacttggtcatctggctaggaagtgtccacagcgcaaggggatgaaggcacctacagggcagacttctaagtctgctaatgtgaccattagcaacactggagatggaagcgggtatggtaatttacctgctattttttcagttaatcagtctactaattggtgggttgatactaggtccaatgtacatgtttgtgctgacatctcattattttcttcttatcaggtcgcacggggttccaccgtcctaatggggaatgggtcacatgtttctgttcatggtgttggcacggtagatctgaagtttacttcgggaaagatcgtgcagctgaagaacgtgcagcatgtcccttctatcgacaggaatcttgttagtggctcccgtctgactagagctggatttaagttggtttttgagtctaataaagtagtcgtgtccaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggttgccgaggaaagaaacttggcaccactagaactcttacattcagatctttgtgaaatgaatggggtgttgacaaagggtggaaaacgatatttcatgactttgattgatgatgctactagattttgctatgtgtacttgttgaaaacgaaagacgaagctctagactattttaaaatttataaggcagaagttgaaaatcaacttgacagaaagataaaaagacttatgtctgatcgtagtggagagtttttctcaaacgagtttgacttattctgtgaggaacaggacatcatacatgagaggacgcccccctattctcccgagtctaatgggattgctaaaaggaagaaccgcacactgactgacttggtgaatgccatgttggacactgcgggactacctaaggcatggtggggggaggcattgttgacctcaaattatgtgttaaacagagttcctaacagaaataaggacaaaacaccatatgagatatggatcgggagaaaaccatcactttcttacttgcgcacatgggggtgcttggcgcaagtcaatgtaccaataacgaataagcacaaacttggacctaagactgtagactgtgtctttctgggatatgcttatcacaacattgcctatagatttttaatagttaaatctgaggtacctaacatgcatgttggtacaattatggagtctcgtgatgctaccttctttgagagctttttcccaatgaagaatacacatagtagttcgagccaaccatatgaaataattcccagttcaatcacaccaccagaacaaattgaacatacacatga

SEQ ID NO: 75495 - DNA, 10196 bp, Oryza sativa
caacgatgtagtcttccgccagcccgtctgccgtatcatcaaccgagtacgcgggggtaagttctcatcggctagatccttctttttcgcaatagattggttttcctcttccttatcttattttcccctttctctgttcttttggatttgtagcatctctccaacctggttgcaattccaagcctatcccatgaaaaccattactttctcggcccaatcggcaaccttgatcctactgagttcatcattggccagaccaatagaattcctttcagattagccaacccaaatctaggtcactggaaaaatacttttaaatcttggccatctcttgagaaaacttcacctgagaagagctggattacatggtacaagcgcatgtcgactagcaagaaagttcactgggacgaaatcggaatcggccaagcgcttgaccttaccatagccaattcagctaaagatgaacctttaatggccgccgccaccacctatttctggtctaacaccatcaacgctttcttgttcaactaagggccgatgactccaactttaatcgacatcaccatgattaccagattagatataacttcatcggctaaccctatgagtctgaacaccaagaatcagtatgactttaggaccaagagcataggcggctggtccggttatgtagcagcatatatgggccaaggatctgtcactccccaagagcatgtagcttttctgcttatgtggctggagaaattcctcttctgtggatcaagctgcggcctgcaactaactggcagtttgtagccgaggccttggaatcaaagagacaattccccttaggcaaaatcctcctcggctatttgtaccaaatgttgaacaatgcatcagctaagatagccgtcggctcagtagttggagcaggtggaccatggtggctactacaaacttggctaaacctgacggccatgaaattcgtcaatcggccatctatgacagaagccgaattcccaagactagagccaatcatagaagacgatggggaggaacgcaccaaccgtagatgcacatcctatggagaatatgcttccacaccagccgacgcaggggcaaagctatcagctgaactgcttaaggactagttctgtaacttttatgagggctttcagaaagatgctcgaatttggttccctacgaagactcagcacttctagagcatccatcggactttagatttgaagacatcaaccatgaaagataccaaaagtccagagaagtcttctcggctgcaatcagcccatgcatccttcctgttggcattcatcaagggaggaatattcaagtctcttatgagttctatcatccgatgagtgctgccagacaacttgggatgggtcaactaccaatcggtctgttctttgccgataaaattcaatgccgaggggaaatttcatcgaccctaatgatggataggctgctcaatcttcacggacctcctttgggcagtattgaaaacatagagttggcaacctttaggagcagatcatttgacaaatggtggggcgaatggaagctgcatctgttccatcaatcggcttctatgtacatgacagatctcttcccgaacattgtccctcaggtatatcttggctttaatctcgcttgaataagtgttagctgattcacaacttgactaattttcttttctattttgcagacaacagaatcttcccctccacaccaaagcaatagtggcagagacatcgaatatgtcccaggtctaattccaaatggaggtgggccatctacccccgtcatcggctatcatgcccccaagacttcaactcttctccaagggcttattagagaaccagccgataccggcaaaaagagaaaaaccagagcatcggctgtagacacatcggctctagccccaaagaagaaagctaagtcaaagaagaccaagccaaccgatgacttgcctgccctagatccatccattgaacaagctctggatgaagaagagattggagaagatgttgatcaagctgcagccgaagtgagcgatacagagaaaacaccatcggcttcgcccaagcagacccctccaactccttctgccccagctcatttctcgagggtaaatatctttccctggttcccttttataaccattttatcctcagccgattacttattaatcttgcctttgcagaaaaagagaattgctatgaagaagaaatcggcagcaacaactctcaaaccggctccaccagtaagatgttcttaattttttcaccagttgatctcagccgatcttgtctaatacttgtctcttttcagcctcctcctcctccttcttcccctgtacagcaatcatccagtgaccaaactccatcggctatagggagtcaccatgttgaggaagaagaacaaccagccgctcctgctatcccagtaagtttccctttgatacaagaacttagatcggctatgtctatttagctcctaactctcttgaaattgttcttgcaggtcttagccgatctattctcttttgacatcaaggacaactttgatgagacagaagaggacaccacaagcaaagccatagcccccttatccaatgatgtgaagaaaactcttgaagatatctctcatcggctagaggcatcttctttagacagcttggtggtcgactgtggatcaattagggctcggctacacgaagttcaaactctgattcctgaagaactagccgatgtccttactccagctgcttatcttgaacagcatcaattcaaactggagaaagccaagcagagattagtcgaacgccgagaacgcaaagagattgaaactacctgtcacgcccagaaattcccgaatagaattccaagcagaatatgcattaaaatccccatccaggaccggccagggtatacaaacgacaatgttgacattcagatccacgtcttacaaacatcataaaagtcttacataaatgcagcggaaaaacgaaagataacaggagctacgccttgacttgatctatagcgggaacaccactccacaggcatcctcgacggcacggacgaagcctactcctcggagaaaccaccatttgacacatactcgtactctggggttggggaaaatagagcaagactgagtactacccactgtactcagcaagccatactggaataggggtatgatgtagggaattatcaaaggagagctagagtggttcatttgcataaagcgagcatttaaaaacagaagttgaaagaattaaacagttgtaataattaatcaatattattcatccactgtccaatgctataccacgttgcgacaggcctaaccatccacctatactatccaatttcattagactaaactagggtgagactaatcgcggtgaatctggttgaccgcccataaccgcgggcacggctatttaaatagttttactctgatcagaggtgtacaacagtacccacaagacacagccccacgacacattttcgtgcaccgacatgccaccacgacataccggaaagaggtcgtgacaggacccttcgcataaccccctctaaccaagcacaccacacctcaggtttcacccccactcctcgcaaggcagcgggcagtcccctctcgtgcctaggtgaatccggaagcgacagaggccgtcgcaggggccaccccggttcatcacacccacccttgcctagatgcgtcagctagaggaaagctacactacaagcccagccgctgcccacgctggcttgcggtaagcacgataaattcttccatgttttctgcgaaccggtccttaattgccatgggtgcgactagcaaaaccatgcacccacagcccaccatgtgattcattttaattaaccaacaccgaagcggtgtcactaatccaacaataccattagaaccaacagtctaaacattaataggattttccccattatgtactagttgaactaagcatggctaagcaatccctagtccaaagtctattcatgttataacccaagctaacaaagcaacatggtaccaaaatagcatggctgtaacaataggtaaacatcccatagtaacattataaaatgatgcagtatttgaagaaaaacaatagagcatttgcaatataggatcaacatgttcaagtgacaagcatgacttgccttgctctgctgctggaggaacctcggcgactatttcgaagtacaccggagcgttggaagaaccggaatctaagcgacaaacaaagcaaacaatacaaacaggctataagactactgaaacagagaacaaaaccatttttaatggattctacacatttttattgattcactgagacttgaatgggcttaaacagagcacggatgaattagttatgaattttagaagattcattgtatttattactataacaaaaagtccttaaatcatttattgcgcaataaatcccagggctgacgtcatcaagggggggcggcgccgacgggcggggcccgcatgtcagcggctcaatgggagagaggggcgccagcaagtggggcccccgggtcagcgacccaaggctgccggtccaccgtggaccgggaccacgcgggtggtccaccgctggtccatgggaccgacggcctagatcgccccggggccgatcggacgggcggcggcgacccggctcagctcggctcaaggccggccgaccggccacggcgatggcgacggcgcgcgcgcgcacgcgttgccagcgatggcaaccggcggcggaggcggcgacgcaaaggcgacgcgaaggcggcgacgctaagcctaggaaggagagggaggggaatagaggggagaggacgcctcaccaagggtggccggcgcggaggaagacgacggcgaacggcgacgacgaccacgggcaaacggcggcgacgggcggacgaggtctggaatgccctaaggaaggaaaagagagaggttagagggagggagacgaaccacggcgatcggaaaccatggccgaaggcggcggacatggcggctctcaccatcgcacggtgggaacggcgctccggcagcgaacctcgacgaaggaggggtggacggggtggcccttgaccatgcgaacccaacgacggcgacggcgcggtgcggcggcgagcctagcggcggctagaggcggccggagtggcgggagcgccgaaggcgggtggttgcatggcgcgggagtgatggggagcacgagggagttcggtgaaatggggaaaaagagagagggggtggcggcggagcttaaatagggagagagggggccggacgtggccgggagaggcaggaatccgccggccaacgcgggggagtgggagaggagagagaggcgggattcaaaaatcgaatcctggccatctcgggcgcgggcgcgggcgggagaaaagaggggaggcgggcgcggaaggtgcggcgcatgcgcgggcgggagggcgacgtggacggcgtggcccgggagacgcggacgtgggcgcggcggcggtttcggcggtggttgcgggcgcggcggcgcggcgcgaggtgggagacgggtccgataggtgggccccacctgtcggcgacccgggtgagaggaggcgggcggccagcccgcgcggcctagctgggccttggccttcggccggcccagcaggaggggaggaaggaaggagaatgggccggccgcccattcaaagaaaaagagaaaggaaaagaaatgaaaaagaaaaagacttttcccagggatttaaatattgcttatgctcaattttaattggttaaaactatttctagggctctgaaaattccactaaaaatcctgttagcgaatttcgacatgtagaactcaagaaaaattccacatgccaattccgattattatttgcattaatttattaaggtttactcttgctttacacatgtattttcttgagaccatttataacttcaatttaggcttgggaaagaacttcgaggtgtgacactaccatccaggccaatcagcaactcgtgcatgaagagaagtccaaacttgatcaactatctgaaggcccgatcatgtctaatattgatcggcttgaagctcggaagattgagctcttggcacaactccaagaatgcaatgccgaactggatctggaacacaagaagctagccgatctcccatagtttgtcgaagaacagaaggcaaggctgaaatcggctatcaagaatgtcgcagatatgaccaagtctctaaaagtcatctctggaaccgatgctcaagatgctcaatccattgaagaagtagaacaaattaggcaaagagctatatcggctatccagtgttacttgtctctgtgatatcttgtgtaatagatcttaggaaattttgtaatcggctaagaaactctggctctttatctaactcatcttgataatctttatgccgattcaatataactccacattttgctcaaaaatttgcaacttttcatatatgtgcccccctaattttacaaagatgaaggcattgctaaaattataagttgaactaagggcgatataacaatatcggccattgcacatcggcagaccacaaccgattacaatatgaaaacaactaagggcgatataacaatatcggccatttcaaggtgatgtaaatacatcggctatcatgtatcggcaacaccggccgatcatgcattaacccaaacacttgggtaatatttcttcaactattttccatttagcgctcgtccataaacttctccatcgagtccttgcaacatgtaagctcccttagatacaaccttatagatttggaacggtccttcccaatttggtgaccacttgccgaattcgttatcccgagtcccaatcggcaaaatcaacttccacataagttcaccttccgaaaaagtcttgggcaccactttcttgttgtaatgccaagcaactcgttccttatccttggtaacctttgcaagggctctcaatctagactgaaccaagtcttccctatcatcggccatgagattataatattcatcggctgtcaaatcactttgcaactctgttcttcttgagccgattctaacttcccatggtaaaacagcctcatgtccataaacaagcttataaggagggacttggatcgatccatgacaagccatccgataagaccaaaatgctttggccaatcgagtatgccactgccgaggaaaatcagaaatctttctcttaatcaatttgatcaaactcttgttagatgcctcggcttgcccattagcttgtgcataatatggtgaagaattcaacagtttgatacccatgctatcggcaaattgaacaaactcatcgaatacgaagattgaatcttgatcggttgtaatggtttgaggaataccaaatcgatagattatatgctcttgaacaaattgtatagcatccccagaatcaaccttcttcaaaggaatcgcttctacccacttggtaaaataatcagttgccaccaatataaacttatgccctttgcttgatgatggattaatcatgccgatcatatcaattccccaacctctaaatggccacggtttaatgataggattaatagccgatgctggtgccctctgaatcgctccaaaattttgacaatcttgacatccttgtaatatttgaaacaatcctccagcattgtctgccaaaaataccctgcacatcgaagcaaccacttcatcttatgagccgattgatgagtgccacaaattccttcatgaatctcaccgattgcaaccttggcctgatcggcacttaaacacttaagcaacaccccatcaatcgtctgataatagagctcatcatccaataaagtatacttcaacgctttatatcgcaatttccgggaagccgattgagatggattctgtaaatattgatgcacatcatatctccaatcatcagctgttaacgctgcaacctcaattttgatgtctttgattatcggtttatatcccgacgccccttgggtcaaatcattagcttcaatattctgctctcgagatacatgcttcaaagtcaccagccaaaactctttcatcagctctcggcacttctcattataaaccattaatgtatcatttttgcactcatactctcctgccaattgactgatcactagcaaagaatcccccataatctcaatagcatcggcttcaacttccttgagtaattgcaaccctttgagaactgcctcatgctcagcttggttgttagttgcataaggtttaatagtataggcaaactcaaaacatgccccccgaggagaaattataactaagccgataccacaaccatgagtgcatactgatccatcaaagaacaaagtccacggcacaacctcaaccgagccgattgaatcatcacaatgatcaacaataaaatcggctatagcctgccccttggttgccttcggtgactcataccgaagatcaaattttgttaaggaaaatatccactttccaacccttccattcaaaattagagctgataacatgtacttaacgacattagctttgcatatgacagtgcattcgttggacaatagataatgccttaaccttgtacaaggaaaatataagcacaagcacaacttctccacactgcatccaagagccgacgacttagatagaatacaactctttctttccctgcaagctcctgaatcaagactgagccaatcgacttctcaccggccgatagatataatctaaaaggtatcctcttttgtggaggaatcaaaactggaggagagctaagatattccttaatactatccaaagccttctgttgctctaccctcaagtatacttttgatcggctttcaatcttaacaatggcgtaaaaggctctaatcttccagacaaattaaaaataaatcttctaacgaaatttatcttgccgatcatttcctgtaactctgtcttattctctggaggctgaattttcttgattgcattaacactcctttgagttatctcaatccccctctcgtgaacaataaatcccaaaaactagccaaccgatacaccgaaagcacactttgtcgggttcatcttcaggccatatttcctagtccttacaaaaaccttcctcaaatcggctatgtggtcctctatctctttagacttaacaaccacatcatcaatgtatatacttcaaccaaacagccgatcaaatcatggtatatataattcatggcccgttgatatttagctccagcacttttcaagccaaaagtcattacaacccactcaaacaagccgattgcaccaagacatctaaaagctgtcttgatatcttctttggccataaaaatctgattgtatcctgcatttccatccataaaactcaaaatcttgtgccctgaagcagcatcaaccagctgatcggctactcaatttcttccaaatcatcaaccgacatgaaaccctgtccttgcttgtcatcgagatcatctactatgtccttggtgtaaacgtttgaaccctccacgacgcccttaaaataataacttgggctctccatctttaattggctgtatatcataatcggacacttttagaagatctccatcccaaacttttccagataagcaatcgagaccatccatctcccaaagagctaaatcggcactggcaacattaactgacctgtcggctggcacgatttcaatcttgtcgccttgccattgaatcaagcattgatgcatgattgaaggaatacaacaattggcatgaatccaatctcttccaagcaacaagctgtaggaacccttcccatcgatgacaaaaaacgttgtagggagtcttactgccgactgtcagttccacattgaaaattccttttggtttctgatggattgccaccaaaatctttgagcaccatgtttgtcttgattagatcctcagcatttctgcccagcttcctaaatgtagcataaggcatcaaattcactgcagccccaccatcgaccatcatcttagacatcggcttcccattgacatagccgtttacatacaatggcttaagatgccgattatctgtcccttccggcttctcaaagactgcttgttccggtgataaaatcaacttagccgattcttcctccacttcatcaa

SEQ ID NO: 75496 - DNA, 16365 bp, Oryza sativa
atttttcccgcatgaatataaatcatatgtcagcagacatactcctctgacactaatatgtgtatttcgttaaaaaaatcatggtattgttaaggcggtaaggcgtaaggcgaggacccacacaccttacaccttaggcagtaaggcataaggcgaggcaacgccttatacagatagaaaaataggaaatgaaagactttttcgtaatatctagagtccaaggattaaaatggaagatgaaaataggaaatgaaggacttctttgtaatatctagagtccaaggactaaaatggaagatggtgacagatatttatctatccatccccatccccgtccccatccccatcctcaatcccatcggcgccacctactcgcctccgctccactgccaccgacggcaagacctctccgcagccgtcgcgtccatcccctctggtcctccctcttcccctgccgccaccgctcctcatcatcaggtggtgctgggcatcgaggaaggtggatctggctttgccagtggtcggggacgacagcgacaaccacataggtcagctattttcattcctcccccttcccctgctgccgctccttctccaggattggcttatccccttgattttgccctttctctagtttttcccgtaaagcggaggcagcgccttaccgccttaggggcgccttaacaaccatgatggtatcccaagatatggctttaaaaaaagtagttttttaaaatgatgttttataatgttagtaaaaccagtgcggagtgtacttaacataaataagagccatcagatacagacacatcccaaattcgccagagctttaaagaggttattcataggtgtagcaggtccagcacttatttcatcttttttttttacattatttgtccatccaacttgaccatagcaggacgaatactgtaagagagattcaagggaaactggcctagttaccctcttgccactataatgctagcccattcatgggcacatatcaaaaccatccatgacatttgttacatagcttatctgttatgacaatgattgatgtattccagtagtgaaataacacatagtgacttaatagagatgcaccaacaatattcacatgtcattgtcaaggtttaaaatatagccacataaagaaaatgataattacctatagcggttctcagagaagattctatataattcgttggatgttctgtgctgtaaaacttctccacagggaataaggttccagggatattcaacacaggacatccagagaagaactttgacactttcaaaccatcaagagtagcagaagtgatcagaactttcaaatctgaagctcgatccttaattaatcgtttcattaaacctagaagaatatcactgtaaacaaacaaatatcagaacgcgactaaagctttcaacaaatagcaacaaaatccagcggtcgtgtggccgatgccaaacaagaaaaagttagtactgactatcgatcactttaaaaatacaattgctagcttacaattgaagcatctgagaaccaattataataaatatgggcaaaatatggagaacgaaaaccacagtaaagttgcatcctacagttagtaaatagttactaggcatttgcgatccgaggccctcccattcaaagttgtccaggtaaacatctaatatagagaactatcgattatatcaaagtcaattttgagaacacatactagatgtctacattacttgtgagtgaaaatatcgtataggtactaattcctagcagtagagaaagaacgcatcagaagaaaaggcaaagctaagttgatttatataaaataggtacaggaagaccaaatataaccaatacatttatgttgactcccagtttcatggcacacagaatggcttcccagcactgttttgttcactgttccaaaaaccggacacataagcaacaaaagttcaacaggcatgcaatcaatcttgggtaaatctatgtagtgtataagcaacaaaagtttagcatattactataactaaatgtagtgtatgacccattcccggtaattatcttattttgttttcaaatcacaagttttcaattcaaacaacaagaaatgggtgtggaataactgaagagtaagcagcaaacttgataaagtgctaaactttaattcaaactcttatagatcagttgaacatataaaacgcatacgtgtttaaactgcgctcgtgagcttcatccagaataattactgaatactgcttcaactcagggtctgaaaggctttcgcgcagaagaacaccatctgtcaggtacctgcatatccgaaaatagaatgagttcgcatattgttcaagaagaaattcaagtcacataaacaccctctgaggcttactttatgcaggttttctctgaagttctatcttcaaatcggatggcataaccaacttcatcaccaaggggaacactgagctcctgtgctactctcctgcaaatattcagattgccagcattcataatggcatcctaaaaaacattttccacacttgaatataggcatagcacaagactacactggaaaactattcttctctgtacatgtataaatatgcatatgctgtaaacatagtgctgctcgccaggaagaaccacttcaaaatttcttaacaagcaggttcttaagttttctccccttaaaacacttctaaattaaaataaatggcttggctatccagaaagcagctgcagtttttacaaacgatgttctcgtatctccaccatcacgattctaaatttcaagatgaatctgcaattttcgtatcccttaagtgctaatggccaaaatccaacacatctgagagcttttcaggcataaccagacccacacgaacccagtaagaatgtaccctgagctaaaaggaaaccaacatttgaaaataacaacatgaatagaaagggggaagttgtactaaactcccaggtagcagataacaacgagcgcgcgcaggtgcgaccgtgccaccgtgggggaagacaagcgaagcacggagtcgggttacctggaaaccgagacggcggcgacgcgacggggctgggtgacggctatggcaccacggcgggtgtagccgcggcggtggagtatctgggagagctgggtgctcttccccgagccggtctcaccgatcaccaccaccactgggttcgcctccaccgcagccatgatctcgtcctcgtgctccgagatcggcagctccggcggcgacggctgcggcggcggcggcggcgatggcatggcggaggaggccgctgggatgtgttagggttttgatttgtttttgtttttcctcctctctctctctctctctctggtttttccggccgttggactgccgcccggtgatgaaaggaaaaagtccaccgaaggtccctcaacttgtcatccagttacaaaatcatccccgaaccacaccaggtattcgacgtacctcaactcacagagccgttcattttaggtccctcggaccccagttttttcctacgtgacggctgagtcagtatgagacccatatgtgcccacatgtcaggatgccacgtaagctcctctcccttcctttctctctcacttctcctctgcaggatcacggccggaaggggatgagtgcaggcggctggcggaggaggaggtcctgcgcggcgagtgcggcgtgcgtgtccgacggccaacaggggaggagggccagcgcgacgggcacggccggtgcccagcatgggaggaggccctggcccagcgtgtgcggcgggggcatctagcagccggcaggggaggagggtcgtgtgcggcgggcgtggctggcggccagcaggggggagtgcagtggaaaggagggccggcgcgacgggcggcgaggaaggagcggggctaggctgacgatgggcggggagaggagcggaggtggagacggacgcggcggcggcgccaccggcgacagcctcttcctcgccctcgccttgcgtcgtctcgctctccgctctgctcgacgggaggcgactccagcggtcgcccgcgcgtcctcctaaacttggcggtgttggccctcgttggcagcagcgacgctagctggcgaagactagcggggaaagaagcagcggccgtcggagaggagcttgacgttggcagtggcagccatcggctagacccagtgggcgccgtcctctgccaggaacgcgtagcggcgagaccggacgtcgagcccggcgggcttgtcggagaggtcgagctcgacgcccatggcgtgggcctgctccccgtttccgtcgaagaggaggagcacctcatcacggcggcatcatctgcgactttgcagactcaccggcctccccgcttcgccccgtcggcctccttcccacctgccggttgcggtggcggtggcggtgggggcggcgtggggggaggccctcctggtccggtgctcccgcgccgtcgcttcctctcatcttcttctccaaggccactataaatacacaatacacctcgccatgaacactcccaggcccagcacacagcaaagcagcagtagcagtgcaagctcgagctagctacaagtacaagctagcagcctagcaaagctcgatctatagcaatggcggcgaaggcggtgcttgttctagcggtgagcctcctcaccatggccgtggcggccagcaccgggtcgtcgtcgtgcccacgcgacgcgctgaagctgcgtgtgtgcgccaacgtgctcagcctctgttgttccctgctgctcgctgctcaacgaccttcccccgcgtcacagccgccgcccgctgcctcctcctctcctgcctcgccctggcggcctcctccctagctgctggccagctcgcctagagaagagaagagaagagaagagaagagtgagagagagagaggaggaggaggaagggagagtggagaggaggggagagagaggatgatgatgtggcatactgacacgtgggggcccacgtgggtcccacgctgactcagacgccacgttggataaatctagggtcaaaaccaccgaaggacctaaagtgaccggttttgattagttgtgggacgccggatatcttgttttatggttcagggatgattttgtaactcgatgacaagttgagggaccttctgtgtactttttctgtgatgaaatgaagtttcggcctcctgggctcgtaggcttctcaagcacaaatgttaacaatatggcccattcgtttcccttaattggatccatgccattgtaaatatgccatattggaaaaatgccactactattcatgaaatcgggtatgtcggagatatgggcccgggggtatgtggagtagaggagaattattttccttccggccacgtgactccgcaggttggccccactcgcgcgccacgcgagtcgtagaagcgcgggaggggggggcctcggggcatgacgtcaccccctcgggctctcccgcggcttcgccccgaggccctcgctcggctgccgcgcggcagagagagagagagagcaagaagggagcgcaggctgaatagccataaatgtgcgacgccccaactgtccctcaccgcatttaatgcggtcaggacagacgtgcggcgcgcctagctaacccctgtccatcgggtatgaccggtttgtgaccggcccgtctccgtcccatccgatggataaggcaatcatgtcctcatgtcgcccttgtccccggcggagtgggggtgggtatgacccgtcacatccggacgctactcgaggaagggctgttgcatgtcatcgttcatttataagggaatgacagggctgacccccgtgtcaggggggacggcgccgagttccgcgcaagaatcggttattggttagcttccgagagaaggcacggtttgaaacccaaaaaggtggagtggggtttccccccccccccatggaggggaagtagaggtggcacatgtggtatccccttaagctataaaaggaggaccctgcccacctaggaaagaaaaggaggggggagagggccaaaaaaagaaaaagaaaacccgaactccagaagagaggaagcaagtgcgctctctcaaggaaaaaaaacccttgtaaaactcatccataatcccaaacacaggagtagggtgttacgctcaatagcggcccgaacctgtataatccgactgcgtgcattcactcctgagagtcgtagggacgagcaagcgactaacgagagacgagcctccggccgaactcacgaaaggagggtctcacgactccccgctattgagggtcttccctcgacagggtagataccactgaaatcttctaaaattagaaccatgacactccatcacgttttccgtcatttttgtcacattttctgtcacggtgccttcatctccttgtcgtcttcatctccaagcagcgtcgaaggaggacgagggcacgacggcgatggggaagggacaagagggcaggagagctcctcggcgagggcggcggcgagcaggacacgcaccccgccgctcgatggtactgctgctcactcgccgctcgtcgtcttcgcctctgggctttagcctacgccaaaggaggaggagggcacgacggcgatggggaaggggcgggacgggtggagagcacctcggcgagggcggctgagagcgggacgcgcaccacgccgctcgcctgtcctgccgctcgtcatcttcgtcttcgtctccaacctgcgccggaggaggaggagagcacaacggcaatggggaaggggtaggacgggacgcgcatcccaccgccgctcgccggtaccgctgctcgttgtcttcgtcttcgtctccaacctgtgccgagggaggaagggggcacgatggcgatggggaaggggcgggacgggtggagagctcctcggcgagggcggcggcaagcgggacgtgcatcccgccactcgctcaccgctcgtcgtcttcgtctgggctctagcctgcaccggaggaggaggtgggtgcaacggcaatggggaaggggcgggagggcatgagagctcctcggcgagtgggacacgcatcccgccactcgctcaccgtttgtcgtcttcgtctgggctccagcctgcgccagagaagaaagtgggcgcgacggcgatgaggaaggggcaggagggcatgagagctcctcggcaagggcagcggcgagcagaacgcccatcccgcagcttgctggtcccacctctcgctcgccgctcgtcgtctttgtcttcgtctccagcctgtgccggaggagacagagggaacgatgcgatggggaaggggcggagcaggaggagagctcgtcggtgagggcggcggcaagcgggatgcgcatcccgccgcttgctggtcccaccgctcgccagtacggccgctcgctcgccacgcatcttgctcgtcttcgtctctctagcgtacgccggagaaggagggcacgacagcggatggggaagggatgtggatcttacgaggatgacagaaaagtgaacggcgaagaaatgattataattttacaaaatttcagtagcaccaagtggatatcacgaattgtagtggcgtttttctgatttgacacatttgtagtggcatggattcaattaacccttgtttttctacactgattgactcaacacccaacagcttgcattaactcaaaaaggaagttccttctttatccagagtcctagtactagagcactaaattgcacactaagcgacaaacctgcaccgatgagaatataactctcttaaataaactaattaaagaacataaagaaactcgaacacttactttgacaaaagaaccatctgtcgaggtacaagcgagagaagatggctgacaattccgactttcttcgaaactccgttgcaagaatgttaacactccggcactccttcgtgaaattcttggaggaactttgatattttggagaattccttctagagcttcccttcactctctactaagccaacatactaaatattaaactacaagtgagctatactctagttgagctcaagttgtgtgtgttgaaggtgcatgagctcctccttttatagcctctatatgacggttgtaacagttatccaggccgagaatcgggcataaccatcattggaaagccatttgggacctagacatggaaggctaggatgagatgcgccagaggtggttcagctgaaccaggggttcgggtgacccctgggctccacctcctagtcttctctgttgactaggagactgattggtgggcccttatcgcggttaggatggtttggccccactttaagtcggtttcatttgtcaggtgggccctctaatcctggtactcgtgcatgattggttggagggtcattttcatcgcatgactagtgtattttctcattaaatgacctgcatacatatatttactaaaactattggaagtgattagtagtaaactactacgattaagttttgataatatatttgatatcttttatgcatgaattaatacctaaagtttgcacttaacgaccgttaacagccaaatggactgtagatttgaaacacatttatctcttttattataaaaatatagaataatagcatccatccatattttgccttttatagaagaaaacgtaaaatctataacgagaggcctcttgatctggtcttacgcagtgatacctggcgcggccatccgatttagtcgagaagcatcagagtttagaatttgagagaagcatcagaatgttaggcatccatgtcttttttcccttcttataaaattttctctcaaattacttatccggtctacaatccgattacaccattgtgttcgttgcaattaaatctttacaacaagatctaacatgattatattatgatgaaaacttacaaattacttttataattgttgatgtaaaaacacgaggcctgggaggatctgcttaactccagtgcaggtccaaaacttgcctttgggtgtgtgagcgtgccagttgatttgatcctacaatcaacaggaaactaagacaaagaaaatcgcggttaaatccataaacgatagccgatcggctaagtgccgatgagatatcatttatccttgagccgacgtcatatttgcatcgatcggcagtcattaagaaataaaaagaactaaatctactcgatcggctgcagatattaacaatatataatccttagatcgatatatacttaaatcaagtgattgggatagatcggtcgtcatgccgagacagtataaatcacttagatcgaaatatatactaataatgagattatatgtgttcatagcatagccgatcagatagatctagcatgtatcggctaatactccgatactactctatattaggatattaaagcgagtagaatatatcaaacaaaaagcctaatatacttaaatgcaacgagatcttaacataaagggcaaatttaacatgtcaaagaagcatgtaggataaatgtagttaaatcagataagatcggctgaaaccccaatactaccctaatcagcaaccaaagacaggctagagattaagattctaatcacgactcataagatcaaactcaactgatgaagctataagtatgaaaagaaggacaatatctagacaatcaagtcgtcggatatgtcatagagtggtagatatcctatataatctaagtcaacatcggtatttaacctaatcggctgccttctagtaacaattgttagccgattgtaggttagatagcgatattgccggagattatataagatatatgataactcgtcgaattacataaacaagattagagtatcatgaagatggaagcactaatctcgagaacgcaagccaccataacaagttttacctcttgttgaagatcgaaaccgatgcagctcaacctaaaagtaagaactcgtcgaaacaaaacgaaaataaaagggtggcgatgcgccgagattgtattgaacgtgtgttagtttgattacatggggctttgatctatttatacccgagaattacaaaatatgttcatatcggacacgactcttatctctaacaaactctaagataccataagtctttgcagtagacttttacctaaacatatctctaaggaaattacataaaatatactaactaatagatacaattgccttctcaggactctatccatgcgtggcaatcgtcatgaagcacgtcaacctaaaccgacaacatatgttgtgtcatattgtcggattcggctcaatcggctaaccccgtccgactcgaactctgctgatcttagtcgtagccgattcggacttcagccgatcttcactctgtttccgggacaatctctatctcgattcctccttcacatctgatccttggattaccaaattgggtcgttaacaataatatatctaaattacttttggatatcactaaattacttcttagacatacaaaagtaaatttaataaagtttaaatgtaatttacatatattatagaagtaacttcagacaaaacgaaagtaactttgtcataacattaggggtaattccattgtagggataaaaacataactctatctagaaactaaattaatcagcacaaattacggaattgactgaaaacaataataggtagtcacctcgtagcattatgaatgtataggaagtaatttaatcaaatctaaaagtactatacacacacacacacacacatatatatatatatatatgtatatatatgtgtgtgtgtgtgtgtgtatagccaataagagagcgccagtatgcatgcttatggatggacccagagagcagcttaatagagagaagtagaagtaagggcgctaagctgaaggaaaaggctgaatgctcctaagaaacacctgacctcaggtgcttttttctcttgccttctggatggttctaaagtagtgaacagcttccgaccattatgaccttttattgaatttttgattttgtggttcgataggaccagggagaggaccctgatcaccttgccaacgaattcaaggccttagaaaaatcatcctacaatggaccatagggactgagaacgaagaagacatcaaaatcaggttaggggggctttcacttcgacacgtcttcgttcgtgatcacttagagccccttttccatcaataggtactcccaaggcgtcgaccacacggcctaacatggcctttcccacaggaagcagtgcagttgccttctttctttgttcacctacattttcttgttctttattgaattggatttgactgaggacatcgttgtctaagcgtgcttactttgcgcaccggcacagctgaatgagaatccgctggctcagattgagtggctcactttcttgagaagggctttctattcgaggatttccaagagcagattgaaatctgtgttatggtttcagggtttgtcaaccaagtgcaggagggcgggtctcgctgccggatcaatgcgcaggacacacgatctacaaagctagaatttccaatagtgagaccagcttgacaagctacctttcctcttgatctgaggtgcgaagagaaacatctcttttttatgacttccacttctcgatcccggcccggaaaagtgaccgacccgaatgaaaaataagacctttgtgaccgtgacagatgctagggggaataaaaagactggggcctccgcaggtgggattgaagaaagggatttagccttttcaaaaaagaagctctgtcgctctcctagttgctaaagaatccggagctctctacgcattcagtagaagaagagtactccccttcataatgcttccttcttcaagtctttcgctagtgaagttgggggtagcattttacttttgttaagtcatggactggtttcttcagccctttttctatgtgttaaaaaaaggtgggggtcaaggtgtataatacgagctccactttcaggcaatgagctagcttaaccctgattgcttaaggtttaatacagttggataagggtgccagtgaagaaatcaagagaatatgctttgtgtggtcacaggaacaatcggcggtcgtagcatgaaaaaaagagtaccttcattttacagcatatagaggtattagggaaaacaacccggtggggtaaagtcgtcaagtggactatggttccaaccaagattattattcacgcacctacgatccctttcttaaagaaaagaattattacttgctaatcttcccctctaacgcgggccgggccgggcttaggcgactggggaagctgaggagagatggggaaacccaactgctgccggtcgggacggacaggaaaggggcggggttatcggagtgatcggggtgatggtgatagttgatccgtaactggtgatgaaccgcaaaggtttttggttagttgaccctgttaaccgtaaagaaaaggagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaacatgaacgagaacatactttcgaattgtggtaggggcgaacccatccgggcgggtggaagccgtaagtatcctatttttggaatggaatttcagtaaagtcttttttttctgctttatccttctctcaatcaaagaaacaccaatttcttattccccccctttttcctcaaaatttctaactggtaaagctcctcagaaattgcttttaggaaagatgcgtgttcggccgcataagccagataagaggcgaaccgtcaggtccttagtagcgttgacaaagaagaagagctgttgaaaaaaaagaaagctcgaatgaaactatccatggaatcgtgcgccgtgtgaaacatacagatggttgaggagacgaatcatgaaggaggattgtgcgactccacagaagagtacgcgcgctagaaaaggcagccagcttaaaaacgctaagagtattcatgctctaggttggtctcccgcgtaggactcgaaacgacaagaataaaccaagttatgagcttttggttgagtcgagggtgtattattacccgtttcactgacatctgccttcccttctctggagcagtactgaagtttaggactacccagtaggatgcacctaagcaatggttaggagagagaatcaatgtttagtagtaggcccagttcaccaggttctaccactgttcggcccaatcatagtcaaaatctgagtttgcgaacaaccatctaaccgtcagtctgaactcccagtccatcagtaagagaaagcttccgtttccatcattcagcagtggaatgtctatcgatcaaattattggacccgtgctggatgccacttttcccccgggcaagttaccttccaggggagttcccttgctcctgctgcgtacaattagccagttctctaattctacttgagtgaggaagaccttttgtggctagacctctattttccatatagtcagctgacttgcccgcagcggatccggaaggacccgcttcactaggcccgggccctggtggtgactatggaaggattccgtggtagtctctgactccctccaactcaatcaagcaaaatgatcagcagtctcatttatgctatgcctcacaggaagaaacccgggaccagggcatgtcgtgaaagacgcacacggggcgggcgtgcttcatggaagagtttggggtccaaagccacaccttctttctcccataggaacagaggtcaggagatgccggcagggcgctgcttttaatttgactgatggctcaaagtcaggataacgagcgcggagcccgcttggcaggcggcaggagctgcgggcaagtgcttgcttccggcgtcggcttgtagtctctgcagtcggcacactcacgcgcccgccactaccctttgatagatagcaagcagctcctataacttgatcgacaggacccaaccaactaaactattgattgtggcaaagcttggagaggttgaccttccttggtaaaagagcttcattagtacctttaataatagcaatggcagcggctttggatctaggaaaatgagggggggcatcatccgcatcaagggctctctcatctcctatttgtttgagccattcattatggtggtggtgccggggaggcagctgtaggaggtgagaagggccctgactccgtcccaaacagtgtactactatcggccctaatccaagccaaagcaccggataactcttactgaaggatagacgaagagaaccggttgggttgacacctggtgatgttagaaagaagacaagtgcttataaggaaccccaaggtgagcttatagctcttgaatcttatctcaacgaaaaaagtgctctctgaaccgaacatgaaagttgttttccatcagacggctattcacgtaactccactctcggcttggatagtcctccccatagtacagatgttttcccttctatcttgttgctccacctcctcctgtatctactattggttgactgaaaataaaccaaaagcaagggtggttgcactagctagccactctcttcgtagagaaaataaaagcagctgctggataaaaaatagtgttttttcgaatctagagctgtttggcgttccaatccagttccaacaatgcacttctcggctccgaggtgtggccgggtgagcagtctacggaacgtttcactgcctggcctcccgggtttctgagtgctctcactacgtttgatgatgaaatctagacttttcgcacatcttcagataaagcccaagtaggacaaagaaatgcaagtaaagacgcattttctacgggatcccgaaatcaccagccaccccgacctaattcatgatgagcccaccaacttcctggcgaattgtgcataagcatagcatttctggtcgaaccaccgaaccacacatctttttttggtgggagggtaccataataataaatagagtcaatggtgacagagccgtgggaagagcctcttcttttttgctgcgggggcttccattcaccagcgcagacaccgcaaccgagaaaagaatgcatgttcggcatttttggtcttcacattgctccgagaagcttcttttagttagccaagcgggtcatgtggataggtcaagagatgcgtaaacgtgcccaacaaggggtcgggagtgctactagggacgatcagagttctggggccagaggaaggggaacaaaaggtagaatatgcgggttatcgtagaatagaagcgagtcgcttccggcgttggcttgtagtctctgtagtcgggtcacacgacaggtgcacgatcgactttgtacactccatccttcggcccttcgcctataggtggcttggcgggcaagctaccttaaccctgctttcacgtggcgaatcggtatgtgatcactttacggtaggccaaattggcgtattaccaaaccacgcccccattaacacagcccgaacccccctccgagaaccgtatatgagaatttcatctcgtacggctctgacacaaataatcgaccttcctggtacagtgagactagtggatctgatggcacatgcgctacgagtggagtcatatgagcctcattcctgagttctcgcttcgccccttctcccacttggcaggcttggtatcatgtcgattgctcaaccgtacttttgctatcttacgtagagctgaattaggttttttcggtagtagaaatggggtagtgcattgaccttactcagtttattagtgcgcttgcttgcagagagtcacctctgtcccttcatctttatgaaaggaatcaaggcccagcccggctcgcgaacagtaatgaaatgtctctgaatctggtatccaaacgttgtaccattttgggcactccttgattatggcataaatctcaaccggtggtagcagacagaggggcgctcccgcttaggcattaggcacgagaaaggacatcgttctcggccgtcccttagtttacttgttcttttcttagcactttatcgaagatactataaatattcagggatatttactgtatcataaatatgatctatcaaaggaggaaaatccaagcgaaaaaaccatgttccaataacgtcaccaatatgagcatatcagtgattaccagctcctaagattcgatcggtccaaaaggcacatttgcacctaatcaactgaagcagatgcaggatccgaagtattcgactccggtccggctcagacgaaccgagggatca

SEQ ID NO: 75497 - DNA, 18457 bp, Oryza sativa
agcacagcattaagagtgctttcgattaaaacggcaacatcctaacagatgtacctaccaaaacaatatgcccggtgaaagaattctcaagcccacgcaatggttatccaatatctcggggaaaaaaattctcaagccccaataaaggttatttgtgtttcctcttttgtcttgtaaataacattttgattcactttcataaaattatacgatgatcagaaaaaggcagtcaattttgtcttgtaggaatgtacgtaaacgatgatcagaaaaaggcagtcaatttacacacttctccaatccgtttgcaccagacagctgcaagcattctgcagcatcttctgatgaaagccccttgtgaaatgtattcagctcctcaaaaacatctataaggggaagattcacctgttattatatgccctcacaaagcacagcattaagagtgctttcgatgaaaacggcaacatcctaacagatgtacctaccaaaacaatatgcccggtgaaagaattctcaagcccacgcaatggttatccaatatctcggggaaaaaaattctcaagccccaataaaggttatttgtgtttcttcttttgtcttgtaaataacattttgattcactttcataaaattatactgtggacaaatgtctgatagttttcctaaaaaaaggttatccgcgttagtccaaggtttgggttctatgaccggcggactggatccaccagcaacctatggactagcaggtggtgtccgtcttggcgccgaggggactgtggtggtgattaacaaagagtggggctcgggcgaggcacaattttcgtctgcggaggcatgtggacaacgacaacaccgtaaatcaccaattgaaaatattaaaacttaataatcagataggttacctcatgactatatgtttcagaaccagccaaagtctacagcatgccaaagtatacaaaagtctatgccttgcatatgttatggtctctggtcacctgaaatgtagatattaccagaagattattaccggttgtagaccatgcaaaagtctaagatgcaattgaaaggtcaatcctgagagaaaatgtagaaaattattagggcaccgcatcattctgaatttaagtcttccaaacacatataatttgtgatgaactgaagcagcacatttcctctaaaagtcatagaagtgtggataaatcgacatcaaactctagtcgacagaaggttttttttgtctacaccggaagatgatagtcaaagtgtcaggaaaagctccattatgaagtaatattatagcctaatctcaaacaatcaaagcagttttgtagtttttttttgttcgatatgctttaaaaactattcagatcaaatgaaatcaatttgtttcgtaatgcactcaacacaataaacacaaataatcagctgattatagttggaactgcaattgttttcctcaacaaaattagtgtgcactctcattaggaactaaagtacaatcagtagtgctgctaaataggacagcaggagaccaaaatttggtgctgctaactggaaagcgaattacatatacatggagctagcagtactcacgattcaattcctcaattaccccattgcatgccttgccatcactacaagaaatatgatcttctgtgacgaattcctcgtgacatcggagctcttcgtcattagcacattccattttatgacgattagtatgagatgaggatggcttagtgacgaaaaaaatgtgttcgtcattaacaccaactagaaatcgtcataaagtatttcaatgggacattgtgacgaatattaatttgtcatagatatatataatgcatttcttgaaaaaaatatactccctctatcccataatataaggcgcggtaaaagctggcacggtctccaaaactaatatttagcttataatttctcatatactataagatttatagcaacaaaactataatcatatgaaagtaaatttaaatatcaatctaatgatataatttttaacaaataaaatattttatattatactaagtgttggccaaatgtttaaaagttgaatcttgaaatatgtgcacaccttacattatgggatggatggagtattaaaagttaacgcaatttaatcaagtgaattaatgaggaaactaaaattttcctttaaaaatcatggacggaaatattttttgtaatattttacgtggtctaaattattattttaaatttttcgtgaattttcagagctcaataactaattttaataccacaaaacttatttaacctattaaaataaatagaaaacaaattaaaattcctctctatgtacttgggcctttttcagcccaagtattactctatccctccctcagcccgcagcctatctctccctcttcctccctcttcgggccgccggcccagcctttttgctacccctcgccgaaaagtccattttacctccctcctctaaattcaaataacttttcaggtagcaaagatttcaaatgaaaaaattgtcaataataattgtataacttatcaagatctacaacttttttttggtcatttttctatatgactttgtttcaataatttgaatttgaatttcaaattatgacaacttcaaacatcactttcaaatactaaatgatttcaattgaaaaagtcatcaacaacaaagttgtataactcatcaatatctataagttttatttttgtcattttgctatatgactttgtttcgataatttgaatttgaatttcaaattatgacaactttaaacaacattttcaaatactaaacaacctcaactgaaaaagtcatcaacaacaaagttgtataactcattaataactataacttttattttggtcatttattcatccgataaagtgatagtaacattgttcacaaaatttacacacctctcttataatttatgaaaccatatggaagatttgtaaaatttatgaacaatgttaaaaaatactttatcagatgaacaaatgaccaaaataagaattgtagatctagatggattatacaactttgttgttgatgacttttttcagttgaagtcgttcactaataaaattttctatttgaagttctcaaactttgaatttcaaatttcaaattgtttaaatagagttagattgaggaattaccaaaatagaaattttggttcttgatgagttctacaactttaatttaggtgacttttccatttgaaatcatttattaaccccaatttttgttcgaagttgtcaaattctaaaaattcaaaatttgaattgttcaaatgaacttatttgtaaaaaagaccaatacaatagttgtagatctcgatgagttctaaaattttgttgtttgtgatttttgcatttgaaacataaaaagcagcctaaaattaaatttgatgttgttcataaattaaaattaaaaataccataagatcattcatgtttaggcccaaatggcccaactatttctgaccgtccatctccgatctaatagttctcatcgccatccctaaccttagccccatataaaaccctcctctccacccctcccccctctctctctctccaccctcagccgccacactaccatccattctcctctactctcctctcctctcctctcctctcctctccggcttactccccccctcaccgcttaccgcgccgcctccgtctctgccgctgccaggctcgggagcggcggatctgccgccgacagcgccggcatccgtctccgcctcttcacggcggcgtctgagccggggcaggtatccctcccattccctcacctcccctctcacctctcctctctcggcgcggattccggccggagcagctgccggagggcggtggcggcggcggctccaggcggttcctgcgcggaaggtggaggcggcggcggtggcggctcccctccctcctcccagatccggtggaggcggcggcggctcccctcccgcccgtgtacctcccgcgccagcccgccgcgcccctgctcctcgcgctcgacatcggctcgcgggttttcctcgctctctcacgcgcgaagtagttcggtcgtggtggagggatggactcgtgggttttttttctttttgttcgcagggactctgataaagctggtgtacacggcgagctgcggtggcggaggcgcggagctgcggtttgccaagttcgagaggcggaggctgcaggagtgttttgacttcgtcagggcgcagggtctcgtcccccctcaccgcttccccagtgtagcatcaccaccatggcgacgcagcggaggcacgcggctgtggcatggacacctactaccgccgccacctctccgggcagcagccgggagtacatgaaggccaaatgcagcatgtaatgcgctgatttaaacacgtacgaaaaggctaattctgcacaatatctttccttttcttatatggtacatgaattattcattatcccaaaatatttgtaaatgctatgtgcagattataaaagctgttctgtaggaggaaaatcattcttgaagattgagtatcatgaattcctacatctagacagtctcgatgttatataaagaactgtataatttggtaagtactgatacaatgaatgtcagtgattcccatgtagcagataactgcaataacccttcaatcaaatctgggatgaaacgtgtagttgggaattattgccatgttgattagtcctatttctgatggtgtcgaaccaagcagtacaactgtagaagtagtagctttgcttacagagttggatatgctaagcattacaaatgcataggtggctagaatattagttcatttcatggaaagtaattgtacatgtagagcttacaattgtatcctgatctgaatgattattggtgtgtctgcaattgtacatgtagagcttccaattgttaaaatttagaccatcatgtcatagaattgcttaaggtgacataaattcagtaggaccctcattcttgatgattttgggttgtcatgcatcaaaggaaccttcaggaagtttcaaaaagtcccacataattgggttattactaaatggagctgctattgcttctctctttgaagttatcatgctaattaaggcaagggcacttatgagatgtatgtgtttgtgtaatacatgaaattgtacctcttcagttctgtagttacgcagccaatggcgcagcgagcttgtttttttatgatgaaatggctagcttcggtagctgatttagagttttgcagcagcaaaataaaacgtgatagctgaaggaaaatcttggatttatggtagtattcatgcacatcaactggcattagacaatctcacattttgcttgcttaatttacacataatcaaagcttaattctatatataacatcaggattttgttgtgcctaagtaacacctcttttgctatggatagatgaatcggaagcaacaaggaagcatatgcccttttgtcgtttgattggccgcaacactcaggtcagcctcaataaggtttttgtctattctcttaatgttaccttgctaattcaagatcttttgattcgtgtgatttggatatgactttgcttaggtcaatgtgtgaacggctatttggcatttggctggatttggtggtcagtgacttgtactagtgatgtattatatctggtcagtgaacctgtgatgtaattgaacatgctttggatagtgatttgtggatgtaattagctgacttgtcatgtaactgatttacggataacctgtgatcttttttttttctgaatttatgatagcctgttttgtgattatgtattaaatgtgagctgaattttgttaattgggctataagatgtcagatttagattttaattgggctaattctgtttgatatatgggctttttgagtgtgcatggctgtcacaccctgaagttcttctctcaagcctaaattgaatttataaatggtcctaagaaaataccggtgtaaaagcaagagtgaaaccctaaaggaacaagagtgaaaccctaaaggaattaatgtaaataataatcggaattagcatgtggaatttttcttgagttttacatgtcgaaatacgctaacaagatttttagtgaaatttcagagctctaagaaataattttaaccaattaaaaatgagcacaagcaatttttaattccctggaaattcttttcctcctttttctttcttttttcccttcctttttctttttgggatgggccgccggcccattctctccttccctcctttttcccgctgggccggccgacagaaccggtcgcccgacttcctctcccggggtcgccgacaggtggggcccacctgtcgggtcctcccccaacctctagccgccgccaccgcgctccgcaaccgccgccgcgcccacgctcccgcctcctccgggccacgtcggccacgcccgcgcgtgcgcccgcgtctcccgcgcccactccctctctctcccgcccgcgcccgcgctcgagacgacgggattcgattttcgaatcccgcctctctctcctctcccacttcccccacgtcggccggccattcccgcctctcccggccacatccgagctccctttcccctatttaagcatccccactctcccctctctctttttccccattttgccaagcttccccgtgccctctatcgccctagcgccgtcgccctcctctccgccgccgccatcgccgctccggtcgccgctagccgccgtgctgagccgcgccgttgcgttcgccgttgtgcgggccgtcccgtccacccctcctccgtcggaatccactaccggaatccactccatgccgtgcgccggtgagcaccgccatggccgccgcctttggccggcgtcctcgccctctcccattttcctctctccctttaatccctctcatcttgttcgctaggtggttccagagctcgtcccgccatcgccgtcgccctccgtcgctcgccgtcgccgatcgtcgccggtgaggcccctcctcccctttctccctctctcccgcgccgcttagccgccgcgccgccgcctaaccgcttagccaccgctatcgccacccgcgtcgccgcgacgccgtcgtcttccgccgcgggccggtcgccgctgtgtgcgcgccgcgccgccgcgcgccatggccgccgggccggcttgagccgtgcccgcgcgcgccggccgcgagccgcatccgccgtccgatctaccgggcggtagatcggggccgtccgttcggccgcccgcgtggctgccgcgtcggcgccacgtcagcgccacgtggtgcgccgccccttacccggtccgtggactccgtccaccgtgaaccgccctccccgagtcactgccatgtggggcccgcatgtcggcgccacccctctctctctcccgggatttatttattgcgcaataattcaattaacgatttttctgtttatagtaaaaacgcagtgaatcttcgaaaattcatatctaattcatccgagctccgtttaagcccattcaagtctcagtaaatcaagaaaaatgtgtagaatccatcaaaaatggttttgttctctatttcaatagtcttatagcctgtttttattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatggtctattgttttccttcaaatactgcattgttttgcaataatactatgtaatgtttacctactgttatagccatgctattcttgtaccatgctcctttgttagcttgggatgtgacatgactagatgttggaccagggattgcttagccatgcttagttcaactagcacacaatgggggaaatcatattaatgtatagactgtaggttctagtgttaatgttggattagtgccaccgtcctggtgttgcttaattaaaataaatcatatggtgggctgtgggtgcatggttttgctggtcgcgcccatggcatttaaggaccggttcgcgggatgccgtggaagaacttatcgtacttaccacaatccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctattcgttatgtcatggtggcatgtcggcgcacggaaacgtgtcgtggggctgtgtcttgtggatacagttgtacacctctgatcagagtaaaactattcgaatagtcgtgcccgcggttctaggcggtcaaccagattcaccgtgattagtctcaccctagtctagtataatggaattgaatagtctaggtggatggttgggcctgttgcaacgtggtgtagcgttggacagtggatggttaatattgattaattactacaactgtttttctgctttcaactactgtttataaatgctcgctttatgcaaaagaacctctatagctatcctttgataattccctacatcatacccctactccggtatgacttgctgagtacggtgattgtactcagtcttgctctattttccccaaaccccagagtttgagtatgcgtcagatagttgtttctccgaggagtaggctccgtccgtgccgtcgaggatgcctgtggagtggtgttcccgctgcagtccaagtcgaggcttagctccaattgccttttaattttccgctgcatttatgtaagacttttataatgtttgtaagacatggatctgtatgtcaactttatcgtttgtgtatcccggccggtcctggatggggattctaatgcacattctgcttggaattctattcgggaatttctgggcgtgacaagttggtatcagagccgaccttgaccgtaggacaagccaaatggaaaaacctaagagccctctgaatccttttcattgcatatattctttgcaattggatttgttccaggaaaattaggatctattcttgtggttcaagggaaaaatcttggtcgctagtttaagtgagatttgtcaaatcaagtcagtctagggttttagtaaaattatttgagatttatttgacagtcagtcgggatttgatgggaagaatgcattaggtcctaactcaggaatatgggttgctaggtatttatgctcttattgttattattagtaagtatataatttctcattatttgatcgctatgtaagtctgtcttatttattcgctctcatgcaaaatgatctatgcataaaattccgctcttactcgcttattttatttgagtcctttacagctttatttaaattggatttgagcatgcattgatcctacccctttgtcttctctagatggccgaccacccacccaaccaccgcggagaaggcgtggacgactttgtggcagagttggctcacatgaccctagtggtgggctaccccaacacgccagagtactcgactgttccgccgctcagtggcgagtttcctcaccgtgttcgtctggaggttcatggctatgtgggcacctgcctcgctaacatggtggttgaagcatctggaggcaccgcagatcacgcctgtcaagaggcagcatatcggatgatggccagacttcgtgggcgccacaactacatcttctgcaacacggcgtactatttccaccctcgccgagcaagtggtgacgatgtcaacacctttcgcctgacagccggtgagaacgacaccaccttcagtcacatgtgcgccgtgatgaggggaatggacaggatgcactcggatctgcacaagatgtccaaggccttgaatgatgggaagctcgtgaggatcatagctttgaaggatgagatagcacgcctgaagaaggagaacgctcagttgaagggcctcccagcgctaggaggagtccggatccgcaccacgccccgcaagtcgacgactacacccgtgcgcattcagcttgcgcccaggaaccgacctccgcccgcagctcccgcagctcctccagttccgcccacagctcccgcagttccagcagttcccgtagctccagctccagtcccggctcccgtccctgtgtcagctcccgcgtccgctctctccttcgctccagcatcagtcgccaggggtccagccggtggcaatggaggttggttgcctgctactcccagtggcagctgcgaccacagcagcagcagttccagtggcacagagccgggcagcggcgagacatatctgcaagactccaggagccgctcagagggacctggtgacgagcaggaggacgccttcgactccatcgaccgcaggagccgttccgagcattaggctcgctttcccttagtttaccgactgcttagtatttgtctattagtttgagtgtttaggtctgttcgcttgggggtcagtcgacggtcgatatcatgtgcctatgatatggctatcttaataaggatttgcttgctgttttaagtgttttaattcagatcagaacaattgcagtttaaattcctatataataaagcttagttcctgagcatctgtttttcttcttttccaccccctccgtctgctctccctccagatggtcaacaccaggaatggcagccgtgcagtaggtgagggcagcaacggcgaagaacgcaccgacggtgggcatcccaacagcgcctctggccacggtccaccaccactccccgagaacccgacgctcgcacaagtgatggcccatcagactcagatgatggcggccatgatgcagcagatgcagcagcagcaccagcagatgcaccagaggatgcagcagcaagccgagcagcagcagtttggtccccctccccctcagtccaagctaccagagtttctatgcgtcaggctacccactttctctagcaccaccaaccccatggaggtgaatgactggctccatgccataaagaagaagctaaaccttctgcaatgtaatgatcaggagaaggtcgcctttgccacacaccagctccagggccccgcgtcagcttggtgggacaatcacatggctacccgcccgccaggtacagaagtcacttgggcggagttctgtcgcagcttcaggaaggtgcaggtgccagacggggttgtggcacaggagaagagggaattccggatactccaccagggcaacaggacagtgactgagtatctccatgagttcaatcgtctagcgcgatattcaccggaggatgtccgcaccgacgccgagaagcaggagaagttcctagcaggcctggatgacgagctgaccaaccagttaatctctagagactatgccgactttgagaagctggttgacaaggcaatctgtcaggaggatcagcgcaacaaaatggacaggaagagaaaggcagcgcagttccggtccaaccaaggaagccaccagcgcccgcgcttcactcccggacagcagggtggacctaccaccatgatcgtccgccagcatcgccctttcaactcgagcagcttccaccagggcgccagtggcagccagaatcaccagggaagtcagcccaaccgcagtgcagctccgcgcctgccaatggcaccagcatagtcagctccatcagcccaagccaagaaggagactggagcaaagccaaggtcctgtttcaactgtggcgagcatggtcactttgctgacaagtgccctaagctaaggcgtgccgggccaaggtttgcccaagctcgtgccaaccacgcgtccgcagaagaggcgcaagcagcaccagaggtcgtactgggtacgtttcctattaactcaatccctacaaccgtacttttcgattctggtgcaacgcattcgttcatttcaaagaagtttgttgggatgcatgggttaagaaaagaagagattagtacactaatgagggttcataccccgggaaatagttcaacctcgatcagttatagcccttcagtgctaatagaaatacaccgatcacgatttctagccaacctcatccttcttgaatccaaagatctagatgtcatccttgggatggattggctgaccaagttcaagggagtcattgattgtgcgaatcgcacagtcaccttgaccaatgagaagggagaaactgtggtgtacaagtcactagtctcaccgaagcaaggaatctccttaaatcagattgaggtggaaaaccttgtggccaccgaggagaagagttcgcggaaattggaagatatccccatagtctgcgagtatccagaagtgttccccgaagacctcactaccatgccacccaagagagagattgaattccgggttgatttggcaccggggaccactccaatttacaagagatcgtacaggatggcagccaatgagctagcagaggtcaagaagcaggttgatgagcaactgcagaaagggtacattcgaccaagtacttcaccttggggtggtcggtcatttttgtgaagaagaaggacaggacgaagagaatgtgtgttgattatcgcgcactcaatgaggtcacaatcaagaacaaatatcctttaccgcggcttgatgatttgtttgatcagctgaaaggagctaaagtgttttctaagatagacctgcgatcaggctatcaccagttgagaattcgggaagaggatatccccaagacagccttcaccactcggtatgggttgtatgagtgcatggttatgtcttttggacttaccaacgcacctgcattcttcatgaacccgatgaacaaggtgttcatggaatttctggataagtttgttgtggtattcattgacgacatactcatctattcaaaatctgaagaagaatatgagcaacatctccgtctggtactcgagaagttgaaggagcaccaattatatgccaagttcagcaagtgtgacttctggttgtcggaagtcaagtttctgggtcacgtcattacagctcagggcgtggtagtcgatccatcgaatgtggagtcagttaccaagtggaccccacctaagaccgtgtcacagattcggagttttcttggacttgcgggttgttaccgtcggttcattgaaaatttctccaggattgccagacctatgacttagttgcttaagaaagacgagaaatttaaatagacggccgagtgtgacaagagttttgaggaactcaagaagagattagtgtctgctccagttctgattctgcccgaccaaacaaaggacttccaggtctactgtgatgcgtcccgccacgagcttggatgtgttctaatgcaagagggcagagtggtcgcttatgcctcgtggcagttgcgtccacatgaagggaactatccaacgcatgacctggaattggtagcggtggttcatgctttgaaaatctggaggcactatctgattggcaaccgctgcgaagtatacacggatcacaagagtctgaaatatatcttcacccaacctgatctaaatctccgacagcgaagatggttggaactaatcaaagattatgacatgagcattcactaccatccgggcaaagccaatgtggtggcatatgcattaagcaggaagagctactgcaatgccttatgcaccgaggacgtgtgtaaggaattgcagcaggagcttgaacggctcaacgtgggaatcgtagaacacgggttcgtagctgctctagaggcacggcctacgctcgtggatcaagtcagagcagctcaagtaaatgatccggagatagctgaactgaaaaaaaaatatgagggtcggaaaagcccgggacttccttgaggatgaacatggcacaatctggatgggagaaagattatgcgtgcctgatgacaaagagctgaaagatctgatactcaccgaggctcatcaggctcaatattccattcatctgggtagtaccaagatgtaccaagatctcaaagaaaaattttggtgggccaacatgaggagggaaatagctaaattcgtcacgctctgcgatgtctgtcagcgagttaaagcagaacaccagagacccgcaggattgttacaacctcttcagatcccggaatggaaatgggaagaaattaaaatggatttcataacaggtctgcccaggacatcatcgggccatgattcaatctgggtagtcgtggattgacttaccaaagttgcttatttcattccagtgcatacttcttatacgggcaaaaggttggcggagctctatctctcgagaatcatgtgtctgcatggagtagccaaaaagatagtatctgattgagggagccaattcacttcaaagttctggcagaaattgcaagaggaattgggaacccggctgaacttcaacacagcctaccacccgcagaccatcccgatggtcagaccgagcgggtcaatcaaatattggaggatatgttaagggcttgtgtgcttgattttggtggaacatggtacaaaagcttgccgtatgcggagttctcttacaacaacagctatcaggccagtctacaaatggcgccgttcgaagcgttgtatggccggaagtgccgcacacctctcttctgggatcaaacaggcgaacgtcaactgtttggaacagaagtgttaacggaagcagaagagaaagtcagaaccgtcagagagaggctgagaattgcccagtttcgacataagagctacgcggacaaccgccgaagggagctcacttttgaagcaggggattacgtgtaccttcgtgttactccgctccggggagtgcaccgtttccagacgaaaggcaagttagcaccacgcttcgtgggaccatacaaaatcttggaacgaagaggagaagttgcttatcagctagaacttccatccaacatgatcggcatccatgacgtgttccatgtgtcccagttaaagaagtgcttgagggtacccgaagaacaagccgattcggagcacatcgacattcaagaagatctgacttatgtggaaaagccggtttgtattcttgagaccagagaaagaagaaccagaaataaggttaccaggttgtacagggttcagtggagccaccactcagaagaagaggcaacttgggaaagggaagatgagttaaaggccgcccatccgcacctcttcgccagctcttccgaatctcggggtcgagattctgtttaaaggggggtaggtttgtcacactctgaagttcttctcccaagcctaaattgaatttataaatggtcccaagaaaataccggtgtaaaagcaagagtgaaaccctaaaggaattaatgtaaataataatcggaattggcatgtggaatttttcttgagttctacatgtcaaaatacgctaacaagatttttaatggaattttcagagctctagaaataattttaaccaattaaaaatgattacaagcaatatttaattccctggaaattcttttcctcctttttctttctttttcccttcctttttcctttcgggatgggccgccggcccattctctccttgccccctttttcccgttgggcccggccgaggcccagctgaaccggccgcccgactccctctctcccggggtcgccgacaggtggggcccacctgtcgggtcctcccccaacctccagccgccgccgccgcgcccacgctcccgcctccttcgggccacatcggccacgtcggccacgcccgcgcgtgcgcccgcgtctcccgcgcccactccctctctctcccgcccacgcccgcgctcgagacggccgggattcgattttcgaatcccgcctctctcccttctcccactacccccacgttggccggcgattcccgcctctcccagccacgtccgagctccctctcccctatttaagcatccccactctcccctctctctttttccccatttcgccaagcttccccttgccctctatcgccctagcgctgtcgccctcctctccaccgccgccgccgccgctccggtcgccactagctgccgctagccgccgtgccgagccgcgccgtcgacgccgtcgtgcgggccgtcccgtccacccctcctccgtcggaatccgccaccggaacccactccacgcttgcccgcccgcgtggctgtcgcgtcagcgccacgtcagcgccacgtggtgcgccaccccttccccggtcgccgccggtcaccgcctcgcgtcgccgctataagcgccatggccgccgggccggcttgagccgtgcccgcgcgcgccggccgcgagccgtatccgccgtccgcggtagatcgaggctgtccgttcggccgcccgcgtggctgccgcgtggccgccgcgtcggcgccacgtcagcgccacatggtgcaccgcgccttccccggtccgtggactcggtccaccgtgaaccgcccccccgagtcactgccatgtggggcccgcatgtcggcgccgcccctctctctctcccgggatttatttattgcgcaataattcaattaaggatttttctgtttatagtaaaaacacagtgaatcttctaaaattcatatctaattcatccgagctccgtttaagcccattcaagtctcagtaaatcaagaaaaatttgtagagtccatcaaaaatggttttgttctctatttcaatagtcttatagcctgtttttattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatggtctattgttttccttcaaatactgcattgttttgcaataatactatggaatgtttacctactgttatagccatgctattcttgtaccatgctcctttgttagcttgggatgtgacatgactagatgttggaccagggattgcttagccatgcttagttcaactagcacacaatgggggaaatcatattaatgtatagactgtaggttctaatgttaatgttggattagtgccaccgtcctggtgttgcttaattaaaataaatcatatggtgggctgtgggtgcatggttttactggtcgcgcccatggcatttaaggaccggttcgcgggatgccgtggaagaacttatcgtacttaccacaatccagcgtgggcaacggctgggcttgtagtgtagctttcctctagctgacgcattcaggcaagggtgggcgtgatgaagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctattcggtatgtcatggtggcatgtcggcgcacgaaaacgtgtcgtggggctgtgtcttgtggatacagttgtacacctctgatcagagtaaaactattcgaatagtcgtgcccgcggttctaggcggtcaaccagattcaccgtgattagtctcaccctagtctagtataatggaattgaatagtctaggtggatggttgggcctgttgcaacgtggtgtagcgttggacagtggatggttaatattgattaattactacaactgtttttctgctttcaactactgtttataaatgctcgctttatgcaaaagaacctctatagctatcctttgataattccctgcatcatacccctattccggtatgacttgctgagtacggtgattgtactcagtcttgctctattttccccaaaccccagagtttgagtatgcgtcagatggttgtttctccgaggagtagactccgtccgtgccgtcgaggatgcctgtggagtggtgttcccgctgcagtccaagtcgaggcttagctccaattgccttttaattttccgctgcatttatgtaagacttttataatatttgtaagacgtggatctgtatgtaaactttgtcgtttatgtacctcggccggtcctggatggggattctaatgcacattctgcttggaattctattcggaaatttctgggcgtgacaatggcctagattcaatttcattgcaatggttgggcctattggcccttttgaatatgtatggcccacttaatatggatggatatagtataattgggctgaatttattaaaatctaattggacttacaataggtctaccccataaacaagttgctcactatatggaccttaatagg

SEQ ID NO: 75498 - DNA, 18611 bp, Oryza sativa
ttccttactcgggaaggcatgtttcgggtttcctttggattctatccctagttggacgtggaggagggcctgtagagggcaagaccaacccctatataagggacatggccggttcattctacaaacaatcaatcgaatcgtttttcatattgcttttagttttttgcttagtttgtccatctttgtcgatttgcgctgtaaatcgtccgccgccgctgcgaaagtgcgacacctctttttaagtttgtcctgaaaaccttccgtttttcccacgagatgggtagttatctatcgttctatttagaattggctctgcaagccggtttagttatcaaaacccatcttgatttagctttgactagattgaggtggttggcgactctactatcaccgcaaagctttaggtgctgtgatcatgtttgtcaacttgtcacaaaaagttgccaacacgattttttgtgactccactggggaaatctgctcaacgtcatctcagctttgacgtcgccataacaaagcctccatcaactaaggcggaggtggaaccatccaatgtcataccaatcacattgaaggagcttgatgagggagcactcaaggccatggaggaacatctcaaggcgtatacccaggaaatgttgatgaagacgtgcactaggacccgtcaaggtgtggttctcaagccgggatggttgcctaaacctaatttcgatgtggtaagtactgaagaggtatcaacttctatccaacaacaaatagcgagtacaatagattcatccattgctactttaaatactaaattagatgcatctattgaatctcgttttgatgattatataaggaacaaactcggttctgtcatagccgattttgtattcaaagataaagcctctaccagtactagcaagcctcctgtagatcaaatatatagtaaaaccgatggagcgaatatgcaaacaacctgcgaagggtgggctacgcacacagccgattcaaccgggccaacggctggtcagaccgggttttatcctggcggtcagaccagtctgaccgcgcctctggacgccggtcagactgggtcctagaccggtcagaccggcgcaattattcctatacagggggtagatccaatgacaaacaatgggtttttataccatattccagcacctaatccccccgtatctactgttagtccccaaattcccccacatatccctaatgcttacaacgatcctactaggggatgtcctcccgatactagatatagctaatataattatattgcgccgcaaacacaacctattagaccaccaaacccaccaccaaaccagcataggcttgagaatatagaggaattaattagtggtatcattagggataaattcgggattgaagctgggaatcctgctaaggtttaccaaaagcctcctcctgattactatgacaatatcctatatcctcatgggtatagagttcccaaatttaccaaatttagtggtgaggatagtaggaccacgtgggagcatgtaggtcaattcttagcgcaatgtggagaggctagtagttccgatactttttaattgcgcttgttttctttttctttgtccggtactgcttttacatggtttagttctttaccggtaaattctattcatacttggcctcaattagagcaaagattttatgattatttctataagggtgaaactgaacttaggctaagtgatttgacatcggttaggcaaaaatacaatgaatctgtcattgattatggtaagggatttagggatgttagaaaccgatgttatagcttgaatataactgatagagatttggctgatcttgcttttaatggtttaattgctcctattaaggaaagattagttggccaacaatttcttgatgttagtcaactcatggaaaaagctccggctcaggaaagccgaattaaagatagtaagaaatttgttagatcatatgttaatttgattgattaccctgaagctagtgattctaataatgagggtgatcatgatatgtatgttgccgagtggtcatgaactaataaaaataagccttttgtttgttctaatttaatgccgactccttgtaaagatcgacaaagtgagattaagtatagctttgatgtggccaaatgtgataagatttttgattatcttttacaagaaaaacaaattgattctcgttctcattctacaatgattgctatgtgtttcgacgataggttcaatcggccatagatgaagaacgattgaaattttccgatggttccaagatgaagcttgatcatgatgcttttccggcgaatacaattaatttcaatgataagaaggtgttgatttggccgaagcaagccgaatctactaaggggaaaggaatggtcagtgaagagcctaggccaaagatgattgtgccaaagaatccagaagttggtgtttggaaggagaataggagtgaggcttcaagttccaaagctcctaagaagactaagatgaccttcattatgcttttgaacaagtatgagaagcaaggtggtgagaaaactcgcaataaaggaaagagaccaagatcatctcctagggagcgatttggtcattcaccaagacgttcggaatcacctacatatcatcgttctcaagacatgtcatgggggccttatccaatgccgccgccgggttatccttttccttactacgtgccatggggggcaataccgccaatgttcaatcatatgcctccaatgtaatacaaccaaggatggggaggaccaaggaggccagctcgtgagcgtttatcttcaccaaataatggttagttttatgctaaaaatcaggtcaatgaaggaaagagggaaggaaagcgcatcaaggtggagacaaggacttcagaagtgattactatcaaagtggggtctcatgatgtgctaataccttctggacatgaggttggagagtcttcaagcaacaaattcgaagccagaaccaactcatcgcagtcagccggtctgaccaacctcttaggccggtctgactgggccttcaggccggtctgaccgcctgtcgcaggccggtctgaccgggccttctggccggtctgaccgggcttcagcgccggtttgatgggagaatttcaaagggtagttcgggggtttcatcgtcttcgagtaaaatcaaaagtgggcattatttaccttctggaacagagccgaaactaaggtggatgcctaaggatttgacagctgctcaaaagaggaggttgcaacgtcttcaggcccaagaattaagagagagagagagaggccgaagagcaaagagatagaaggttcaatgagttgcgaccaccgcctacaaagatgtggaggcgtaagtccatagatattgaagaattggttgttgtgcaaaaggaggaggaagaacaatcggttgatgaatcatatccaaaggaagacatggatgtcaacatgatgtgtatgttgcctatggatttttgtgctatggatgaagccgaagttgctcaattttcactaggtcctaaagatgcggtttttgagaagcccgatgagtcaaactgtcatatgaagcctatttatctcaaaggtcatattgatgggaagccggtctctaggatgttggtggatggaggtgccgccgtgaatttgatgccgtactcgttgttcaagaagttggggcgtggagatgatgagctaaagaagaccaacggaggcgaaaaggtatcttttcggtggagcttatcgtgggaaacaagacgtccaaccgctttcttcatcgtctatgtgcaaggtaactacaatgttattttgggtcgttgttggatccatgccaattattgtgcgccttctaccttggatcaatgtttaattcaatgggacgacgatgatgttgagattgttcaagcggatacatcggccgaggttgcaatggccgatgcaacatttgagtggcgtcacggtaatattcaatgcttatcggggatggatctttctagctatgatttcattagtgtttctgatggcaaatttgtacctatttctgtaaagccggctaacatagcacgacaaggccatatcactttatgtaatgagtaaagaagctaatttagagtggttgcaaaaaagggtgcaagaatatcgatctacaaagaacgatattggtgaaactattgaagattttgacgaagtagaaaaggttggtcaagggtttacatcggccgatccattggaggaaatagacataggtgatggaactaagccaaggccgacttttgtaaacaaaaacatgacagccgattataaggttaaaataatcgagctacttaaggagtatgttgattgcttcgaatgagagtatcatgagatgccaggtcttagccgtggtcttgtcgaacatcagcttccaattaaaccgggttttaggccttataaacaagcaccttatcgtttcaatcctttgttatatgaccgggtcaaggaggagatttatcggttattgaaagcggggtttattaggccatgtcgttatgcggagtgggtatctagtatagtcccggtggagaagaaagggagtggtaagattagagtttgcatagactttagagatttaaataaagctactccaaaagatgaatatcctatgcctatagctgacataatgattaatgatacctcgggtcatcaggtgattagctttttggatggtaatgccggctacaatcaaatctttatggcgtaggaggatatgtacaagacggcttttaggtgcccgggatttgttggtttatttcagtgggtggttatgacttttggattaaagaacgcctgtgcaacatatcaaagggtaatgaatttgattttccatgattttctaggtatcatcttagaagtctatattgatgatattgttgtcaaatcggatggtatggagggacatatagccgatttgaagttagcttttgaaaggatgcgccggtatggtttgaacgtgaacctactcatgtgtgcttttggtatgtcggcagggaggatcttaaggtttatggtgcatgagagaggagttgagattgatcctaagaagatagaaaagattcgtgatttcaaagcgccgacatgcaagaaagaggtgcaaaagttactaggtaaggtgaattatttgaggagatttatatctaacctagctggtaaaatcgatgcttttgtccctatacttcgcttgaaaaaagaagccaattttacttgggggcaaaacaacaagaggcgtttgaggaattgaaaaggtatttgtctactccacccgtggtgcgggcgcctaaagccggaataccgtttcggttatatattgcctccgaagacaaagtcattggtgctgttttgacacaagaggaagatggtaaggaatatatcattacatatccgtcttttgggactcggattcggtgacatcgctatggcatggcacagtgtgacattggagcaatctggagcgttgaaatctgatcgaacggtccgctgcgccggcccacctgcagccttcattttcacccccaagcgctccgtttcctgccgcccaatgcccaatcccggggctcgcccaaatcccacacgcgcgctccagtcctgacgtcccgcacgcgcccggtcctgcggaggtcccaatcccgcaccggagcagggctgccggcagagttccaatcccgcgaaggtcccaatcccgcttggagcagggttgccggcgccggggaagtgcagcacgccaaccagccgaggccggggccagagcgcctgccccgccgtcgccaccggataggtgggaggcaggcgtgcccctcgccgtgattggggaggtaggccggccgccgtgaggccgggggccgaggcccctgccctgccgcaagatttcggggaggagggctgccagagtgagccaagcatctgcagaggaggattgctagtgagtgttgtcacatgtgacacaacttttggcacgaacaaggaatataggccattcggtgtctttcttgggctcaatcagttgagagaaaacactatttttggtgctgcacttctatttgatgaaacagaagcatcatttacatggttgtatgagacttttctacctgcacataatggaaagcaacctaaaacaatttacacggatcaagatgcagcaataggaaaagccataaagatagtattcacagaatcatatcatggtctctgcacctttcacataatgcagaatgctgtgaagcatttatctccagtgaagggtaaagaggaagatgaaggtgaagaggaagacgaaggtgaagaggaatcgcatgttctctctgattttagtgcttgtatgtttggccatgaagatgaggcatcatttgaagaggcatttcagattatgagatccaaagttcataagcaaacatggttagatagcatttacaaggtgaaagagaaatgggctgaatgttatatgagagatgtcttaatgctatctgtgatgtctgaatgctccaagtttctatatggctgtttatcaacttctatatggctgtttatctctttctgtgttgtctcaatccatccaccaattatggggacatgctgtcaaatttttcagaaaataacatcacacaagttactgatttattcatccattgattcattcaaattacagcataggtcatacaaccaaaccaatctctcaattttcccaggtgttgctgctcacaaaaaaattacagaatcattctcccagcagcaatgacaacttccttatcaaccacaatggttaacacagtgcaacctcaacaaattattgtttcaggacaatgcacagcctaaggtaatcaggttcaggtacaccatgaagcagaaggacaaacagctaaactactgctgctgcaatcttggagatagagaacaaacacctaaacaacaattttggaaaacaaatagctaaacagcatgaaatcccatcgcctccatcggcaccccgacggccggctgcctccatcgccaaggatgacggtggcagggcagggccccggccctggcctcgcacggttgccgcctggtcccctccccacttgcggcggagcggcgccttgccggctcccatctagttcgcggcggcggccaaacgcgggcgagggaggcgaagcgacgacacggtcacccggtcccctccccactcgcggcggcacgacagcctggcgtctctccggcctggcgcggtggcgggctgacgtgggcacgggagacgaagtgacaaggcggctgccttgctctccgctggtcgccgtctgggacctctacgccggcagccctgctcccagctcgcgcggcggtggccgcctccctattcgcggcgacggcccggcgtccggtgcgggcgcgtgcgggcggcagggagtggagcgtgtggattgaggcgagccgcgggattggggcgtcgggcggcaggaacggagatcttgggttgaaaacggaggctgcaggtgggctggcgcagcggaccgttcgatcagatttcaacgctccagatttctccaatgtcacaccgtgccatgccatagcgatgttactgaatccgagtcccgtcttttggatgctgaaatgtggtatgtctttatagagagactttgtttatgtctatactatgcttgtaccaaattgcggcactatttgttatctagtatatgcatagttgcttgtcaagccgatgttattagacatatgttgcaaaggccaattctaagtgggtgaattggcaagtgggcatatgttttgattgaatatgatttggcttatgaaccgttgaaatctatgaaaggccaaattgtagtacattttatagtagaccatcatgtcgatattgcttatgatgaagagatttgcttagttgaagttataccttggaagatttattttgatggttcttcttgcaaatagggtcaagttataggtgtagttttattttcacctaatggcatgtgttatgaggcatcggttcgtttgaaatattattatacaaataatcaagctgagtatgatgctttattattcggcttacaagtgatggagatgattggagccaaacacatagaagcatttggtgattcggaattggtggtgcaacaagttgccggggcttacaaatgcttgtacggatcattaaataggtatcttgatcaatgcttggatattattgccaatttatataattttgctattagacatgttgctaggcgtgataattctagagcaaatgatttagtgatgaactctgagctccactcgagacactcaaggctgttgttggcccgatctttcggtgagttgtagataactacgatttgagagaaacgttgacgacctgactacaaccgtacacaacgttgttgtgttgtgccttagcgatcgatacacctctccgtgggttgttgatcttgccggtgcagatcaaccttattcctgcaaggaaatcgaataaacaagcaagaacaagataaaagcaatctgaattgcagataggaattgaatacaaatgataagttgggattccgtaacaggcaaaccagcgatctaaccgatcacgggattacacggcaaagtatcaaagctaaactttaatctaaacaaaacccaagaaatcttgaaggggtacctagctatttatggaggtgggaggatgaccaaggggaccctagggtcgtgctccaactgattggggcgcaccccacatgggccccacttaggccgggtcccaaacgaagttacaagcaatttggcccattataggtgacgtagcaccttatttctgcaatagcagcccactgagaaggaatttggcaatgaggttggatccgttggaaagatgactacgtgagctttccatcaagtactcatggacccaaaacggagctcgtatgcacatttggcggccatttgaattcaatacagtagcaggtggctgaattggattccaataattggaggacttgatcttgttatcatcttgttcatccatgatgtgagcaatggttgtatcaatggtagccatggtcacatcatcctccccttctccttcaaatcatcgagctcacaaaaatcatcaaactgaacatagcccgaattatttaaagaagatgtcaattctcgttcctctatttcattagcaatgtgaacgacatgcttaaaatcggcacacaaagaaacactagaaacaacatgtaagtgaagcattatcacacgactcttctttatcacaaggaacaacaagtaaatcaacttgtgacaaaggcatctcagcaattggttccactaatggctgctctactatagcatgaaaaatagacatgtgtagcttagcttgagaatactcacatttatttatctcagtaccatttaatttaccttgcaaactttcttcagacaccacaggtgcttcatcctctttcttctcaagtacaccattctccctcttttgttgaatgtgatgaattacctgcaaaatgttagtaacaggagagacaaaagattgctcctccaatgtttgcacatcatcattgcatcaggatataggagattcagaaataggagataaatcacattgttcatactttctcgcatttgatatgatctgactctcaatgctacgagcaaacatgaataggtgtccaatatgattatatttcacattagcaagcataacctgaacttcagaactaagccctttgaaaaatctacgcattgtgttttcattgcattcttttagaccactgtagataatgcaaactttgaattcatgaatgtactctcaccttgtgtttcagatgttctaatttctcatgaagaagacatttgtaataagaacttacaaaatgttttcttatcaaggttttgcattcatcccaagtttcaggtttgttactcacataactccaccaaaagagagcaggagaggtaaacttattactagcagccttaatcatttgagcatcagaaaaatcatatttatcaaattcattgtctactgctagctcccaatcaatataagcaacataatcgtatttaccattgtagaatggtaacttagattcaactcatgcaaaattatagtcaggtacctcatatgcatcttgtcgagaagttggcatctctcgtcgatggtgaagaagccgatgttgagcatgaccatctcgtatccccttgcgcaatcctggcatggttaatagcaaacaagaaacatacacaagaatatgcacgctcctatcaactactaggtagtggaagctccgatatcacacacactcaagctttttaccaagttcttaccaaagcaagcggaatggtgacgtacaccaactcggccaagcatcccaatggagtttggatgtatcgataccttggcaaacacttgctatacggctgcaatcaaatatgtggagctctgggtaggcttaaaatgtagcaaaggaatagcaaatgctcaaatcagataatacaaaattgaataatcattcaaagtcagtaccgtactggtcctaggctagaacgtactagagacgcgatcctagacacagacgataccacaagatagctccagaaacaactcaagcacactctgatatactaaagcaaactcaaatataagagctcatttttctcttttccatctttcttctttcttttttttcttttatttttcttttcttttatggtgcggcttttcatttctttttttatgcaccttcctgccttttttttctttctttttttgattttttttaccaaaaacagactcaaggacctcaatgtgatgttacagggactcaaacgtaaatataaaaatttacaaggactcaaatgcaaaagtccgaacccaaaattaaaattatacaaaaatggaatgctgaatttatactggttccatttttttcaaacggatctccaatccgacaatcgaaaacttgtcaccaagctctctagcaactcacggtgtagattgaaatcgagaggagagtggggagtcactcggcttgtagaggtggtgtgaagccgcacgcgagggggtgggaatcggctataaatttggaaatcacgcatggaaggaaacaaagtccagaaaccgatctgctatcctttctttctccttaaccgcacgcaacagcgatatgctatccttcctttctccttaaccgcgcgcaacagatcctcttccttgtgtgaacagaacaagcacaggcgaatgcagacggcaaaccccagatgcaactcagcaactctaagaccgactgataaaaacttctgaaaactagaaaaatagaaccctgcagcatggcggttccattttcgtaggtcccaacgataacaagtacacgacgacgacgacgacagtggtacaaaacgtgaccagaacctgaaactctaaacgaactaaacgctaagaccagcaacatgactcgacaatgcaacgcaaaactcaacaaagcaaaaactgaatgaacaatgcaatggcacaaatatggctaggtataggatgcaatttttttgtatggctattttctggtagtagtgttaacgaccaaatttgagaacactgagcaaaaaaaagctctgataccacctgatgaaccctgagctccactcgagagactcaaggctgttgttggcccgatctttcggtgagttgtagataactacgatttgagagaaacgttgacgacccaactacaaccgtactagacgttgttgtgttgcgccttagcgatcgatacacctatctgtgggttgttgatcttgccagtgcagatcaaccttattcctacaagcaaatcaaagaaacaagcaagaataagataaaagcaatctgaattgcatataggaattgaatacaaatgataagttgggattccgtaacgggcaaactggcgatctaaccgatcacgggattacacggcaaagtagcgaagctaaactttaatctaaacaaaacctaagaaacccagaatgggtacctagctatttatggaggtaggaggacaaccaaggggaccctagggtcatgctccacctggttggggcacaccccacatgggccccacttggcccattataggtgacgcaacaccttgtttctgcaattgcagcccactaagaaggaatttggcaatgagggtagatccgttggaaagacgactccgtgagctttctatcaagtactcatggacccaaaacggagctcgtatgcacatttggcggccatttgaattcagcacagtagcaggtggccgaattggattccaataattggaggacttgatcttgttatcatcttgtttatccatgatgtgagcaatggttttatcaatgatagccatggtcacatcatttagcatggcaagcatatggttataatgtgaagaagggagtattttttatattagaagaaccggtgcttgatttcaaacctttgggtgaaattggcaaaaatgcagaccggggcggcgggggggggttgtttccccatataaaaaaaaaacccctctttttggcgccggttttttgggccaaccgggggtttgggtttcttggacccgcggtgactaggggtggtctgacggaccgtatcccgccggtctgaccggccaacccgggcggtctgaccgccggtatgccgccggtctgaccgattctagacagaaggttggggggcacgtcccgattgattcaaaggccgaactaattgtaatttcggacatttgtgcccaggatacagaagaggattggagaattcctttgattaaatatttgaaagaccctacacttaaggttgatcgaaagatttggcggcaaatgtttaaatatacattgcttgatgaggatttatatcgccgaaatatagatggggtgcagttgaagtgcttagataatgatcaatctaaagtggctatgggagaggtgcatgaaggaatttatggaactcatcaatcggcccataagatgaattggttgcttagaagagcggggttctattggccgaggatgattgaagattgtttcaaatattataggggatgtgaggcttgtcaacggttcggcaatgttcaattggtgcctgccgccgtgtgaatcctactatcaaaccatggccgttccgaggttgggctatggatttcattggtcaaatttatccttcgtcatcaaaggggcataggttcgttgtagttgcaacggattacttcaccaagtgggcccaagccgtgccgctcaagaatatgattcatacggaggtaattgtctttattttgaagcttattatccatagattcggtatcccgcaaacattgactacgaatcaaggagcttcttttatgtctaaggaagtgaagagttttgccgaattttatggtataacattgttgagttcttctccttactacgctcaggctaatggacaagccgagtcgagtaacaagacgttgtcgaagatagtcaaaaagaagattgaggaacacccaaagaagtggcatgaagtgctttctgaagcattgtgggcgcataggatatctaaacatggtgccactaaagtcactccttttgaattggtttatagtcaagaagctgttttgccggttaaggtaaatcttggctctcttcggtatatcaagcaagatgatttatcaagtgaagattacaagaatttgatgggagacaatcttgatgaagtcatcgacaagcgtttgaaggctttggaagagatagagaaagagaagaagaggatggccaaggcatacaacaaaagggtgaaagcaaagttgtttcaagttggagaattggtttggaagacaattttgcctttgggtactcgatccagggagtttggtaagtggtctcctagttgggagggtccttttcgagtatgcgacattgttcgagggaacacatatttttagagacacttcaagcagagcgttttcagcgagcaatcaacagaaaatacttgaagaaatacttcccgagtgtttggcaagacacttaggaggttctatggccagtaattggattatcaccctaagaccaaaacatgttctatggttttagattcacgccattcaccaaaacatgttctatggttttagattcacacccaaattcggcacccagggataaaatatggaaaattgccaaagtttggatgtctgacggttttcctctagttggaccggtctgactgcggtgtataggccggtctgaccgccgaaagtgggccggtcagaccggcggtgtgtggccagtctgacctgtagagtccgagtccgggactgtttcatcgggtctcaaggtttgtgggcccccggctttacacaccagaaaccccatgtgtcttacaataccatttcctagatcagtagatggtacacatatggcacagttgtatatcacaagctgacatcgttatatagtttgaactatacattaatagtacaagggtagcccaaatgggatccaaatagaccgagcatggtcatgtactttgcaaaataccaaaagaagtagatgagatagcggaagcgaagcagcggcggtccaacgtactccacaagcatcgactggtgaacctaggtcccgactccaccggcttcgatatctcttcatcaacattgttcccgtatggtcgactccaactcctttctaaaagatttagttaagcaagggtgagtaccacccgtactcagcaagccaccactacagaatgcatttagtgcacacagaggttcaaggatggcttggtttatttgcataaagcaagatttcataaatcatttcacaaacctatgactgagcagttttaactgaaaacaacgataagttgaagttatcattaatccgcaagggttcatccaccttccccaagcctcgtttggtccggtttaccctcgcatctagttttccatattcccaacatcatcatcatgaccttcctgcccatcgggcaagatcacaccacttaatctaagcaagattaaaatctatgagactagtcaagtgtagtacaagtcccggcgctcaataaccgcgagcacggctattcgaatatatttgatttactcacactgcagtggatgtacgcttttaatcccacactccgcgacttgcccaacacatgagcctagtcccaacacatgagactttccacgatccggtatttcagtcaccctcgcgtttcggcacccgctccaaggactatgtacctccattgcacccttggcacaacacaccacctcaagccggcggtgaggagagtcctggcgcccctgggatcacaatgggttatattacatataggttaggtccattttagatttctgatgtcataaaccaatccacatcccttcaccttatctcacatcacacttcagaaccaccatgacaggggtgccgtgctatagctgccttcatagctaagtcttcaccagttattatgtttgtgggctctacaccttccatagcctctagaaatgcttgaaacaaccatacaaaggtttctgcttttcattccttagaaatccacaacccagctaaatatccaaaaaaaaaatacacataaggaagtcatcatagtttggaagtaagttactacaatttgcatagtctgtacagtttgtttttgctggaagtaaatcagtacaattttgaactatagaacagacactaaagatgtaacttgtaaacttagttacttttttttcttttttttagaaaaaaatgtaacttcacatgctactggaagtaacttttatcaggacttgatgtaactcaatgaatccaacaactaacttaaggtgtactataatgtacaaagttattacagattttttagatttactttttttgcaaaacaaggagtacctgaattgattgcccatgtctgtttatcccaatgaatggtgcacaaggcatgttatacatgttcgtcatgtatgtgcagtcaaacgagatgcaatctttgtagtctttgtaggcatttcttgctgctccatcaacccaaaatatgttctgcaccctgtcttccttattaagttgaatcttgtagaagaaatttgggtcatcctttttgatttcctcgaagtgagcaattgtttgaggcatatctctacacctatacttgctccccatctttgacttgaaattgcttatgtcttttctagtgtagggtacattcctagcccctccatacaattctgacatcaattgcataattctaccagttgagagattaactccgtgcaacattgtgatgaaatctttttcctttttcggtattgctctatgtgaccttagaaatttcttaagtgaaaactttctaaccagaggatgtgtgtgttcttcaacaaactgaattacttcccacctagttcctttcctcttcactgtcatccttactttgcaggcagcctgtcttgttttacttcttttccttttctttggagggcacgcttgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggattctttttctttaactgaggttgattgattagtgcaagaatgagcatatgacatactcaacaagccacacagcaaatatgcaagtgcacgaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaagtaccaccacggcactgcaaagggggaaatcgtgacaataccctttgcacaacacaactcaaaacagtgcaccgttcctggatcataatcaccccctcaaaaaccagaggcatggactccccagcgacccccgtgggcttatctccgccacttctcagtctggtgctccgcaatgaatcatgctatacaaaagataaagccgttgcccacgctggcttgtggttggcacggttaaagtttcacaacagtagctcgcgaaccggtccttaattttcatgagcacgactctcaaaaccatgtgctcacaacccaccattatcaagttttagttggcaagtaattaattaaccaatcacgattaaccatcgtgaactatcattaagccatcattaaataataatgcgtcataagttatcccaatagtgtgctaatgtttctaagcatggctaagcaatcacatctaatatctagctgaaccaatatgtaaagctcaactagtcaagttataaaaacccaaggtatcaaggaataaagtaatcaatgcaaacagcccataacaaaggaatagattcactccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcataattttagatgaattatgagtcttgaacggcctcattctgacttcaaatgaatttattatgaattttacaagattaaatctatttaaagcccatttaaaaagaattaaataaatttaattcaatttatggacaattttaaaatgtagatctttattttatataacttttgcaacttgaaccacattaaactgagttacaatgaattagttatgtatttttaaagattaaaccggattaaagcatttatatggattttaattgaattatgacgcaataatgaattatttttgaaaagaaaaagaggattattgcgtcagcggctagggtttgcggtggaccgggtgcacggcggcggttcacgagaacggacggccgagatcgatccatccaaaacggacggccgagatcgatcggtccacgaccgggccaccgggaacggcaacgatgacgtcagcaccggcggcggctcggcaacgcatgctcgccggcgaacgacggcgcggcgacgcga

SEQ ID NO: 75499 - DNA, 13230 bp, Oryza sativa
  unsure (1)..(13230): unsure at all n locations
tgcatctgaattctagggtcccatcgtatatttattgatgaagcatattgtgaggctgtctgacagtgtttgggtgatttgtgtgattttctgcctcttttctggtctatctgtgttgaaagagaatgtttattttcatatcagggattagatggtgaagctactgaacctatgattaaagagttagaagatgaaagggaggaatcacaagatcctgaagttgagtttgctatagcaggtgctgtaagggaatgtggaggccttgaaattatattaagcatgattcaggtaataatgttaagatatcggtcttttttttgttgcccgtgtaacatgttacgatcaattaatctgtacagatttatatatgcaggcacatttttaataatttgtaagatatttctgaaaaaatattatatctttgaatattattttacgtaggtggtcagttggtcttatatgatcatgctaagttataaatttgagaacaattaagtactaataatattttataatttaggcttatattgtgtttagttgggattcatatttgaattttctgatctaatccttctattgttaatgaggcttgacaatctaattatgccctcaaaatccttttttcttcagagcctacgcgaagatgagttaagatcaaaccaggaagaattgggttcagtccttaaccttctgaagtattgttgcaaaattcgtgaaaatagatgtgctttattacgcctgggtgcattgggtttgctacttgagacagccagacgtgcattctcagtagatgcgatggagccagctgagggtattctattaattgtagaaagtcttacaatggaagctaatgagagtgacataagtattgcccaaagtgtttttacaactactactgaggagactggtgctggtgaggaggcaaagaaaattgttctcatgtttcttgagaggctgtgccctcctgatggtgccaaaaaatcaaacaagcaacaaagaaacgaggagatggtggcaaggatcttacctaacttgacgtatggggagccagcagccatggaggcccttgttttgcattttgagccctaccttatgaactggagtgagtttgaccagttgcagaaacaacacgaggaaaatccaaaagatgaaactttaagcaaaaacgcatcaatgcagaggtctgctgttgaaaactttgttcgagtctcagagtcactcaagacaagttcttgcggtgaaaggctgaaggagattattctagagaagggcattacaaaagcagctgtaggtcatctgagggaaagctttgcttctgcagggcaggctagctttaggactagtgcagaatggacagttgggttaaaactgccttccattccactcatcctctcaatgttgaaggggctcgccaagggtgatctgcctacacaaaagtgtgtcgatgaagaagatattctgccattgctgcatgctttagaaggagtgcctggtgaaaatgaaattggtgcaagagcagaaaatcttttggatacccttgccaacaaagaaaataatggtgatggcttcttggcagagaagattcaagagctccgacatgctacaagggatgaaatgcgacgccgtgctctcaagaaaagagaaatgctactccaggtaactgttgccattatggtttcattcattatttgcagagtcttgtactcttgtataagtgtttgatctcctgttctgcatgtgcacaaattaatatgttttgctaccttctttttgtataccaggggctaggaatgcgacaagaatttgcttctgatggaggtagacgtattgttgtgtctcagcctataattgaaggcttggatgatgtggaagaagaagaggatgggttagcatgcatggtttgtagagaagggtatactttgaggccgactgacatgttaggagtctatgcatttagtaaacgggtgaacttgggtgccactagttcaggcagtggccgtggggactgtgtttacactactgttagccacttcaacatcatacactaccaatgtcatcaggaggctaaaagagctgatgctgcactgaagaatcctaaaaaggaatgggatggtgctaccctgagaaataatgagacactgtgtaattgtatctttcccttgagggggccatctgttcctcctgggcagtacacacgatgtctcgaccagtattgggaccaattgaattctctgggacgagcagatggaagtcgccttcgcttgttaacatatgacattgttctggtacgtggcagtgacttcgtcttatttcctcgtgtatacattgtatggaattccatttcattcattctgccattattacatccctacaaagtgcattttctagtttcttatgtttcgttggagcttttgctttattttattttttgctgagaactgtgggggatgccatctggaacatatttatgacaacagcaaaactctaaaattctttatgcctggctaacaaaataactctaatgtcttcgtgaaaatcaaagataaatttgtcatcaaagtgacatgttttgcttcattactgacaacaaaagctgaaatatctgtaatttatggtcttccttttatgctttgtatagaatgcatgctgtagggcatattattctctgatatgattccaattttagcctaaatgccattgccttgtatggaggcaaaactggttgatacttgatggcattcaattcttgtttatttggtgtgacgaggtaacttgagagcagcaaatcggacctgtcaatttcattttgttgttatggcattttccttcataggtaatcattgtacattcctcttgcacatacaaaactaatcaaacttcatttgttttcactagatgttggccaggtttgcaacaggcgcttctttcagcactgactgcaaaggtgggggtagggagagcaactcgcggtttcttcctttcatgatccaaatggcttctcatcttgtagatggaagtgccaaccagcagcgtcatgtcatggccaaggctgttacctcgtacttgtcctcttcgccttcaactccagaatctcctgttcgactttcagctctatctggagctcgtgggggttcaggttcctcggaggagactgtacagttcatgatggtcaattctctgctgtctgagtcctatgagagttggctgcagcaccgccccgctttcctgcagaggggcatctaccatgcttacatgcaacacaagcatggacgatccaccctcaactttctgccgacacgtcttcctctgcagtccgatcagatgaaggttcatccgccgattcaaacgacagcaagaggctctttgccattgtccagccgatgctggtgtacactggtttgattgagcagctgcagcaatttttcaagaaaggcaaatcgtctggcacgcaaaaggtcggtgagaaggacggatcaagtggtggtaacctcgaagcttgggagattatgatgaaagaaaagctggggaacatgaaggagatgctaggattctccaaagacgtgctctcatggctcgaagacatgacctcatctgaggacttgcaggaggccttcgatgtcatgggtgcgttgccagatgtgttctccggtggccacactacatgtgaagactttgtccgggcgatcatacacggtgcaaagagctgaacgaagttttccgaggatctacaatttgtgttgaaactttgccacgcgcctgtatgtttgtaaggatagtcagcttttgtgtggcagctgtaaacattataattcttccttgtaaaatgaaactgggcaaggtttgtatgctagcttttgtcctggcatttaccagcctccattcacattccttgctccacctgcaattgaagaacatgaaggtgaaacaacgaccgtaaatgaagttattgacgacaagagcctgtctagcgtcaaaactcaaaagaagtgcacatttgctaaattaacttatagcaggacctagtaatgaaagatcagctcgacctttaagttacaacgcggcgctgatgaagtacgtctaattaagcgtagacgatctgattcgctagctcgcacattgaatgatccaccgaaatcagtggatcaataccaataactaaaaatcggttgctgtagcatcatcagatggtctacccactactacgtactactaccgtctatggtcactgttctggctaccatgcatgctcatgctcggccacataattaattaacctaacacagaagattgatcaatatgcatgcatgcaatcttctgggcatcatgaaatcggattagataaaaagtaatctgtactagaacttaccaaaattttgcagctaggggcatgtagagcaagcaaacgcctcggagacggatgaacaacaagcccggctcatcgttcgcgtgcccttgtcgctcgcggcgacgacactataaatacttgcacgtagccagtgacgaatcccagaacgaaaatagagaaaaattaatttgggagtactaattaagatgtcgtcgcgacgacatggcatgaaagccgtggtggtggtggtggtgatcgcgcacgtcctgctatgccatgttgccggcggcggcgggggcgtcccggcggtgatcgtgttcggcgactccacggcggacacgggcaacaacaacttcatccagaccatggcgaggggcaactacccgccgtacgggcgggacttcgccggcggcgtggccaccggccggttctccaacggccggctcgccgccgacttcgtctccgaggcgctggggctgccgcccgccgtgccgccgtaccttgaccccagccacagcatccaccagctcgcgtcgggcgtcagcttcgcctccgccggaacgggcctagacaacatcactgcacaaatcctagtgagtatatagtacggggtataatatatactagccttttatactttccagctctttcagggtgaaagtcttttttttttccaaaaaaaaaatgtataaacattgatcagccaacaaactaattaataacagggaagtgttgttcactattacaataaaaaaagggtgacactgtatgtgtagaaaattctagaaacattgtttttctcgcgtgccgccgcgggacaccattggagataaccggcatctatgtgacggttgttaatagaaaccggcacaaccagtttttattaacaaacgacttcttcgagtgggctcaccttttaccaaatcgaaataatcattggagaacccattttaaaagtgacaccattttaagctatcagacataggtgccaattctaaataagaacgacacatttgacctcgcccttatatacctctccttccctcttgagcagatcgagtaaagaacaacgcaacgtctcaactggggggatttgctccttaaacaattttgcctttttttttaaatgttgttggagtttggttgtattttcttctatgtgtatatttcttttatctattttgttcattcaattacttcctagatctatccccgatgacgcgatgataattattagtaaatgcattataattctacccaccaagatttaaattgtccttaacgtcaatgattaaattcaattatcgagaaaacaaactagtagtaaataaagtatatttttttagaagtttaatagtaccgtctgctttatactaattacagctcgcggttaccatcagtcgattaacgttttttttaaaaaaattcaataaaacgttaaaaatttctatgattcagtaaatatagtgcataaaatatgttttttaattgacagtgaaaataatatttggtagtatatgtaataggaataatcaaggacaatttaaaagttgtaaattattttgaaatgtacaaagtaaatgtaaaaaataattctgtcttcatagtttagagaaaaaaattatttgaaatcagaagctttattaaataaatttatgtttgtactaaatcgtgaactgtgcattgaataaggaaaaaaccatatcttatacctggcgtacgatagaaaaaaccatatcagttgttgacaaatttgccacattatacttgtaataagttgagaaaactgataaccgcaaaatccactgccacttagttattttaatttgcgacaaataaagggaatatgaaatattaattagaagaatactgcaaaagtctcgagacaattaagtaactatgcttcatggcctatccaaaagcaagaaactgaacctgggaaccttgtttagtgcacaaattaatactcccaccattctaaagtataaatatttttaggaatcaagattggtgccacgtatttctgtggcactgattccaatggcaaatttgtatactttcaaccaatcagaagtatatgaagaaaatctaaccgattcaaaatttaaaatttgattaatgacttagaaaaaaaatgaccgaacgttgtaacgggtgaagtctattttaatcttattattgttatatagtttaattaagatgtggaaattcgctttgatatatgtatatattttttagaaatcataaactgcagttgaggttgatcgtctcaagttagcatgcaagttttttttaaacggatttcttatatgtttccttctgtattactaagagccaacgaaattaacaaccgactcaaatacggatatgtattgctaaaagcaaacgaacttaaaagctgactcatatacgaatgacataccaaaataccgataaaaatatcttcaatttttataatagtagagattatagttggtcattacacgttacctttctggtaaaaagaaaacattatctagatcgtggcccatgtaggcctggccggatgtcagctcgctcgctgtcctctatccggtacctgtaataccttttcttttttcttctcttggaacaagcgaagagtagaacaagcgaagagtagagatttttgataagtgaacagtaatagattttagactggccttgagaatctttttttgacaaaaacatgttaaacttttatactagtagagaagagatatgatattatcttatcttaattcttgcccaattaacagcctagaaaatacaatggaggaaatacttagcagtgtcaggcagtagactgatcgaactgcagttaggtggccctgtgtagaaccaaatactaatactcctccaggaaataagtttgttgtttatggaacggtgggagtacacgagaattaattgaaccataacttggactaactaacaaacccatgcatgcatgcatgcactcattatgacaagaccataacctaatgcagtacttgtcatttgttttactaatttgcagtcagcaatgaccctgagtcagcagatagaccacttcaggcagtacaaggagaagctgaggtgggccaaaggcgaggcagcggcacaccacatcataagccaggcgctctacattttgagcgtcggcaccagcgacttcctgcacaactacctcgtcttccccatcaggggcaaccgcttcaccctgccgcgctacgaggcctacctcgccggcgccgccgccggggcggtgcgcgccgtgcacgggctcggcggccgccgggtgaagctcgccgggctgccaccgctggggtgcctgccggtggagaggacgatcaacccggacaggcctggggattgcaacgagatgtacaacatggtggctctgagcttcaacgcaaggctcaagaggcttattgggaggctcaactgggagctgccaggggcacaagtagagtatgttgatcagtacagcatcctctctgccatcattgccaagccatgggaatatggtcagtacccagtaatgcacttcgcttcatattaaattttggtcagtagttcagtacccagtattgaacctagttcgagattgttaattgtattcagaaccttttggatatattaaacctacttcgagattgtatctaagtttcccgagtcttaacacttccgtaacaccttcataagcccaatcggatgtggagaagatcctttaggtgcaacaccatccctcctatatatataaaataggagccaagctcgatcaaccaacaatcaatcgtcaaaatcagtctattatctatacctctgtcatctacatatccctcctttcttctggcatcctatgtctattcatcctccaatatatcccctaattactcgttgtctctctcgtctctatggcgttagaggttgtcctagctatccaccgagtctaagtcaaactggtgtgtgttcacgatgacaggttctctatcggtctcgagtgatcgttcagtagtacctaaccctgtggcattgtgtctccgggtgtctctatgggttgtacacaagatactcaagtgtgcctaggcatgtaacccgttcttcgtgtcaatgaaatttggttataaatatttgacatttgtcataatatttaacctcactgtttgcttgttggtttataagccacaagcaaaagttaaaattttaaacttaatgttaaattatttaatgtacttttatcaatgttttttagcattggctttatttaattcgctaagactaaaatctaatggtcctacgcaaaacaattttatgtatccttacttagccagaaaccaaccatgagatcgttgatcaaaatttggaaattttgactatatattttgtattaaataaatttagggtcttatgatagtaatcttaaaagaaaatctatgcatgccattttaatttgttattttaaaactaagttttgagaaattaattatgatcaaagttttaaatgtttgataaaatcttattttaaaagtcaaatatttatgattgaagggagcatataagttatgtaatcctattctccatgattaaacgtatgatcctaaaaatttaaattatctaatccactccgaattatatttttttcttgtgatcaaatcaggttttgggaactcaatgcaaggatgttgtggcacgggatttgtggagacaggaattctatgtgccttggacgatgcgttggcatgcgacgatgctgataaatatgtattctttgatgctgtccatccatcggaaagggcgtacaagatcatagccgatgcatttataaacaccacctcacctgtattccactgaattaaaaaatatatttcactcgtgatattatctgaacgctcaaattaatataaaagagctactccctccattccaaattgattatcatatatatttatgcaccaagagcaaaagtaatttaaatcgcatcaatcatgacaccatgccctcattcaagtaaaacaccatgccaattacactcttagcatgcgcacattatctcctacgacattaattatatttcgatgaaatccatgtctatacggttatatgataatcaatttgataaattttggattttattatatgataatcaatttgcgaagaagggagtactattgcagatacgataactaggtaccggatttttgttacgcaaatacccttgtacctatgtggtactaggccatgccaccaagccgaatagaagatgagcttattgtgctcaatctgaattctgaaattcccaaacagaacaaatatgagcctatatatcatgtgcagtatgtctacattttgtccgttgtaacactttgtcctgtcctcgtctatacctatatcttatcttaattacttaaaagactagtaattttccgttcgtcaccaaaaaatttcgtttgtaatccgttttgtatgcgcatttgtgtcatcaatgtccgattcttccaatcggagactagaaaaaccaagttatagccggtaacccataacaacaaaatcttgacaataatctaatctcatggaagcacttaccaaaatcagactttgatagttcgatacaaccataaggcaaaaacaagaaccagatttcacccaaataaaatcagtaaaggatccaccttaaacttgatctccttcaagcccagcactagaccgatggcagctagccccaattaaagatgaacagtgttggaccacttgatgtcgtggtcacaccattgccgcctgcgccttcctctgccgccacctacaacaagatccacaaaagatgtggtcgtcgccagccttcgcattgcttggtgccctccaccaatccacccatcgccagcctctgtcttgctagctgcgtcctcctccagatccaccgtcgccatggccactctaccagatccactatcaccatggacattgctgccgccttctcgtcctccttgccgtcatcattgcgattcgcctagcgccggcgcggggataaggcgagatgcacagtgggtggctggcgtgatgtggtcgtggcattgagcatgatgcggtgcatgcggccgagcggcgcgtgtgagtcgagcaacggcacaacgagcaggagagagggtgcgctcgaggcggaggatgagatgaggaggaaagaagaaggcgaaggcatggcagaggcagaggtggaggtagcgaaccggaggctgcttgctcgaaggattcgagattggaacgaggagtggtgggttggtggagagtggggacggggagggattaaagattgtgggcgaccttttgattttcttttttcctttttgtttttttgagcttctttcggctagggtcctttttcttgcaaacgattcgtctcttgcgggcgtgcatcactgctgccaccacatcatttataattgtaaattagaaataaatagatatagtattgtcgacgttttagatcacgactacggtatttgcatggtatggggatcgttggtaccagagtatatacgagattgaggtaaaagagccagagacaaggatttttatacaggttcaggccccttatacatcagaatcangttatagccctactcatgttggccgaagccggtgtaactcttattcatcaaaatcacacaagtacaatatttgagataacctatctaagtgtgtcgtcgacttgccggcttgaaacaccaacacctaatcgacgaccgggtagtccncctccttcaatacatactcggtgagatcaaagatagcgctagatccctcttgttggcctatgtaggcgccagattgggtttgtctaggttaatctttgatattgatgtttggtggcatgtattcgtgtctattctgactatttttccccctctcttcctaggggtcttgtatttatacccatatatgtccccttgtccaagtagaactagggagaccaatatagaaacaatctgagtagtccttattgtttccacgtagaactgtacttgtcattccttatccagaactccttttatatatacgaggtatgattccatataagacttggtatatggtaggccccgccgagcttagtcgattactattgggtatgtgttatctataaccctgacagtagccccgacttcaatgcaaatgaacgagttgatgatctcgatcgaataccttggaataacagttgttgtgctcatttaatcattctcagacgaccgagaaaatgcggagtatgcgactaaattccttgttttatcgtaatcgagaatttggattgaacataaggaattttgtttcggcagatacacaatcgctttatctgtaatccaccaaccattcttggataatcgagtagttgtagagtctgcaacaaagccctaaaatctgacttaactgttctgatatctgactttcctaaaatcaatactcagaacagattgttagattgaaatagcccccgagcgaacgctcaagggtaacacaatataatatgaatttaaaaattgaaaataaattgaatctgcatgtgacgataaaagagtactctcgccaaagctacccttagttggctttatggaaaagtcattttccaaaaggcagcttaaatcttataacaaaccaagctgaagctgacgaatccatggctcagttaatatgcatctacggagcactctaccagatatgacatggtcgtttggctctgaagcatctgacaaggacttatcagctctgggcgcgcgtccctagacgaaatccccttatgtttcttggaggctgtcagaatagcgtaaaggaacaatatgatcgacttcaagacacgacgatataagaaaaggggatcaacgaacaaattttgcacatataaatacttacagaagttgacgcacatgggataatgagacgaccaccacactgggcaaagaccagatgtgtagttgttctcaacaaatcgcagaggtagtgggtgaatctctacgccgctggttgaagaccagttgtagtcgtacctctgttgacggctgttaaatgctaattctatgccgccaatacctgcataaaacataattaatgaaacatccaacatagtagtagggtttaattctaacatattccaggagtgttggtgtatatttgaatgtaggtgataaaccgtcaaagttgggaggaaatatagacttaagtaaaggaagaatactctcaggctcaacgctaccaccgatgtcattcatgctctcgctgaagacctcttcatggcgcccacatacatctacactatcaccaccatcacaatcatgcatggcagaacatgaagcgaagaccgacaacgatgaccagcgtagcttaatcggaggtataattgacctggtgtcttccgaaaccacgggaacctggtaaacataattgtcaagtcagatccaccttgcctataggccgtggagcgcacactaaggattttgtattattgtaattctttaagaattataacaaaatgcatttttctatgtccattttattttttttacctagtacacaggcatgtccgtacattttattttactagcaaaaatgcccgtgcgttgcaacgggtgaaaaattataatgataatatacattttatcatgcataaccgtgtcaatgcaaatgtttgtatggatcatttattgctaagacattcagaaaattggaacatcttcaatctaatggcccaacctcaacgatgtcaaccataccgatgcttgtttacctaaataattagattattcatatgacaacatcaaatcaaatcaaatcctacactgcatcgcagggtcaaatctatcaaaacagagtcactgtgcactcttctctaaatactaaca

SEQ ID NO: 75500 - DNA, 3598 bp, Oryza sativa
cttctccatccaaccccacttgtttttcatttattgaggggcattaattaaagtatttttcttcttaaccttaacctctacatatcaatataaaaatacttatattttaaaagaaatatagtaatagataattctccttttttttctctcaaaaagacatgcaaggcagcaacaagcagccatatataaatgggaacaagtacacaattaagatgctcggaggaaattaaaccagagataaaccattataaaaaaggaagatatactcccccccttctctctctctatttcaataactgcaacgtcaattctcttccaacattaaccaatgctcccttcgttttatattatcaatcaaactttgagaaagtttgatgaactgatgaagtatataaaaaagcatagcaattggtttcatttcgtataacattgaacatatttttttatattcttatttatgttataaaaactattgctatattttttctataaatttgaaaagcaaggcagaaacaagcagccataaaagggaacaagcaaacaagatgcttgaaggaaattaaaccagagacaaaaacgcgttataaaaagggaagatatactctctctctctctctctcaataactgatgataattttcttgtttctattccctccattttatattataaatcgctttaatttttttttaaaatctaacttcgagaaagtgaaaaaatatagcaattggtttcattatgtctaacattaaacatattttgatatcttttatgttgaaaaaatattgctatgtttttttataaatttggtcaaacctaaagtggtttgacttagaaaaaagttaaaatgatttataacatgaaacagaggtagtattattttttatatactcaaaaccatattgttagattcattttgtatagaactttgtaatagggtagagtttcaaaagtatttgcaaatctgaaaatatcaaagttcaacacagccccatccttttcatatgttccctagaatttcatttgcctcgtataattttttttatttttctactatgtctactatattgattagaccacctactttaagttatttgtgaagtttattagaccacctattttaagttatttgtgattttttttaaaaaatatattaatttatcatgttaataaaataaacaatccgcgtcaataatatgaaaaaaaatgtctcaaacagcgtcaacgttatcggtctattctgatagatatagatatagatagagctagatatacatatgcatatagatagatagatatagatatgcatataagatatatatagatataacaatgtcatatatactgccatctgcaaggtcgtcaccctcggctctacaagactattgcaagagtccaacttttgcacgcatagctagtactaggatcatatagctactaagctacaaatggcgatagtaattttgcttaattaatctagtggccgtcctggactcctggtttgaaaaaagtctagatagctcacaaatgtacgcaagatacatgcatgttacctcactctcaaaaaaatatcattttttatccagctcatatacattaatacaaagagcaattttacggtcattgaggtaccaagaggtaccaaatttacaatagaaaaaatggtacctcatggtacctactcaagaatcgtagaattgctctaatacaaaactaacagactagaatacttttaccaacttttatcaaaatacaatacaataattgtttcaaagtcaaagtttttcttaagacaaacgaattgataaaagatgtggctatttgagattgaggatgttacaatactatggccctgtttctttcagtttgggattattataatctagattattaagtcagattactataagctagattgttataatttatataatttatagtagaataaccgttggttgtttctttcctagattattagagcctagattattgggttttgcaagtctaaagagggagtggggtggcatggtgggtaattttgcacccaataatctggaaaaagctcacctaaatgagcttatcaaattataataagctggactctagattataataagctacttcaataaggcttatttgtttctttcagcttacttcctatatatatatatatatatatatatatatatatatacttttgttattggcgctcacggccttggagattttgtgttgttggcggtaattaggtagatgggctctactaataagaaatcaacgaaggtgcatgcacctcccaaagaggaaacaaatatgaaccagtccagtacttgtactgttcttttttttttccaaaaagggaactgttttgtgttgcttgaatcagtcggctatatatttagctcttattaaatactatctctgtattttaatgtacgacgccgttgattttttatccaatgtttgaccattcgtcttattcaaaaaatttatgtaattatcatttaatttattatgacttgattcatcatcaaaatttatgtaaatattttcatatttgtacaaaaaatttggataaaatgaatggtcaaatgttgataaattctggtggtgggagattggtttgattaattctggtttgtcaagtctagctatgtttattatgtttatgatatcgttttttgagattcctaaaggggttcttcaaaaaattgattattatagatcccgtttcttttggcaaggggatgaacataaaaaaagtatagattgacaagatgagatattatttgtcaaccaaaaaatcagggtggacttggagttcataatttagaaatataaaaccaatgtcgtttaagtaaatggttatttaaattaataaatgagcaaggtgtgtggcaagatttactgaaacgaaaatatcttactggtaaatcaattactcgggttgagaggaaacaaggggattcccatttttggtcaggtctgatgaaggttaagaattcctttttaaatatgggttcctggattattaataatggtgaacaagtaagattctgggaggataagtgactagggaactattctttgaaggaaaagtacccctcgttgttttctatagttagaaggaaaaatgcctcaattgctaatgttatgggttctgttccgcttaatgtttcttttagaggagttttagttggtcaaaatctaattagatggcataatttatgtgcttccattgtgcatattaacttaacagacgaggatgaaatttttagatggaattttcattaaaatggccaattttctgttcgatctatgtacttagctttaattaataatggttacatagagaaaaataaaattatttggaaacttaaaatgcctcttaagattaagatttttatgtggtatctccttaaagggattgttttaactaaagataattcgactaaaaggaattggaatggtagttcgagatgttgcttttgtatgaaaaatgaatcaattcaccaactattctttgagtgccatttttctaaatttctatggagagctatacaattcttttttggactttatcctccacatagtatatc

SEQ ID NO: 75501 - DNA, 15701 bp, Oryza sativa
ggttttgggccgactttcgcgccaaagccaaaagagactttttaaaacatttttcaatttaaattatttcttaaatgcaattccatttattaaaaatacttccttagctcaaataaatcccagaaaaatctaggaattatagaattaagcaaagtatttgatgaaattttatctggccccattttatattggaatttattaattaaaactagatcttctcttcaagacttttaaaattatttctaaaaattccatttaaacaacaatttataaattttaaaattttcagggtgtgacagacatcatcaccagcacctctgcttcatcggccctgacatctccgctgttgctaatggatgattatgttttcgccgacttattatttcaccttcatggttgacctactatgcaaatgctgatgagcgtctttgtcattatcattggttgctacactgctattggctggatcaccaacatcgtcatcttcatcaacatactgtcaagcctcttcaacatagcccactctactactgtttgatgagcaatttcgtcatcatagtcgatcatctctgttgctactgacggttgcctttgtcgtcgtcgactattttctttattttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcatcggctgcctcatctgtcaccgactgattatttcgccaccatggctgctcaattttgtcgatgttgctggatgccttcatcttcactgttggctgacttgtctgctgccgattggtttcttcgcctccacggctgtgcaacttcattacctttgattggtgtcactgttttttactaccaatgacatcttccattacttttgatgagcaatttcgtcttcatgttggtcatttcatctccatgccgactgcgtcagctattgccaataagcaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacgcttgatctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacgatgcatcttaaaaggtgtcaaacagtaaagctttacatagctgccccgctgacttttttatatagtcaaggtgctgtttgggtttatcaagcaattgattggatataatatcattgctttttgccacgtaagtgtgcatttttattgaccaatattatggcttaggctgattatatattatggtcatttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacgagcttttttatagctattttggtatatcactcggatcatgttatttggaggattcacaccgcatatactatatattgatatcaagtcacttggttgattacgattatcaaaaccacttggttggttggattatttattccttgactatatgcttggtttgttcaattaaccacattgtcgggggctacacctattaggtgcatctattcgatgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaattccccaaacaggagtagggtattacctctcattgagagggcctgaacctgtctaaatcctttgtctctgcatccatccacttttaggtctcgtgcgctaccccgttttattattgccgaattcatgtttcgacagtaaccgaatcggataagccgcgcgtaacttactcggactccacgccgttttcacgcactggatttttcagaatgtttccaaaatttcccgcagcaaaacaaaattacaaaaggagccaattttgcggaccatttgacttgcgtgcgtgcgtgtgttccgcctcttctctccaccacacatgcttcaagtggctaggagggcatcctcccttttaaggaggtccccatccgctagaataagtaaggtggtactaaactccacatgcataccatcccatgaggtggacttttgtaattttccaaagaattaatcttcgaataggctttaacccatctattaattccaacacgttcaacatggcagtgcccgtgagcaggatggggctaggcgtggcggctgagaaagatcatcggtagtgcggcccaggaagcagaccctgctacgggtgagcttcctgtatggtaactgtcgatggcagcaggggccgtatatccaccgatgtaaagtgtgcacatgttcaaggcccccaaatctataactactagtactaattcgtaattatcctatccatgctaactataatagcaaagaaatgaaaacgtattacacgtatggaaagcccaacaagctatttgagcaatttagtattaatttgaaagctcaaacaacaggcaaaaaagaatgtatgttctcatgttgtctcgtttgatcaaactaacatccaacatgcaccacacatcgcatcgtctcgcttttttaagactcggttttcccacaccgtcgccgctaggacactacttcgatctttttttcaaaacaatcagcaccgctacttaaggatggttaatgggcacgtacagacggcacgaattaatgaacaagctcctagctgcctgacttctgtgtgtccacgactatacaccaccggccacggcagtgtgtacagtacacggttgtggctatctgtcgtaggtcaccacatcttttcaattcaggctcaatatatactcctttcgtaaaaaaaaaacgaatctagaactgaatgtgatatattccagtacaattaatctagacataccgacagagtatgtctagattcatagcactagaatgtgtcacatccagtactaggttgattttttatgggacggagggagtactttcacataggccttcaatttctaggtacggtcttagacacagcagtaaaatgttatgttctttacccagcagtaaggttgtgttttttaccttatttttctaactatctttctcgttttttacgtgtacatttttcaaacaatttaatggtatgtttttctaaagaattcctattcgaaagttacttaaaaaatatattcaaccattttttaaaaataaatagctaatatttaattaattatacgctaatgagttgtttcgttttacgtacgaaaggattagttccctacaccaacaaccgtaagcagccatggttgtcctggagttctgcagctgctgcggcaacgtcgatgcctccaaacagttcataatctagaactgttatgacagattaataactctattcttcaattgttctttacttcaaaatgagtggcaaaatataatttctctaactagtagtaggtcaggactcacgagttactagagattagcgatatagtataagataggtactcgtatgtttataaaaaatttatggcggtctttattaataataaggccatttttaactcaagacactatacgtagtttctataaacttcacatcatgtactagacactactcttccaatgcaaacaccactatttcatacttaaatttaatactacttatctcacataatgtcttggatgtctcatgcaagacatggtttccttctcttttcttatttatccacttgccacatcattttttatcctaggtggcagcttatttaatgctatagacaccatcataattattgagttgggaatgacctagcatcgatgatccatataaacacaagacagtattttgaccagcacaatgatgcgaatagagatctagtcgttgccgtcgtcagatctcgccgtcccagaggtcgtggagggacttgtacgggccgtccggcgagacgaagtagtttccatggcaggctcgccgctgcggcacgccggcgatcatcgccttgtcttggtcgctgagctcccagtcgaagatgtccatgttctgcttcatccggccctcgttgaagctcctcgccaccatgcacacgccttgctcgtacagccaccttaacgccacctgcatcacaaaccaagagataattaattaattgagttatatattgatgtttgtatatatatagtagttttacataaaactgtaggatataaacctttgttaattgaatactgtaattatgtatgtaattaacccaatcgatcgaatttttggtcttgcattttccttgtttgttaggacgaagggaatattactgttattgattgtgaattcagttatttggggagacaattaggcctggtttagttcctaaatttttttttcccaaaaacatcatatcatatttttgaaaacaaaaaataattacacaatttgtttggaaatcacgagacgaaccttttgagcctaattagtacatgattagtcaaagtgctacagtaacccatatgagctaatgacagcttaattaggctcaaaagactcgtctcgcggttttcatgcgagttatgaaattagttttttcattagtgtccaaaaattcctttcgacatcctgtcaaatatccgatgtgataaaaaaaattcgcgaactaaacatgccttaatagctgtatttttctagtgtgtaggaggaaattagaccagatggcatggcagctgtgttccagaggtgttaggtaaaattttcgcattagcaatgatggggactaacttgagatgagagataacaggagttttttttagaggggagagataacaggagtttagagggtaaggttcatttagttgatattaaatttagcatttgcttcagttactgcaactgaaactacaaccattacatttttttttctcaaagctcaggtaggatagaataaaacaacagtagataaaaaaaaaagacacaacgacaccaaccaaaaaaaataagcaacatattcaaagttttaagtctattgctaaattttcatccaaaatttttaaaaaactgcataacgattaactctaaattctggagcatatatgacttgttgtgtgtccacttcacacctatgaattattgagaattagtttctccaccaactcacactactaaaccccgcccccttttcgaggccaaacaggacttttcagcagagtctattttgattgttgtaaatttttcatttatcaaatttaattcttgtcgtggttattttctcctagcaccatggccattctatacttccataaaccatgaaaaaggtcaaactataataaaaatcattggagtacacaagtttatataacaacaattcaattattttaattgaaacagctaataccattctgaactgtagaagtcaaccagtctgaactttttctttcttagttttattttatcacctgagcaatcatcttgcctctcatggcggcaaccgtcacatctcattctagatttattttccatgtgacggagagaatagtttcaaagaataataattcagtattttaactggagcagctaatgtcaatagaattgtagaagtcaacgattttaattgatttttttcttagttttttttttttttacctgagcgatcgtcttgcatctcgcggcggcgacgtcgtgcagcacgccgctgttcatgacggcgtcggagccccagtgcgcgccgtgcgcgccgagcggcgagtaggcggagacgacgccgccctcgccacacacctcccgcaccttctcctgccgccacccgacgttcatctccacctggttcaccgccggcggcacggcggcgagcgcgagcagccgcgacatcttggcggcggagaagttgctgacgccgatggacctcgcgaggcccagccggtggcactcctccatgccgcgccacacgccctccatgtcgaacggcaccagccgcgggctcaggtcgtcccacgtcagctcgccggcggcgtctttcttgccgatgcgaacgggccagtggatgaggaagaggtcgacgtagtcgaggccgagccgggacagcgactcccggagcgcggcgaccacgcgcggcgggtgcgcgtcggccatggagagcttggtggtgacgaacagctcgccgcgggacgccacggcgccgcagcgcacggcctcggcgacggcggcgccgaccgcgccctcggtgccgtacaccgccgcggtgtcgaggtggcggtagccgaggcgcacggcgtgcgcgatggtccggccaggtcggccggcggggtcgacgagccggtgccgaagcccagcaccggcatcgcgtgccccgagttgagcgtgacgcacggcacggcggtcgccgccgccgccggcgtggcgccgccgtggtgcacgtcggaagcagccatcgatcgaacgggttcttgggattgggtttgtggtcgctgagagtggattcgttgtctattcggatgttaattataaagactctttctaaatcgtgctgagtagtactagtaagaattattagtcttgtaagcttgggagacaagaagcaaagggttagagtcatcacacgttaaaaaaaaagtcaagtccacgacacagacggctttctttttctttttcttttttttacctaagttgtagtgcaaccacaaaatttctaatcgaaatcggaactactacatcccaatttgttttccaacaaatcgagcattgtttccctgctcatcgaaaaaattttcaccactatatagaaacatgtttcatattattaaaaacggtgaaacacattcaaattatgaattgaaattttttttctaacgtacgaaatatagaatttcaaccattgaaacatttcgacacaaagaaacatcaagtacatcggttgaaacatcgaaaaagcaccgtacacacccatttggtattctcgtactccactcctgcatggtcccaacggtgagacatcagtgccaacctcctcaaacacgagacgagacgaaaggtttgaggcagtggtagagccaaaaatttctccagacacatggctcaattaatcaattctccctccgtactcgtaaagaaaatcgttttggacagcgacacgatcttcaaaacacaacattgacttcttgtttctataaaaatatttattaaaaataatatatatactttatgaaattatttttcaaggcaaatctattcatatattttttacatttttaaactcaacagattgagagttatttatgatttatatttataaggtttgacttaagtattgtccttaacgacttactttataagtatgaagagagtacagtataatttacatatgctttagccttaactgccctactcgtggttccacccctagtttaaggagagaagggtcatcgctgcctagccacacgagctcgacgctaaggccaccgcatatcaccgcctttaatcttgccccggaactggatgtactcgtactgaacatttggtgattacccaccaggacttcctgacaccggccaccacgccatcgaaggcttcagggtgtttggagtcacgacgtgtgcgagcgtggcgcctgacactgagcgttttcgatttctaatgtacttggataaaccgttgttttttttcatagtagtagtaatttttttcacaataaatatcaatatctcatttatgcacatcaagtccaaatattagtggttttaggatttttgagtgttttaatggtaaacattttgtgaagattcaatgtagtaaaggaatttatcggaaaaagactgaattaccctatgattttttgcgctcatccaagttaccccctgaataacaatacataacattttaaacccatcaactttgcaaagtggacaaattacccccccccaccccgcgacactctagggcggttttgctctttagtgacacacatgtgatagtcagtcagccaaaacaagtaaaagaaaattttattggacccacttgttcgcccaatccctcttcttctcccctcctctgcgccccttcctaaggcaagcaacactagggttttggggcaatgcacgctagcggagctagcagagttgactcttggcagcggagcaaagtggaaccaagatccaaagaggcgatgcttcgtggtggagctagcataggcgagtggtgttgagttcatggagctcaccgtcaatctcaccgctcttccacttcaagcttgaaaccacctgtatcgcctccgccgtgagttcaccattgcttccgtcgtatttgctagatctaagttgtgttgttgaggccataagggagcagtaggtttatgtgtttggtagcacaacgagggagcggaggaactctagcatcgaccgcgcggtggagttggtgctgccgaaatgacgctgtggggagagattgagagagaagaggagctggacaactggcgttcgacgacagcaaccaagcagcgtccgatgatgctctagcagtagatgaagaaagaggacatagcaactgatatgtagggtccactagcttgatatgtaagtatggaagcatgaggtggaggctgacatgtggggccagcgccacatgtgcgcctacgtaggaccaaaaccacattcaaatcgatttagagagtaatttatccggattacaaagtccacatttaaaagtgtttgtattgttatctaggggtaaatcggatgtgtgcaaaagttcaaaggtaattcggacttttttcaaaattcatttgtacgaattgaatcgaagttatttaaataattaaatagacatgactaaggatcggattgcttatcatttcaattctatggaacgctataatgtttcattggacagtcacatgttttagtacgatcgtgtcatagttacagcagaaaagtgaaacgccgaaaagtgaaacgccgcataaaaacaacaaaatactggtatgtttcactagataattgttccattggaatatttcattctgtgtgtttagtcattggaccaattgtctggaaatattgcattgactcctcaatgtttgcatgcaaatatcaatatatatttgtaaatatgacgaattgttctttcgttattagtcaaaagaaaatgagtgtgttcggctgccatttgtttagcagcggctgcagcaattcaaaattgctgcagcttacagcgactttgaactgccgcagccgcagcggctgcagcagccatacctgccgaacagagccatacctgccgccgaacagagccaatgttggagagaaggactatcatctgttcttaggaccatcgtatttttgtaagtatattcttgcatattcagggagtttgcacttacccctactctaggaatatttggcatcaccaaacatttcaagcatgcttatagcatgcacaggtaatacgagcacgcaagtattgtgatgtgaatgtggcgtgtttaggttttgtacgtacgtctagttgcctaaaagaccaaagagtttgaaaaggggaggtggtcttttgtcactctccttgtcgcttatgcatatatgctttatggaaccgtttattaattactaataactaaagtaaaatagtttaaattctaaaaaaattaatttatgggtataacttatccttactgatttataagcacatactgtaaaaaagactataattaaaaaaatcacaaaaacaccttgaaaattaagttttaataagatggcttataaacataagcgaaatgagactatacatgtcccactttgatttgtcagtaactacatttgattggatcatagatagattaacaggcatccacaaaaaaacagtaactgcaagccacagggctccatgagaaaatggaatataataataaataatgtacataatgtctcatgacattttgcatatttgcaatttcttttttgttatctccttttatctctatggatggcaatgtttgcatccattctcctttttttttttccactggactcttcccagtgaacataaccgacaaagaactactaggaagctagtaaaattgaaagaagaaaaaagaaagaacaaagaaaatttcagagttcagaccaccccaactttcagaaacaactcctccctttgttctaacaaccactactagagcttgcttttgtgagggttgaacataacaaaggctaaaacatgaaggaaaatgaagcagccagataaattcttattgtgatctgagaccaggctacctccatgatctctgcctaccctcttcctttcagatcaatcacaacgacactaatgttatctgaactctccctgccgagggcgaggcgcgcaaggagagcagcggcacggtagcagcgaggctcagattcttggcctaccgctgctgccggagcaccggcgctgctggaagcggcttcgccgctcctagctgcgcgacgcccactggtggggctcccgtcttcaaggcattgtcgagcgacatcgctggccgtctcgtttgagatcacatcccacatcccatcgctcgcgaggatgaggcattcgtcgtcgacggtcctcacggttatggtgatgtctggctcacatatgacttcaggctttaggtacttgtctcctgcgtgaacatatttagaataattgagagtaacatacatgatactgaattagtttacataaagaatctcataaagtaagtaatatacaggaaaggaaataaattttcaaacatttcaaatggtattgcattgaattctagtaaatgagaagattcatggtattacatagtattttcaggaatcctatttagtttcatgaaagaaaaaggagaagatgacacatataaacctaacgaactagtgaaatcgagaacattattatggctacggcatttcaagaactccatccaaatatttaagccacagatacctctgaagctacaatgaaaggatacacagggaccagcccttttgcaatgaaaagcttaagcatcaaaacaggggcaaacgtgagatgcagaaacataaaatattctataaccactcagtaactactagaatgtagggaaatttgtactgcctatatcaagggaaggtgatgtatcatgtataagcctataatgacaagttggacagataagtattttgaaagaacacatttcctttgaccttttgggccaagtaaactgcttccttctgctgcacataaattatattatcattatattaattaatctactatataaagtaggaatcttcattgattcaaaatacttaataagtgataagtagtgtggtgcttcctatatgtgaaatgggcaattcctacaaccaaaatggtgtgtctgtaatataatacaaccctctccaacttgaaacctgatatataaacatactaccactgaactctagtttaaaacagagcttgtgagatagacagataaaaactattttaagaaaaagtggtttatcagaaacaacatcagatctgcagagacaatattttctatgttatttgattataaacattcgatatgaagtacaattatatagttttgaaatcaaatagactgacaaggttctacaatggtgcaagttgagcttttctctattgtcaaaaggtccaaattattactacccaaggtatttcctttgtcaatcctgaaagctagattaaaaaaggtgtaacatcactattgggaacttaggatacaacagaggacaacgtcactagcctaatcaaacatatatgtcccacttatttatgaagatcatttcttttagtcagttggttaggttacaatcagagcaactaataaaaagagctagcactttcacagatggtgaatcagagatgaacgcgtgtcttttatgtctaatccatctttcttctttcagacatctgataatataactaaatgaaataacaccatacaggcactgccaaatgttaggcctaatggctaaagtgagatggactgggtacatatggtcattttcttgataagccagataatatggcacaaaccggtggggtcagtgatgtgactgtgtatcaactcaacaaactgccaagtaacatctactagaagctcattagaagctggaattgtaccttttatctttgtcatagttaattgtataaaccacaaaaaaaagttggtaccttcggacagatgcaaatatcctatgtaactaaagtgtaaaaaaccttaaattcatagggtaccatgctattgtcatattcataaccttcctgccacgaaacttgcatataatacttattttcctcatagtcttaaagcaggaacatccttatttgacctagattctgtcaccaggcagtttttgattggtcaaggggtggaaagatgcagagcaataggttcctttttatgtttggaagaacatgcagagcgacaaatgtaaccaccctttgtgatatagtattaccttccgatcttttgtttatttccatttcccccaacctcgttgggggcaacatgatagtttaagaacaactggacacgtcttagaaactgacttgccaatggagcttcagtggtttagcccaatgatcaagcaaaaccaaaaggctagtgaacaataaacaaatgatatccagagcaactaaactagaatggcaaggcattaccaaccatatataattggtctccctaactccagattatgtgcacaagtacaactcctgactacttctattagagcaagtttaatattatagccaactactagctccaatttatctatagccaatctaatagctcatttatacaatagttacataatacactattaatacctggtcccaccagtcatacacacactgcgtattggagtctgtgctatagctggctacaaatctgtaatctgctactcttctctctccttatttatcttcttaaaatatgtttgcagctggcttatagcctactattgtacctgctcttagcagacttcttttcgaaacatttactcattgagtacatgtttccgcgtgaaatcaaaacccacgccaagacgaacacgtgagcgacagaaattggttttattgtggctccaagttctatccaaagctagctagctacgcaaacattcagattgtgccacccactgctagctgtatcatgtggtcttaagtgaatcatgtgtgcagctagcagccaagacattgtagcccaggacacaggcaatttcagttcttctacagcagagtagcaaacacaacacacaaagatagtgcctgcagacagaatttagatcaatgatgatgacgatgacattacctaatgctcgcgacatggcgaggatgccacgcaccctcggcccgttgaggtacaccacccggccacccaccgcctcgatccgcgccttctcgtccggccggtccggctgcataattcaccgtcaattatagtaccatgtaatctaggttcgtcagcagcaagatcacacttatgattagcaagatacaagagcaagattaggttaatcacactaccacatccagcacgaatattgtcgcaccaaccactgcccccatctcctacccccctcatggacctaccacagccaaccacacccagccaattttccccttcttttttccccctttccacagaaaaggaagctctgaccagtgtgggtccacaatccatctcaggaagagcaaaaataaaaaagaaaaaaagaaaaaaaaagaggcaaagggacagcaacttcacagtacacaggagcagggacaggtggcagaggtggcggccaaccccctctcactgctcacgtgggccccaccagacagcagcaaagcagctggccccacactctgaccagtcttatccccccacgtgccccgcgcgagagcaacacgtgtccccctccaggaaagcgatggattaaggccctgtatagatgggactaaaactttcaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattagtcttaaaaaatttgtctcgtgaattagcttttatttatgtaattagttttgtaagtagtctatatttaatactctaaattagtgtctaaagacaggaactaaagttaagtccctggatctaaacaccacctaaaacacttcggaatcccccccccctcccccgcccaacaccacgtgggccgcgcccctccgcagccacccccgaggttcccacaaattctccaaattgccactgccctttctactcgcattaatgagagggccaaaacaaaaacagaccataataagagaagaaaaaaagatactagtaattattttttttattattattttttaatacgaggtgataatcttttttgtgatgacgctagcggggtccacgtcggcgagcacggcaaggcgaggcgatccatgtctctccgacaagcgagagcgacctctctctttttctccggtcgccggcggccaaccacgcgtcgccggcgaggcagccgcggccgcgaaggttccggagaggcgacacctcggctggggcccaccccccgcaggagtcaacggtaaacggcagcgcgagacttggaatattttggcaggtacggtcaaagccgtggtgtgagggacacgtgtgcgtgtgaggagggtgccacgtaggaatggaagggctgattaccttgtggtcggaggagagggggaggg

SEQ ID NO: 75502 - DNA, 19531 bp, Oryza sativa
ggtttttctctcgcgttgagtcggacggttttctcgaaccacttgtagaaacaacggctttttctcgcattgaatccgattgttttttagatttggcttcgttataaacagtgtttttttctaatagttttttcagagtggctttttttcaataaacggtgtttttttcttgcgcaattttctcaaaccattttcacaaacgttgcatttctttctgaaatttctttcctagcacgtttgtttttctgttttttacagacgatgaaaaccgtatttttctcgtgttttttttgccttcttttctcgtgtgttcttttgcctgttttttctgacatttttttctcgcgcatttttcttgcttgttttttctcgagtgttttttttttgcttttttctaatataggagcataaatgacgaaataaaagtcgtgtaggagatggaaaaaaaattgaaggattctatccgacccaagcgtccatcaatttagttttttttttgacatttttttagagcagcttgtttttttataaacgtttttttcctgcacagttttttcttacaattttttcctcgcatgcatttttttattttttacggacgatggaaatatttttcctcgcgtgtttttttattttttaggacgacggaatcctttctttgcgcttttttctaacttattttctcacgcgttttttgcttttttttttcttacactttttaaaaccgtttttattttatcgcgtatttttttatttttagttgtacgatgaaaacttctcttttatatagttagatttgatttgattagagatagagaaaagatatatacagtctcgcgtgtttttttattttttacgaaccgttatttcgcaactcttttaatgttttacctaattttttggatttttttttgtttttttgcctttcataggaatcatatttttttttgttcttcccatttgtttttaaggggaatcggatctatgatttttttcgcctttttttttttcattttttggtttttttcaccttttatcgggggaatcggattttttttagatttttctccgattttttttgttttccccatttttttggggaatcggatctacgtttttttttttgtttttttgctacttctcctgcgaatcggacttctatttttttttaattttttttgccacttcttctcagaattggatttttaagggtgtattttttaaaatttttttgccacatcttatgggaatcggacttagtttaggttgttttttttgctatttattttattttgactgacgaaggaaacattttgtattttgaatcggatctacagatttattttggttttttcaccttttatagggggaatcggattttttttaaagatttttcgctatttttctccgatttttttttgttttcccctttttaaggggaattacgttttttttttgttttttcgctacccctgggaattggacttctacgttttttttttattttttgccacttcttctcggaatcggattttttaagggtgtattttttttttattttttgccacatcttctgggaatcggactttttagtttagatagttttttttcgctatttattttattttgacggatgaaggaaacgtttcgtattttttaagtagtagagattttacttccttgcgtggagagacgaaaatttaattttctatctaaatacattgcatgcagcggtgaaaagtaagagagaacacacacacatgctcctctctccatcgtgttgatttttttactacttgctcgtagggctgtcaacgagccgagctcaagcgagcttacctatataggctcgagctcggcaccaacttgagccgagctcgagtcgagcctgtttaaactacaagcttagaaatgggctcgagctcggctcgctcgagcctcgagctttctcgagcctaactcgtgtgccctcaaataaccaatacagatgaaaggaggctgcatgcatgcttgtcgagtactactagtactagtagctttttcaaacatgatatgacaactagtagtactattaaatagagctgcatgtatgctagtagtactaataggctagtgctgcagagtaaagtagtactagtaggctagtgcctgcacggtgcagccctgcacgctctgtgtttctatacagcttttcattgggagtaggagtagtactagctgttgcattgaaaatttaagagagggaaatctgggctcgacgagctattcgagctcggctcgtcaagctcgcaagcttggagctaggcttgagttcggctcaaattgttgacgaatcgagctcgagccgagtctacagcgagccaagctcaagcagctcgcgagcctcgagcttttttgacagccctacttgctcgtgatcatttcacgtacacgtttaggttcattggttgtgctccattcaaggagctaagtgcctaagacaaaattagactacaagatcaccggtgttgtaagcttgtgtacgtgctattggtttccctattcctctctccgacacagataggatcgaaaatttggaaattgtggtaattttggtttgaattaatttaaaatgttaatcaaaatttgatcacatctaaaataaattttgctaaattctattttaatgaaagattcagaaaacaattaggataaatagttcctgtcagaaggggtgacaaaatccataacctcgggcagtgtttgtcaaatggaaaaggaaaatgatttcccacccatctttaaatcctaaccattcattctccctcttctatttaatcctaacccttcgttcatttccctatctcaaccccacccctcatttcccattatccaaacacacccttgatggtttagatcttgttggctagtgggaatcaaccatacagttcagggatacatggaaatgcaaaacagtttgaatttttaagttactagtaaagtgactgtgcgttgcaacgggaaatgttgtatatcaatttcaaattatattaagtgaaaagatattaaataatcattgagtgaaaatttgttgaacataggaaaaaaaatctggcaatcaaagaaactagaaatcataatagttatgtagattaatttcaagcaagaaatttgttttcattacagaagcataatccaagctttttgtcgcataaaacaatcttacagtgtttattaaattataaaaaggcaacataggtaaaagcctgctacgaaaatttgatgatgtcatacaaattaaagcacaaacattaaatctagaacattaaggattttcagatatggtatttctcatggatgatcacctcaaattaaattattctatataggtaaataactaccctaatattgtgtatttgtgatacacttaataatatcccgtgcgccattaggtatgttgctttcacactcattttgttggtacatcagtagatttagcaaaaaaaaattgcattagcttgtcaccatcctgcacatgtattttctttgtaagttaaatatttctaattatatgatataatattcaaatgatcaatgccagtcaggacttacattaatagccggcaaatgtaattcttcatttttccatgtacacatgaagagatgaacaagaagacccgatcaatttccccctcaatttccttaattccctttttcttaggaattaaacaaacaagttcttaaggtttagatgggttgggaaagggttcatggcttctgatccattaccgcccctgctctctaggcataccgcgtgcatacactcgccgcgccggcacgccattcccttctcatcaggtcacgcatcacgctctccccccttcttccgccccttcttccctaaaacaggcaattcaagcacaccatagctggaagccaatccgatcgatccaatcgagattcggtgtgctcggctcctatcggcttagaacaaggtcaatagcatggctagttgtttgctctaagtaatgtgttattttgtagtttataccacagacaaccaatacaatagattggctattgtgttaactctatcttattaattaagaatcaattatgcatgcacatataaaatatatatgatcaaaatgaaagtacatccttgtggccatctgtgttgtcgcatacagtctgcgacacacaaaagctttccaaagctaagcttgccatgacacttgcattttgattgatctatgtgaagatcctgaggaggctgactttctcggacctggccgagggagcacactggggggtggtgctcatgtcgctcagccgctctccgcgcagcgacggcgctgctcgtgctcacagctgcggcagcgacctgcgctgcaggcagcgatgaccatcacttggcgaggcacctcacgtcgtcgtccaattcaaacaaatcagaggctaacttcgacaagatttacaccgaaaaggaaactgcaagttgttctctgggttgatagggatcgggcatgacctccatggaccgatcgagaaatctaagaattaatcgcgatggttgagcggagtggagaggagacacaaaccaggtgaccacggaaaaggaacgtgcgagcaacggctgaacatcggcatgcgcgcgcagtcatcgatccggagaagggctgcccgctgtctagatctatttgctacgcacgggatcgttcgcgatggttgtgggcccactaaggtcttgtttggttaatcatcgtgagggtggaattggagagaattcattccacacatgttgtggtaaggaattattccccctcaatcctctccaatcctcttcaatcccctccaaatcgaacaagacctgaaagtgttttctatcgttgggggattaggggcgccgttattttcttgttgagtgcggatcgcgatccagaggagtcgcgcgatggtggtgcggaggagcacgatgggatcgctctgcagcgttcgattttttatccatgcatggttaatagatcgcgtgtctatgttggatcgtgtgtgttggcttcaccatcatcaatatggattttttaagtagcagagattatccaataagtgaagaatatgttgtctctttcttaaaataaattataatcattatcataacattagtttttcccgttgcaacgcacgggcagtttttctagtaatatataatagaaaaatatttataaggcttcccttcgtccgttttgtccatcctttgagtccgagttcatcgtccaaaaaaaacaaggtagatccccaaatcaatcaatcaacgacacaacaaaatacagcacggaaaagccaatttaatctagagctcatgaatttgatccccaagaaacttaatccccgtcgtactaaatcaacatccaaaacacaaaatcctcaaaatattcacaaatcaaaccgccgccatgctggagagaaccaccgtcagctccacgtcgaggaggtgaggggtcagttggggggaggggtggagctgctgccaccacaccagggagggaagtagccgccaccgccacgccgggggggggggggggagtagtagccgccatcggctgcacgtcaggaaggtgagtgggcaactggcgagagggtcgcagccattgccaccacgtcggggagggagagcagcagtagccgccgtcgtcacttagtatttgaggagacgggagaggaggcaagagaggatggaggtggcaaaagaggaggcgcagaaaaagagaaggaaaaaagaaaaagatgtgcaggtgcagaaaaggagggttgggcgaaaaataaaggagaagtgagggcagagaaaaaaaatgttcgcacggctcgattggataatatcggctcaatctgcataaaagtgtctgtttattaaccggaaccagcacctatgagcggcatctatttgtatactaagctgacggtttttgctattgacatccccatgggcatgtgtttaggccagaaatgcactatatgtgctggttttagccattccggtatctataatgcggacatctttgcgtgtttatatagtagtgaatattgcatcacgaggcaacaaatcgacgaatcaaacaaattagcggatcaagctgaactcaccaaccaagccactgtcgtcatcgtcatcttggatccgctgtcatctccctcgagctccagtccccaccgccaccgtctccctgatttgatggcagaaacgaagaggctaaggaggagagggagagaggggagggacggccgtcgtcactgtcttcgcgccatacccccgtcgacgaggagacggaaggggtatggatggctgtcgctgccatctccgcgccgtacgcctgccgtcaccgcatcatgttgaggaaaaggcttctgcggccgtgccctcaccgtcgctgcgcccatccgatcagtcaccacgtcgagcaggaggcaggagctcgcagtctcgcaccaccgccaccgtgccacgcgtggcacacccttgttgacggttgttaagtggaaactttaaccattaactgttacataaaagatatcaaatatactatcaaaacttagtgataggagtttactaccaaccacttccatctaaactgagcctattattgatatgttcttttatatgtacgatgagtttttcttttatgatgtattaaaaattgtttccttttaaaacggaacggtaacatctcatcattagtggggcatagtaggattcgaggcaagaaaactcagatgggctgaaaatggtccaaaagaaaggagggtttttattttcagcccaatagaaaggagtgtttttatttaaataaatgttgtcaatattattaaaattcgaaattgagctttaaaaattctgagaaaatttcacatagcgtaattaatcacggagagcttaataaaattaaatccaaccatgttttatttgggaaatcttatttgctacaacttatattttatttgagacttatatattaaggttgtattttttttgtctatatttgagtgggttaggtttgagtatctggtcgacatgtcaaggtttggtttcagttattttgtatcatgggggagcggcgtggtgaccgggcttgcccgcggggcggcgaagctggctgcggtggtggcagggcgcgggagcggctcaggtggcgacaacatgcggctggaggcggtttaaggtggtggcggctcgggtgcacggtggaaggggagtttcggcggaggtttgtgcaaatggagcggtggccggtgtgcggcgaggcatggcgaagctggcggtgcaagcggcgcggcgcggcggtggctacggcgacgacagcgtgcagccggagctcgccggaaagcggcggagagcggcctcgtgcggggagcacaggagagggtgcgaggagctcggggaggagggggaaacggaagaggagagcacgagggtggtttttataggctcggggaggagaaatagtggccggacgtggcggatttgaagcggcaacggccggcgacgtgggcgacatcgtgggcgaagtgggggctcgatttggcgccaaaaatttgggaaaagtgggggatttggtggaggaggtggaggggaaccgattttatgtggtttgggcgcgagggcgcgagcgggaggaccggaatcggcggcgacgtgggcggcaacgggcggcatggcggcttcgggcggttgctggccaggatggaggatggttggggatggacctgacaagtgggtcccgcggtcccacttgtcggccagagggagagagggactagggctttatttagacttcaagggcgagcgggccgagggggagagagagaggcccgatagggggaggggcgcacgcgggccgcggaggaggggaaggattcttgggccgaaaatggcccaaggaggaaggggagtttttaatttgttttctttttatttaattgattcaatgaactttgtgctattaaaattatttcttgagctccgaaaattcacggaaaattccggagaatatattagggcacaaagaatattacaaaatattctcggctaattatttttaaaggaaattttaatttcctccataatttcacttgattaaattgatttatcttttatttaatttctagacaatgcattattaaatgatttttaattccgaccgaaaatcggggcgttacaggtacttaccttgacgtattcggcggttgatgcgcttggtggacttgcggacgtcgacattgccggcggtgagggttggagttgcagagaatcgcatttgggtcgccggaaacttcgaaggtgtcgcgggagagctcgaggaagagattggggaaagttttttcactagagcggttaaaacgggagctgacgccgtgaaacgagcaaagcagtggttactatttaaaagggagtgcggtaacggccaaaacggaatcggttaaggaaaccctagttttaatcggaaagggaagttgagcaaatccgccaagcattaaggtatattaggcttcttgtttgatatattctgtctattttaatatcttaatataaagtggtatcggagtattagctgatacatgctagatctatctggtcggttatgctataaacgtttatataatcattgctttaatgtatacttcgacttaagtggtttataccgtctcggcatggtgaccgatctatcccaatcacttagtttaaatatacatcgaaggaaggattatacatcgttaatatctatacctgatcaagtagatttagttctatcttatttatttatgattgccgatcgattccaatatgacatcgactcgaggataaatgatatgtcatcagcaactagactatcggctatcgtttatggatttaaccgcggttttttttgtctttctttcttgttgattgcaggatcaaatcaactggcacgctcacgaacctaaaagcaagattttggacctgcactgaagttaagcagatcttccaggccagtgtgtgtttttcgcatcaacagtgattaactcttagattacctatttaaagattagagctataacctgcacaaaaggtgccatattttattttactatgttgaagctcactattttctggttctatagaaacttggttcactccatttggactaaagatgaattttctacaaattttacaattaaaggctattctatgttggttatttcttatataaatatttagaggcttttattataaagtaagtacataattttattttataacttggaagtatatgttttggtgattctacagaactttggtttactcaaaaaggatctaagatgaattttatataaacttctaaagttcagcctacagaaaactaattattttgattatactagttttagagacatttgacaaaaagtaagtagatgattttatttcactataccagagagtgtaagttggtgagtctgtgaaatgttaatttaccccaaaatgagttgagatgaatttcgtatgcattttataattttgtgtatgctttatgtataatttttcttagataaattttagaggtgaaatttgtactgtgagtgcaagtttttattccttaacattaaagttaatgacttggtgagttcacagaaattcgaatcatctcaaaaagagttatatttgattttatatggattttacaacttttaggtacttttcttatataatctcagattttgtttttagtggtccactatcagtcatacggacaatatgcaaaaaggcctttgagatttctagaaaccaacccgcagtcctaggcccatatgtcagtgtttagtatgttttcatattgaaccttataattgtttaaattctcaaaccaaagtccctgcgacctggacagaacagagcgccatggccgagctcgatctcgagctcgccggcggcaaacgatggctcgtttgggggtgcgaccaaaagacgccggagtaacgtcggcggcgagtccgagcggaggatgttttggcatgggtaggcatgttgtgccataggtgcgaatcgactaagggagtgcatgcatgtgctttctaaggagtccagggtgctgaccgagatgtaaaacaaggctggcgaagctaagttgacgacggcagctcgtgtgacggctcggctgcggcaagaacctccggggtgaacggcgacagctcaatcggctccaagaactatcgtgcatgtcagcatgtgtgtccatgaggttagtgagtccagagaaatggtgtgtgcgcgagtaaacgaacaatggctcaccggaggaggcggaatcgcgccattgcctgggatttttgaggggttttgaggaggacatcaaggagaagacgttggcgcgacggctcggctcggcttggtctacagcggtcggaacgaggacgatatcggctgctatggagattatggataccccatacctacacggtatgtatgtccaactgggtatggggtgccatgtatagatatactatctttaaagggactcgggttaaaatccaaacttgtatgtcaaggaaatacccgggatcttagtcggttacgattgtatcttatctgtaactacctattccgttaaggatatgggctgtactttgtaatacggactcctcccctatataaggaggggtccaggtgcctcttggggtacgatttttctcccagatcatacgatctataatacactcggcggatcaatcactggacaggagtagggtattacttcttgattaagaaggcctgaacctgtataaaatttcttgtctctaaactcatccacttttctagcttgatagccacccccttttagtattgccgaaatcttgtttcgacagttggcgcgccaggtaggggccgcgtcaagttcttcgaggattagtgcgatgggtttcgtctccggcatcaatgacttcgtcttcccacccgggcagacgttctggtttggcagcctcgacttcatcaccaacgacttcggcaagatttctctcttcgactcggattcgaaccagtcgggaagaggctaggtctctgccccgttcggtattccgaactcggcttagatctaccccaagatcatctcagccgagttggcctcaaaccactcggacgagatccaatctactataacacgacatgatcaagacgatggagcttatcccccaatcctgatgaaactccccgatgatttggctgccgtcttcaccacaagggcgtcttcttcccgtaggtctaggcgggatccggcctcggccccgatccagtctagctctaaggaagtcggcgtcatactctagcctctcggcacagttttgacggaacaactggatggctacctcagctcccccggcgtcgactcacggccaacggagatcattgagtacgacgacttcggctaccgctacgactaccgcaacctcgacgactttggcgaagactttgaagataattacacgcctctctacttcggcattttcatggccgacaacgagacggaagaacagcgtaaagcccgggaagcagaagaacaatgcgtacaaaaggaagccgaacgacaccgactcgaagaggagcgccaagcacaagagcgagaacggctgcagcatgagcaataggagcgcgaacgggctgcaaaggaggctgaggaccggcgacaacgcgccttggatgccaggtgacgagcacgagaactcattgggcagcaagacgtcaagggaactgcggtttttcacactcctcaacagacgcggttgcagcgatcaccctcctcgacaccctcctcatggaagacgcactcaatcaagccaatcacgtcgtcaacatcttgaaccagaccaagaccatgatcgcaactttggtcccgattaactccgcaagcattcgcacaccgactggcagtcgagtcccccctcttcgatcttaagactatcaccaaccgagcctcagcgccgtcggtgccggatctagtcgcaggagtagggaccacaacgagcgatccgtccactcgcctcctgaccgacgcagggagcgtcgagctgaacgtccccgctccccgcatcgcaggcgtcccatcgatcttcgcgaaactatcaaccagcgccgcgcagcgagaggctacgtccccaccattcaccagatcgctacgacgacgacgtggatggagtcgctgcattcacaagcgacctgcgtcgagtggattggtcggccggcttcaagccgactggaatcgagaagcatgacggcaccactaaccctgagtcttggctcaccgtctacggtcttgcaatttgcgcagcaggaggagacagcaaagctatggcaaactatctgcctgtagcactagcgcattctgcccggtcctggcttcacgggcttccccgtggcacaatcggatcttgggcggaacttcgcgaccacttcatcgccaatttccaaggcacctttgaacgccctggcactcagttcgatctctacaacgttgtccagaagtccggagaatcctttcgagattacatccggcgcttttccgagcaacgcaacaagatctccgacatcaccgatgacgtcatcatcgccgccttcactaagggcattcgccacgatgacctagtcggcaagtttgggcgcaagcctcccaggacggtcaagcagatgttcgaaaaagccaatgagtatgccaaagccgaagatgccattaccgcgtccaagcagtcgggcactacttggaagccgaagacagatatgccgaccacagggggggagtggaaataccaatcacaagaatcataagtgcaagcccgaggaacttgtggcaaccactacaccatcctcccgacaacgttcgcgcgtcaacacttttgataagatcatgaactcccaatgtccacatcatccaaattccaatcacacggccaaagattgcttcgtctacaagcagtttgcagaacaatacgccaagaacgcacgcaagacgaatgacggagatcaaagcacgtcaaagaagaaggatgatgaagatgatgccccgactggttttcaagaccatcgcaaggaacttaaccacatctttggtggacccttggcttatgaatccaaacgaaagcaaaagctgaccgaacgggagatcaatgctgttcagcccggcacaccccaatatctttggtggttagagatagctatcaagtttgactgctcggatcaccctgaccgagtggtccacccggggcggtaccccctggtactagacccagtggttcgcaacgtcaagctttgacgatccctcatcgatggtggcagtgcactcaacatccttttcgccaagactctggatgacatgcagatcccttgtacggaattgaaaccgagtaacgcgccctttcacgaagtcatccccgggctgtcttctactccactcggccagagcactttgccggttactttcggtactcgggagaactcttgcacagagaatatttgcttcgaagttgctgatttcgagacagcgtaccatgccatactcggacgcccggcgttagccaagttcatggctgtcccacactacacctacatgatgatgaagatgccaggtccccgaggagtcatatccctgcggagcgacatcaagcaagccgtcacttgcgacaaggaaagctgcgagatggcccagacccgcgagatcacgctcgcccgacaagagatccgactggccgcgtccacagcaaccgaaggagaagtgcctgcaaccaagatgacaaagagcggagaaggcgacgccaagaccaagaagattcctcttgatccctctgatcctactaagactgctgtaataggcgttgagttagattgtaaataggaaagcgcgctcatcacctttcttcaaaataataaagatatctttgcatggaaaccatctaatatgcctggtattcctagagaggtgagtgagcactctttacatgttaaggaagatgctaaacctatcaagcaacgactccgccgtttcgtacaagataggaaggacgcgatcaaggaggaattgaccaagctgttagcagcaggcttcatcaaggaagtcattcatcccgactggctggccaacccaatcctagttcggaagaagacggggcaatggcgcatgtgtgttgattacctcaacaagtcttgtcccaaagatcccttcgggttacctcgcattgaccaggtagttgactcaacggccagctgcgaactacttagcattttggattgctactcaggatatcatcagatccgactaaaggagtccgactgtttaaagacttcgtttattacaccctttggggtctattgctacatcaccatgcctttcgggttaaagaatgcaggagcaacttatcaacgcataatccagagatgtttttcaactcagatcggtcgtaacgttgaagcctatgttgatgatgtagtcgtcaagaccaagcagaaggatgatttgatcacggatttagaagagacctttgcgagcatccgcgctttcaggatgaaattaaaccctgaaaagtgcatcttcggagtaccgtcagggaagttgcttggctttatggtatcccataggggcatacaagccaacccggagaaaatcaacgccattctcaacatgaaaccgccgagctctcagaaagacattctaaagttgactggttgcatggcggcgttcagctggtttgtctcacgactcggcgagcgggggatgcccttcttcaagctgttaaagaaaactgacaatttccagtgggggcccgaagcacaaaaagcctttgaagacttcaagaaactcctcactactccaccggtcttggctttgccacatccgcaagagccgctgttgctatatgtgtcggcaactgcccaggttgtgagcacagttctggttgttgagcgtgaggaggaaggccatatccaaaaagtccaacgaccaatttattttgttagcgaagttttggctgactccaagacaagatatcctcaagttcaaaagctattatgtggtgttttgattaccgtcaggaaattatctcactactttcaaggtcactcggttacggtggttacgtcatttctactcggggatatacttcacaatcgcgaagcaaatgggcggatcacaaagtgggccttagagttgatgtctttggatctatccttcaagccgcgaacttcgatcaagtcccaagctttagcagacttcgtcgccgaatggaccaagtgccaagaagacacgcctgcggaaaagatagagcattggactatgcattttgacgggtcaaagaggctttcaggcactggagcgggggttgttctaattttcccgactggagagaggttgagctacgtattgtggatacatttttctgcgtctcacaatgtggcgggatacgaggcacttcttcacgggctaaggattgcgatctccttaggaattcggcatctgatagttcgtggagactctcagttggttgttaatcaagtcatgaaagagtggtcctgccttgatgataacatgactgcctatcggcaggaggtacgcaaaatagaagataaattcgatggcctcgagctaacccacgttcttcgacataataatgaggcagccgacagactggccaattttggctcaaaacgagaaacagctccttccgacgtgttcgttgaacatctttatgagccgatcgtaccaaattaagaaataaacaaggccacggacgcctgagacgtaaacatgattgaagccgactggagagagcccttcataagatttttgaccaaacaagaactccctcaagataaagacgaagccgagcggatctccaggcgtagcagactttatgttgtacatgagaccgagctgtacaagaaaagtccatcaggaatcttgcaacgctgtgtgtctttggaggagggaaaacaattactaaaggatatacattcaggcatctgtggcaatcacgctgctgcacgaaccatagttggcaaggcatatcggcaaggttttttctggcctacagctgtatccgacgctgacaaaattgtgcgaacatgtgagggttgtccgttttttgcccggcagactcatctaccggctcaagagttgcaaaccatcctgttgtcttggccgtttgcggtatgggggctcgacatggtcggcccgtttaaaaaggctgtcggtggttatattcatctctttgtagctgttgacaagttttccaaatggatcgaagccaaaccggtcatcacaatcacggcagacaaggctagagatttcttcatcaacattgtgcaccggtttggggtacccaatcggatcatcactgataacggcactcagtttactggcggagtatttaaagatttttgtgaggacttcggcatcaaaatttgttatgcctctgtagcgcaccccatgagctacggacaagtcgaacgtgccaatggtatggtacttcaaggaataaaaacacgagttttcgaccgactacatccctatgctggcaaatgggtagaatagttgccatctatcttttggtccctgcgcaccacacccagtctggccacgggccagtcgccgttttttctagtctatggagcagatgcgatgttgccaagcgaagcggaatttgagttgctgcgatttcgtaatttcagcgaggagcgctacggagaagaccgagtagatgatatcaaccgactggaggagcctgtgaagcagccttaattcaatcggctcggtatttacaagggatgcgctgttatcacaatcgcaatgttcgatcacgtgctttcttagttggagacctggttttgagaaaaattcaaactacgcgagatcggcacaagttatctcccttatgggaagggccattcataatttctgaggttactcggccaggttcttaccgactcaaacgtgaagacggtactcatgtcgacaactctcggaacattgaacatctccgtcgttgttatgcttaggcattacattttgtattttcctctttgaacgttaacatcaagtttgtacttgaagttatcagggggctattataataataatggagtgtgatctcttatcaattcaatttgcttacttgatttatcattgccttgtttgattttttggcttagtcaatgaggactgaaagtttttcaacaacttttgcgagttctaggctcaataaggtttgacaaaaacttttaagaaatcaggagctgagtttaaatcatcaagcacagcataaattcatcagtattgtacaaattgtaactccatcatcatcgtcatcatcattgttagaattcaacatcaatcagtatcagtcttttcatcatcagaattgttagatctagtcggctggaggtcgttgtcctagaatctctcaacgacgtcagcagctattttatcagcagctatttgtgcatcattgatgaggtcaagagcagcctctttgcttgtcccgtctgcaaagccatcaatggcattaatatcaatcttcgggtacaaggacttggtcatcgccaacgccaggcttgctcccatgcttccagcttccttgatattcttaaaatatgtatccggagcaattctcagcttgtcgaagatctcggcaatgtcaaatgaactcggaccattgttattgaagaacatggcttggacgagtggtgtagcggcgttggcgacttcatctctagctccttcaagcctcttgattttgttgaccaagacgtcgaattgagcctaggatttgattttacgatctgcacaagtacattcacatcagcaagagggcatgaagataagagtgattttttgaagttccagctgcaagtaccttcgacatctttcaaggccgagtccctctgctttgtcaattcatccttatccttttccagagccttgatccgcttttccagatcggatatctttgcggcttgcactgtattgcttcttgttggttgatagcatatggatagcaacatcaaatgagtcagacaaggatgagagttaccttttgatgagccgcttatcgagaaattggagtcttgaagcttggtgatacggtctctcagatcatgctcagtcttcctggcaagctccttggcttcgtgcagctggtctctggtggcttcaagggttccaaggtgtggaactaacttctcgagggttgctgtcttcgcttcattcctaagatggattctctacaccacaaatttatccctgttcaagtaaagtggtcgacaggatgattgaggttctgtaagagtggacttacatttacaagacgagtagcttggcccagtgtctttttcagtagacatacttcctcatcttccctctgcttatttattacaattccttgtggccgcatttcatcatccctccacttgactaatattggtgggcgggaatcttcagccgattgtacccggaggacctcttcttcatcaccaatcattggcccttatatattcatgagtaatagtgaagtaattgaataaaggttgtcgaatcaaagcaggtttggaggactagtttacctgtgataatttccggtctgggacgagcaggtccttgcaccctaacaggagaactagttccagagtcagcaccagtgtccgtcttgggagggctgttagtttgagcttctacttccgggatgtcattattttgttctgtacccaactggtttctagtcggttactagtcgggggctcctgattagcgccgactccagcttcggcagaatgatttccagtcgggggctcattgctagtctctacattgtcggttgctggttgattatcactcgggcgatcttcggcagtcggcccggtttcctttgaaggacccgtctccgtgtcagttggctcggggtcttttccagaaggatctatgtcagatggcttcctacaaatttgaggtatgctatcagtgctacttcagtagtgagtgagaagcaatacaaggaaaatggccaaatgatttgtacctggaggacttcctgattttcggcatagggcaactggatgttttcttctttgggttagcttatcttggttgttttccagtcatccctttgttgccagctttttcagcgtcatcgccctcgtcgtcactcacaaccaattttctcttacgagagtcagactggttagtcgactttgaagtgtcaggttgatcaatagaccggattttcggccctccactggcttggcttgtcttccaacggggtgagcggcgttgagcaatcggagggtcagatttcatcaaagcaaattcctgtgcatggtattccgagttttcaacctaccttacagaaaataaaagcatgctttgagagaggctgagatgtatgatgcataccggtgggggaggattgaaggcgttgtatggtatgactggcaacgtgtgtgaatagctgaccacgatggcattcgagaagattttttacatcctctcctgca

SEQ ID NO: 75503 - DNA, 6662 bp, Oryza sativa
aatgacttacattgtgaaacggagggagtattacttatagaaaggacacatgagacattttgttaccatcttttatttatggtggtttaatttcatatggaaaaattgtcaccaaccagtatcatataaagagagaaatatgtcaataaaaacatatttcttccaacaaacaactactgctataacgtgagtccgtgacataactagtttcaaagataaatatttattagtaaaaagttaagaacatatttctacaacaaacatgtgtcatcaatgtttgataacaaaattactacatcaattcagaatgtcagttgaaggaccactggattcccatgctagatgacaacaattacaaagaatttctaggaaagagccaatgcaatttagagacaggttacaagaaatgcatgtaagggaaaagtgcacagtactcattggctaggataccctgatatgtccctaaaacgacgtattcgtctcagatacgtgaggggatacgaatatgtatcgaatacgctccgatacgtatcccgtacgtatccttcgctccatcccgcgagagcagcgatcgatcctagcatgccgcgcgccatcgtagctgagtacagcaaaaaaaaaaaagaaccaccactgccataaagcgagtgaacggcctcggcgccggacggctggaggtgtaccagctccacgcctccactgttgcgcgccgcgccgccgtggtccctcggcgcaaagctatcgccagtggccgattgcttctttcatgcctaatgaggtagtaagatattggctgttgagtttcttccgtcgaacaattcatcttgtttcatctatgttctcctcacttattttcttgggacaaacaatgccaaatttcatagatttgatggattttagagttggtaactagctgcatctattcctaatgctactgcggctggaggttcaaggtaaaacaagcaagggaaagaacattatattttgtgattttgaggacttcttgttgtcttacactaatttatactatctttgttctttgctgtgtggacgtcggtgatagtatacaagactacaaactagaagggatattggaggtcatgtgctagcttagtactcaccgatctggtatacatttgcaagcatgatttagctacaaatatgcatggactaattttcttaaagaagttcaacatttttttgtatttttattaaatttccaaattcatcaaatttctatattttattaaatttctatatatatagatgtatctccgtatccttgttttctaaaaagtgccatatcctcgtatccccgtatcacgtatctgtatctatatccccgtatctaggtaacataggtaattggcctcatgagccatcttcttccatggtccaatcttttcgctctatgtctagatcaagcttctcatttaattctctttctttgacatcgatctattggaaagacaatggttaagcattgtgtgatgaaatattggataagagaagattgattggagagctatgccacaaaccgcatcatatatttcaccatttttctcaaaatctcctttctttctgggatgatatggatgtggacatgtggaaccgtttgactagcttgtgggccatcctgataagcattgtactggtgagcaaatagctaaatatttttatccaaagaatacaataagaaacaaaattctacaacaggtatataaaaggtatagatagagcaattgatcaaaagaaacaaatatatctttgtttcacacacaataagataatcatattttagaccccctacaatcaaaaccaatatggtactcctcttagtgatacgagtaaaacattaatcatgaaaaaacaaacaaactcttaatttagtagcatacaccaaacttcaatagaaaatgtgagtgaagatgttttatggtattgcaagagctgtacgtcaacatccttcacaataacccataattcaccgtctcatcagaacttagatcagcaaatcgtttcacttcacatttgggacaaacaagaacatatgtgtattgtcaaggtaatacaatgactaaaatatatcatattttcttaatatatcaaacttcaagtaaaagatagatacccaccaataaaattatgaaagctttgcccaacaatgcaatacattatatcaatcacaatcaagtagaagtaaacactacaaatagatcagttgcatggacaaacaacatgtcatggtcgagatgacactatctgagaacaacatgtcatggtcgggaagtatagttagatgcagcaaaactaaaaacttacatcgctgcttgagctaatcccccaaaatgaacaattgaagctaacatggtccccatggtagatttgatatttatcaagtataaaagaagagtaaagtaccgcattcttttcatgaataaaaaagttccacacgtctatttcttttgtattatctctcttttttaaaaaaataacttcttttatattagtttaaacagccttgatgaacttcaccaaagcacaaaacaacaaaagcaaacacattctatgaacaatcccattgggactagcagtgcgggcatatgactagtactagcttgaaattgatgtgggtttcaccttccaaggcccatttcagccatcttgttgtctggacaggtgggcctaaagcattaaaatgaggaggaagtccatttttttcatccctcaactatagcctgagtccgatttacgtccctcaaccaaaaagccaaaatagaaactctctcaactatcaaaaccagtgtaaagtaactcccttagcattgcaaagtggttttatctgatgtttcaatacaatcattagaaaaagaataacaataggacaccatgtaaataatacaccaaatctcttttgatctccaacaactcctcacctcccctcatgctccgtcgtggcatcaagcttgggacaagccacggaggtgcagaatgaggggtaggcagtggcggtctgtcacacccagaaattcacgaaccagaatttctaaggtgaatgtgcattaaacctctgtccaagaccagccagggtacacaaacgacaattgttgacatacagatccacgtcttacaaaaatataaaagattacaaatgcagcggaaaagataaaagcgagttaagcctgaaaacttgactcctgtagcgggcgactccattccacaggcatccttatcggaagcgacgaaaccaacttcttcgagacagctccaactgagaagaatttcaactctggtgtggggggggggggagagagagcaagactgagtactacccactgtactcagcaagtcataccggaagagaaggtatgatgcaagatataaccaaaggaggctagaggttcatttgcaataaagcaggcatttaaaagcagtagttgaaagcagtaaaacagttgtagtaattaatcaatattaaccaaccactgtccaacgctacaccacattgcaacaggcccaaccaaccacctgaactacaccagttcattagctaattaggggtgagactaatcacggtaaatccggttgaccgcccataacggcgggcacgactattcgaataattttgctctgatcagaggtgtacaaccgtatccacaagacatagccccatgacacgtttccgtgtgccgacatgccaccacgtcataccggaaagaggccgtgacaggatccttcgcataaccccctctaaccaatcgcaccacacctcaggtttcacccccactcctcgtaaggtagtgggcaatcccctctcgtgccacggtgaatccggaagccgatcaaccggacacccaggccgacccaactccatcacgcccaccctagcctgggtacgtcagctagaggaaagctacactacaagcccagccgttgcccacgctggcttgtggtaagcacgataaattcttccagggtttcccgcgaaccggtccttaatcgccatgggcacgactagcaaaaccatgcacccacagcccaccatgtggtgtattttaattaactaacaccattgcggtggcactaatccaaaactatgccaataaacaaagtctatgcattaatgtgattccccatttgtgtgctagttgaactaagcacggctaagcatctcctaaaccaacatctagtcattttaatacccacgttatcaatggcgtaagggaaacaacatatagctgagtaataggacccatcccacatgatatcgtataagaatgcaacgtttagcagaaaatacaggatatttgtaaattgggtacaatatgatcaattgtaatgtatgacttgccttgctctcgcactgatgagaccacagcaacgtcttcaagaaaccgcagattgacgaaacggccaaaatctacgcgacaaacaacgcacacaagcaaaacatgctataagtctactgaaacaggaaacaaccatttttaatggattctatgcatttttatgaatttattgagacttgaatggacttaatcggaactcggatgaattagttatgatttttagaagataatctgtgttttaactaataaagaaaaggccttaattgatttattgcgcaataatacccagggctgacgtcatccaagggggccggcaccgacaagcgggccctgcatgtcagcggctcatagagcgccggttcaccgtggaccgggaccacacgggtggtccatcgccggtccacgggaccaacggtccggatcgaccgggagccgatcagatggcgcggcggcggccaggcatggcgcggcctggcacaaagccgaccggccggccatggcaaggtggcggcggcgaccggcgcgagggcggcggtgcgcacaggaggcggcgacgcgcacgggtgaaggagaggaggagagggggggtttctcaccgaggttggccggcgcgagaagagatgacggcgaacgacgccggcaagcggtggatggcgaggcaagcgggtggacgacgtccggagtgacctaggaaagcaaaaaagaggattcagagggagagaggtggttcgcggcaactggcaacaccggccgaaggcgagtaaaatggaggggctcaccggcggcggggaagacgatttccggtgggatttcagcgacgggaggtggcggccgaggtagcttccgcggcggcgaagctatcagcggtggtggtgcggcgcagcgagggcgctagtggcgacggcgtgcggctggagatgggcggcggcgatggagctcggggagagcggcgcaatggcggtagagagcacgggaggatgcggcgagagcggaaaaagagagagggggcttgggggaatgttttataggcgaagggggaggcggacgtagccggggaggggcccaatttgccggcgacatggagaggtggagagagagagagagagttggggaaggtgggcgcgcgcgccatttgcggcatttgcgggcgcgcgcacttgcgggaggtgtggggaaggtgggcggcgacgtggagggcgtgtagtggggtgcggaaggcggaggaggtgggcggcagcggcggttggggcaggcggcggcggttgccggctagaggaggaataaggggccgacaggtgggccccacctgtcggtgacccggagggaggagggaggggacgtgggccggcccagcaaggaggagggcggcgcgggaggagtgggccgacggcccaataagaggaaaaagagaaaatggaaaatgaattaccagggacttaaatattgcttagaattgattttaaatgggttaaaattattttcgaggctctgaaaattccactaaaaatcctgttaatgtattatgacatgtggaacccaagaaaaatcccacaatgccatttcccattattgattgcatttattaaataaagaattagctctaggttaatttgaaccaatttcttcaagcgatttattaaacaaaaatttaaaactagcaaggggaactttagggcgtgacacagtccgagcaggcgactttggctcctagcagtgggctcctccacagcgtcgatctagtggcttaagaggtgtcagtctcggtcctcatctgaagttggttggcctcgctaccacctcacacccatgtcaatgcagcgttccatgcggtagttctcagaggcgcgagatggagctagtgttcatgcaataggatgggcttccatcaggcaacaatctgagctggctggggacaaaccagaaagctccaattagatatgttagcaagcacgggtatcaaaatgtacacaagcaaattggaattagcatgttgcatgtaccggatataaaagaagtgggactgcctatatatttgtcgataaattttcccccaaaaatttgacagatgtaattacagtacaatcgtagtgtagttacactgtaacttatatgtaattacactgtaacttgcatgtaactatagtataacttatatgtaagtttcacataattttgaatcgttagatctattacaagatttgttttggtgaggaaaaaaacaaatcatagcacacacatatatgaaagaatttgttctcacgacctccattttaccgaaataacatgttacggagagatttttgaaagttacat

SEQ ID NO: 75504 - DNA, 14399 bp, Oryza sativa
catccctttgttgccagctttttcagcgtcatcgccctcgtcgtcactcacaaccaattttctcttacgagagtcagactggttagtcgactttgaagtgtcaggttgatcaatagaccggattttcggccctccactggcttggcttgtcttccaacggggtgagcggcgttgagcaatcggagggtcagatttcatcaaagcaaattcctgtgcatggtattccgagttttcaacctaccttacagaaaataaaagcatgctttgagagaggctgagatgtatgatgcataccggtgggggaggattgaaggcgttgtatggtatgactggcaacgtgtgtgaatagctgaccacgatggcattcgagaagattttttacatcctctcctgcataattttgaactcaagagattctgggttctctcggttggggtcatgcttgccgtcaaattcaaaggctgttctagatctttccttgattggtgccaacaaggtcttgatgaagtgccgagtgatttgttccccttgtagaccctgttcgttcagcttcagcatgcgatcaaacaagtcgagcgcttgggcggcttcttctcccatcggcagtgagttccaggtatcgcgatagactgggggaagacaggagtatccgggaagcgctggcttggggttttgcacatagaaccagttcgcgtgccaacctttgttcgaggttttgaatggcatggagaagtatttttggctcaaggtccccctcagttgaaatccggctcccccaactacgcatggtttgcttttgtttgcctggggcttgaggaagaagatgcagcggaataaagcgaaatgtggcctaatccccagaaaagcttcgcaagcatggatgaaattggcgatatggactatggaattggggtttaggtggtgtaggctgattccatagaaatccaaaattcctctgaagaaacttgaggtcggaagagaaaatccgccgtagaagaaatgagaaaataccacgaccacatgtgtgtcaggagttgggaatgcttcgccgtatgctggacgccacccaatgatctcctttgccggaagaacaccgtgcgccaccatctccttcaggttctcctccgttacatcggagggcgcccactgactctcaaagctctctctctctcttccaccatggatgcgatctgaatgaggtgatttggttcggggtgtggctaggaatgaatgggagattgatgcggtggttgtgtgggagattttcgtgaagttttggaggatggagtggagcgaatcggtgaaccctagtttcgccggcgcgggttcgtactgtagcagaaaatggggaaagtggcgagggtttcggcggggaagacgaaacggcgcttgatcttcagtgttgtttcattagggtattggaagtactaatgggcatgggcctaaacagtacttcagcccaattttgctatcggcgtggctaagttgtgatccttagggacttaggcatttttgcttcggcaatatttgctcacaacaatatagcctaatgctgttaaaatcctttttgacgcagttaaataattctttggaattactacgatgcaaataaaaaggtgcccaacggaaaagtgttatactaattttgcaagctttttaggctgcaaaagctgtttgggttttgttgagatgactggttttgagtagtcattttctcggcacgttatatgcttattttggtcatggcgtgagtcataacttaggctatttagactcatcgtttgtcatgctttatatcacatttgatggatctttttgagagtttttactcggattcttatcatatgtgttgatttatagacctttagagtgtttctcactcgggtctctttatatctccttttttgtgtattaaagctaaagcagtcggctggatgttttatcaaacgtcgcatatgcttagctatgtgataccttggacgattcggttgtaaaaccactcggatggatgttagttgcactttaactatgtgtttagtttttatttaactaatcacatagttgggggctacacctaattaggtgcatctagttgatgcacctgattttttctattttagcccttcacagtctttgattttagtactcgggagaccaaggcagaagaagttggagcactcggattattgttttgaattacgagagaagactatttcgtcgactgtaaaggtctcaggggctactgtagagattatggataccccatacctacacggcatgtatatccgactgggtatggggtgccatatatagatagattatctttaaagggactcgggttaaaatccaaacttgtttgtcaaggaaatacccgggatcttagtcggttatgattgtatcttatctgtaactacctattccgttagggatatgggctgtactttgtaatacggactcctcccctatataaggaggggtccgggtgcctcttggggtacgatttttctccaagatcatacgatctataatacactcggcggatcaatccccggacaggtgtagggtattacttcttgattaagaaggcctgaacctgtataaaattccttgtctctaaactcatccacttttccagcttgatagccacccccttttagtattgccgaaatcttgtttcgacacttgcggcggcgcttggagcacgctctagagctcccgtagacgaggtcacgttcccgtcgttgcagtggacgaaacaagatggagtgaaaagaggatttgctcggcatggagagaagataacggaacgtgaattagatagggatggagacggctcgttggtgatcggcggccgacgacgaaagagaggtggagagggagagttggagctctctccttgggtttcttcggctcagggtggacagtgaagtttggcgatgcgtcagggagaggagtagaggaggagctcggcattttgagggcgtctacacgtcatagccacgcgtcgcgcgcgttcggactctgaagggcggcagagcgtgctccctccctccctatgtgtctctggtcggctggaggaggtgaacacttggacagcgacccagagatgatgacaggtgggtccagggtggtgtggtctaggtgtgggtgtaagggatgggtaggattttgagtgaaaattgatttttcagttattttcaagattatttctctcccccttactttttaaatctatagtttaatttgtggacatgataaaattagaggggatttttctggaggtagatgaaggtacctagattccatttggacgcgactacaccgagaccggtatcgcgatagccctatcgcgcgacgtgcgcgcgcccatgccaaaaaaggaaacagcgttttcccgggcccccgcgtgcgccatggctcaaaaaggaaaggaaagtgcgcgcttgcgcgcgcaagcgccgtgcaacgccacacgtcgctagctggcgtgggccccagctaagacagcgcgatgcgcctctctcccccgctccaacccatcaaatccggacatcggcgacatcaatcgccacgcagttgccacagcggtaaaaatcagaaacaaatcgccatcttggaagaggggaaggaggaggagcaaatctaagaagaaaaaaatcgccatcttggaagaggggaaggaggaggagtaaatccaagaaaatatccaggtaaagtacacatgaagttcaaattctgtcttctttgagatccatccaaaaaaaaaaacaaatagaactaacctagaaacttttagatcttttctgtattcttcgagaaaagaattcatatgaatatgtgctgtaattttgtaagtaatgagctgtagtgttgttttctgtcttcctttataccccaaattcactttctagtgctgctgagaaaaaaagttattgaaaaggcatgagtactggtgtttcaaaatctcaaagcgattttaacaggaagttacttctaacaaatcagtaagttacttcctatgaacttgcaacttacttccagataaacttgaattcacaatccctagtttacacagcatgatacattccatttggttgcctctcagagcaatttgaacaaaaagttactttacttcccaaaataaacttaaatttgcattccctagttacataggcatgagtaatggtgttggaaatctcaaagcaattttaacagaagtctcagtgcatttttaacaaaaagttacttctaacacttcaatgagttacttcctacagtacactaaattacttctcactgtgtattaagtaacttctcactgtgcattaggttaattctcatagcaattttaacagagtctcagtgtatttttagcagaaagttacttgtaacaattcaatgagttacttcctagaaacatgcaaagttacttccctataaacttgaatttacatttcctagttacacattttgtaccttgtttctatatacagcatgatgcattgtaacatactagatttttcagggtaaaatttttgtgaaaatatttaaagtcaatgttcttcgttctttcgaattggagcctcccaatccttatatttcttttgttccctctaagtttccgactcccacgtaaccttgtttagtttccctctccaaaccaaatctgagatatccagagaaaattccgaaaatcatcagaagagctcgtgtttattttaagttatcccggagtcatcattcaaatattctaaaaatcagtcttaacgatttcctattcaaaaatatcctaccaaatttctatacaaaaatctctccaaaaattcaaatagatcactgtgtttcttctcggaccgagttccttgcaatccagcccatattccggatttccttttccctggtcactctctgtgttgggctgttctaccccatgtcctggcccagcctaggcagcccggctccagccgagcctctgcaggccgacgccatccagggccgctctcgcgctacacgcaagcagcctcgcgaccttcccgtgctcgcacacgcccgcccgtgccgcctcacatcagccacgcgccgatctccattagccgtcgcgcaaatcatagcgagaggctgagctcgcctcgccatcgatctccccggtcggttcctagaccttgcactcttttcctttttctccttcttcttctttccctggaagcgttaaactcgttttcatcccaaaatttcctcagccacagccaaggccagctgtgtagccgattcgtcgtcgtcgtccctctgctgctgcaccacagcaccgcaggaacacctctcatcggtgagaattctcaataacctttgtccccttctttccttgcttctatcgggttcctatcgtgctcctgtccaccaccatggctgccaccgaggtcggcatggccgacgcttcatctctatcaactaaccacaaaaatggaaccttctcatccaggaacacgttttgacgcactcacctgcccgcgttcgccaccggagctgccacttccatgcccggtgtcaccatagctcccgatctggaactcgcgttccggttagctctgttgtcttccagcccagtgtccacgtcctgtgggggtgtcagcctgtggaacacgtcatgctatcgtatccatcgccgttccctcactggagctctagagcttttctctctacctctgttactcacgtgaaaagccacgggaagaacatgaacagttccggcagcgctgtttcctattggttgaacccaaccaatcccatcaaaaccacctaaatagtgcctaaccacaataaaccagtccaaacaattccattaggatgtttttctcatgttcgagctctaaaactccaaatcaatttcagttttcacctctgtcatctatagcattaattccaaattgcaaccactactacacataccatgaatcataaccctagaataaatcttttgtcatccaaatcaagttaactcttgatttatcattttcttttgttctggctccgattcacaatatttattttatcgtttatttgtagtatttttattataggcttatttggtcgtttcttcgtgtgcgtacgttagatggtgttgaagattccaccggactcacaggaactgaagtggacctagaaggctacgctgaagcttcggaaggccaccttccacaaggcaagccacagttccaatctttgatcatattgaaacctagtagagaaccacttagttattttatataaattattttgcgtataaattatttttgaataaacttattagtttagttattacccattattacattgttattattggccaaatccatgaattgctatatcacgcccctttgataacctagtggataagaccaccaaatatctatattcatatacatagtttacccgtcgtcacgtggtggcgtgacgggtgatataaaatatgttatttgatataagtcactcgcctagagtgatatggaagattaattccgggtgacgatggatgttgtggtgtgtgagaccgtgcatgtttgtcacgccttgaagtttccccctctccttgctttaaaaattggctaaataaattgctcgaagaaattgtttaaattaacctagagctaaatccctaattaataaatgcatttaataatcaaattcggcatggtggaatttttcttgggttccacatgtcacaatatattaacaggatttttagtggaattttcaaagccttggaaataattttaaccaattaaaaatgagcaagcgcaatatttttaatccctggaaaatcctttcttcttttcctttttcttttccttcttttttctctattgggccgtcggcccactccctcccgcgctcggcctcccctttgttgggacggcccatgcgcccctccctcctctctctgggacgccgacaggtgggccccacctgtcggtcgtctcctacctccagcaaccgccgctgccgtcgaaaccgcccacgccgctgccgccgtttcccgccgttctccgcgccccactccgcccgtgccgcgcgcccacgtcgccgccccactcctccgcctttcccgcccgcgcgcacgcacgaagtgggcgggattcattttgaatcccaccccactctctctctctcctccccacgtcgccggcggtttcgaccatctccccggccatgtccgcccctccctcgcccataaaaaccctcccccgagtcccctcccttgtttcccccatttgccgtcctctcccacgccccctaccgcgcccgcgccgtcacacccgagctccgccgctgccgcccattccggccgcgcgctgccgccgcgccgtgccatcgccgccgtcgcgctcacagagcccgtccgcacctcggccgccgcttggttgccgccgaacaacgccggagcccttttctcctcgcgcgccggtgagaccttctctcctctccatctccggccagcaattcaagccgccgtggtcgccttcccttcccctaacccctctctgctctctcttagggtgccgccgctgcccgtccgcgcctcggcatcgccggtcatcaccgccgttttcttccttcgcgccggccgccgtgctcgccggtgaggaatccgctctcctccttccttccctctctcccatgagcgccgccgccctccgcgcgtgcgccgtcgtcttcggccgccgccgccgccttcgcgccggccgccgccgtctcccgcgccgccggtcaccgccggtggaccacccgcgtggtcccggtccacggtggaccggccgccttgtgccgctgacccatggggcccacgtgctgacgccccccctgatgacgtcagccctgggcatttattgcgcaataaataattaaggactttttctttattagtaaaaacacagtttatcttctaaaattcataagtaattcatccgagctccgtttaagtccattcaagtctcagtaagtcaagaaaaatgcaaagaatccattaaaaatggttttgtttcctgtttcagtagtcttatagcatgttttgcttgtgtgctttgtttgtcgcgtagaattcggccgtttcgtcgatccgcggtttctcgaagacgttgttgaggtctcatcggttcgagagcaaggcaagtcatgcaatacaattgatcatattgtacccaatttacaaatatcccgcatttctattaaatattgcattcttttacaatgtcatgtgggatgggtcctattactcagccatatattgtttaccatatgccattgataacttgggtatcaaaatgactagatgttggcttaggaaatgcttagccatgcttagttcaactagtacacaaatggggatcacattattacatagactttgtctacgagcatagctttggattggtgccaccgcaatggtgttagttaattaaaatacactgaatggtgggctgtgggtgcatggttttgctggtcgcacccatggcagttaagcaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcatcgcggcgcaagaggggaccgcccactgccttttgaggggtgggggtgaaaccttagcgtggtgtggatggttaggggagggatatgtggagggtcttatcacgatttccccctttgcagtatcatgatgatacttcggggtatggcgacatgtgtggaatcgtgtcttgtgggtacagttgtacacctttggccagagtaaaactattcgaatagccgtgcccgcggttatgggcgatcaaccagattcaccgtgattagtctcaccccgagtttagtttaatgaactggtgtagttcaggtggttggttgggcctgttgcaacgtggtgtagcgttagacagtaattggttaatactgcttaattactactactgttttactgctttcaactactgctttgaaatgcctgctttatgcacaagaacctttagcctcctttggttatatcctgcatcatacctcctcttccggtatgacttgctgagtacagtgggtagtactcagtcttgctttcttttcccccacaccagagctgaagatcttcctagtgggagctgtcctgttggagttggtttcgtcgctgccgtcaaggtttgcctgtggagtggagtcgccccgctactgaagtcaagtttccaagtctagctcgttttatcttttttgctgcattttgtaatcttttctatttttgtaaaacgtggatctgtaggtcaacaattgtcgtttgtgtaccctggctggtcctggatagggatttaatgcacattcagcttagaaattctggttcgtgaatttctgggcgtgacaatgttgttataattattttgtggaaagtgtatatttacacttgaagtatgcacgggcctgtgctagttttggtggttttccccggatataaggactacccctatgccatggaaaatgatgtaatttgcgcccatccacaggactgagtaatcaaacttagcctagtacattgtctcactatatgaaagactgtagggtggctctatgagcaggtttggggtggacatgtggaaggggctttggccaggttgacatgatccacaacggtggaacctgtaggatcgtacaagaccaaacgaacctaccagagggggggatgaatggtagcgaaaatcaaaaacccaaaatcttttgcggaattaaagattaccctcgaacgaagtcgatgacgaagtccagtcgccgccggttgaaccgccctcctgccgccggtcagaccgccaacacctcgctggtcagatcgcttgaacacctacggtcagaccgccgctatcccactagtcagaccgcgcacacccctccggttagaccgtcgggacccagaaacaccggtagatgacaaactcgaagatgtagattgaaacttttcgactttattgcatcaactagtgtttacaaagtgcaccaacagcactcctcaccaaaatctcgaactaaacttgaaaccctaactttctctcaacttgtgtctctctaaaaccgatcccaggaggccacccctccctctctatttatacccaaaacctcctactcaaagtaggaagtaggagaacaactcctagtcacactaggactcaatcctccaaactctcgaactgcagccgcaggaaaccaatccgacgtcaatacaccaccatctccgtatggcacccggtctcgatctcctgcgcacatcccaggccagctcgctcctgctgcttcctcccaggccgagctgcctgctgctgcttcacccaagcagcacacacatgcatgcaacgacatgcatatgcaccacacacatatatgctgctactgctcaccacagtacgcaaacacatatgcatactacagtaacccaaagcactgtagcaccatatactcctctccagtttcttccaatctccttcgcgaacaccgatgcttgcacgcacacctcgtgaagcccgttgcgaagatctctcctcatacgatgtccatccaccgtatgccatctcgtatccaacttcgtcaaccggtatccttgaccgtctggacctcaactcctctctgagtctagtcccgatcctcaccgttgaccgaagttgacctcaaagaatcctgactctagtcaccttctcacatggtatcccgaccgcactagacctctgtttctccctgaacatagtcccggtcctcaccattgatcaaggctgacctcaagtcacctgcacataatcagacaaaacaaccgtttctgggcacagatatcacaacctgtcccacattagtcacacgcactcacaccaacattcacacatattttcaaaccaattcaacgattaaatcatttgcatagccaattgttcatcacaaatattacagaacccgtgaaagcagcgaccgtctagccttgcttaggcccagcaagtgcccgactgctaggacggatcaatatcctactgagcagtaactagtagtaagtgggactctcgaacgactatgttgtcctcagcctagctagttgttgacatcaggtgggtaaagctgggcagtctctgcagagatgagtcttaaatcattcgaatgtgtcgtgcttccggttaagaagctatgtcattgggtgattcctatttatcatggtatgagtagattttaaattcaaatatggaatatgatgaagatgaggatgaatggtgattaatattgctaccgttttaaaatgatgatttacaattgtttgcgaataaaatatttgataaagtagggaaaaactatttataataggcttgttatgaaacctccttgatgaactatattctttgtacgccttgcatatattctatttgtattattatggatgtggcttgctgggtacctcggtactcacctcttgcataaaatgtggttcagatgatcagttcttccctgaggaggcgcaggaaggggaataattctatggtgctgacgagttcttgttctaggtcgatctgctctcaggcgttgcctgtggtgtttttatcctattttgtgtttgggtcttttgtttgtagggagtgtgtttggcctgtcggcccctaaaacctgtcttagttatcttttatataataatttctgtaaaaacttgggtatacgtatcgaaagctgttctgtatatcaatctatgcacgatcgaaatcctggacagtcgcgggtggttttgggataccatactcaaaccgggtatcccgacatgcatcccctatttgcgtctcaatttcatcttgtactgcataaaaacaaattgtgaaaaaaaatcattagtgaaagggtcaattaggcctagagggggggtgaataggctaatttaaaacttaagaaatgcggaagcagtaattttcggagctaggctaggaattttcggaacttccgagatgattttcggaacttccgaaaatgcacagagcagcgcacacaaaaaatgaaaactctagatctacaagactataacaggaaatacaaggcacaatcagcaactagaccaatagcggcacaagcaagcaaagctagaggagagggatgaagaaatttcaccaagatgtagctcccaaagttgttccccggagttcaaatccttgaggggattctactctccgttgaggagctcactaagagccgggtcttagctaaccctttcctcaagaggttgcactaagcacttctcctttcactaagaggtatctcttctcttgcggaggcgagatccggccttcacaaacttctcccggccaaccacaagtagatcgatggctcgggagtgacacctagccgtctaggagtcctcaacctccaagagtaaaagatgatgcaaagaactcccggagatgatgcaagtgctcacaaatcttcacaaagaccacaagaagcacccacacaagctcaaatccacactctcacacacacaccaaatccaaatcaaacacgggtggagagatgaatcgaggaagcaaggctcaaatgaatgagagagagagagagagagcaagccaagggcacaaataattggaatggaaccagcagccctcacaagatctgcccgttggagtgcaataaaagggattttcggaacttccgaaacaattttcggaacttccgaaaattccagatctgagaaaaatcgaagtcaacgcccattttcggaacttccgaaaatacttccgaaagtacttccgaaaatttccagaacgcttctgtgtattttcgaaacttccaaaaatcattttcggaacttctgaaaatttccagaaagctctcaaacggttctgtgtattttcggaacttccgaaaatgatttttggaacttccgaaaatttccagaacgctcaaacacggttctgtgtattttcggaacttccgaaaactattttcgaaacttctgaaaatttctagaacactcaaacacaattctgtgtattttcggaacttccgaaaactattttcggaacttccgaaaactattttcggaccttccaaaaatttccagaacactccaaaagagaaatgcttcgaagaaaaattgattttgagcacacgcatcactccttatatgtctatgcatcatcccccttaatagtacggctttcctacgacacaatgcgaggaaaaagatacaatataccatttgatcattgccgcattgcatcgcgatgtcgcattcacgggatatgcattgtattacaacatgttgaggacttaacaaccttcacatttgcttgaataaaaatgttagtcctctctaatcgcattgtaatcaatcatcaaaatcattaggggcctagatgcactttcaattagtatagccactggtctaatttgacaaaattgcttcctagaaagcatctaaaaaagacagaaatgtttgtataggttatttaattacatcgagtccagttataagagttgctatcctgttgcatgtaacttacttccaaactgtactggcttacttcaaaacatataaatgttactccctctaaaacatgcaagtaattttctataccacagatgtaattgtctgacaaaattactcctctgaaaaaaataaaagctttactttcatgtgatgtgcaagttacttctccccccaattactgaattacctcaatgaatgctctgtataaacttactaatagtctgaaacacatgcagcaaaaatggattttgacctcaacagtatcccggaattagtttctggtgaaaatgaacatccactacatcatttactaattgatgatgaagacagaagtgaaacataattccctgtaaatccaactgacactagcatggagattcctactataaatttggacaacacttttgactttgaaactatgtatactgctgatgatgctggaagtttacgagcacacaatgtagccaatgatgagatgcaagtatttgcaaccaatgatcagatgcaagtatttgaagccaatgatgagatgcaggtatttgcaaccaatgatcagatgcaagtatttgaagccaatgatgagatgcaactatttgaagaaatgtcagatcatgcagacacaatgcatactagtgttgcaactggcgcaacaactgctactgccaacacaatttcaagtgaacactctggcacagatgattcagaagcacagtcagcgccatcacaggattttttgtgcagcacacaagtgccatacctcaccttgactttcaac

SEQ ID NO: 75505 - DNA, 15034 bp, Oryza sativa
gtggcgagggggtgacacgtgtccggggactgcggggggcgcgtggtgcgcgcgccgtcgggcggtttggctgcgcgcctctcttccctggttttcgccctccccgagcccggtttggccggcccctgctgctgctacatcaccacccaactaccaaacaaaccaaaagagccccatcctttgacatattagagaaaagacgaaatgatatatttacaaatataaaataatttgtaaattaaaattttatatatgtatttttaatgttctaaataaagattggaaaataaactatgataaaaggtcctaaaatcaacttcaaatctaaagctaaaaatttaaatcctgactgataaacataaccgagaaggtgaggctgaaagcttttgactctggctgggattagaacttgcatcatttgtattgaataatgggaaacaaaggtcggtgataccaccaaaacaaaatgacgggagaaagaaaaaaaatctttttttttgcccctaattagcttctagaatccttctatatgtgggagcacgtgataaatttggatggtggccaggctatatttcttagtgtaactcatttttcaggtgcatttgtaggatttcatctcttacctatactaaaggtgttatccatctccagcacggtggttcctgaaggatggaggaggaaggggcagctaccggcgaggagatcaaccaaaagagggatcaaaactattttaaacacatctactaaagagtaaaaaaaatcaaagtaattttacctctataacatggtaggacgggtgagcaataatcttcccttctttcctctcttctcattgataacgagatcaccggaggtgttgatagtgagataggcattacaagtgcgatgccaaacaatgaagaggaaggaaccattcacaagtttgtggagtatagtatacgaaggaggtggaagaagagatcaccttataaacttgcctctatcattatgtcgcctcatctcacacgtctttgcatcgcatattaatgagaagatatggttaaatgtttttaaactaccacatgttatgcatgcacctagacgttgttcccaacctccacaacgctggatccaccatccccgacctcctcggcgatggatctacccctcccaagggcgccgccggtggatccgctcctcccatggcctctagccgtagatccggcatcaccgtccccaacctcctcggcagaggatctgcccctcccaagaccgttgccggtggatccgcccctctcatggtctctagcggtagacccggcatcaccatccttgacctcctcggtggcggatccgcccctcccgaggctgccgtcgatggatctgcccctcccatggcctctagcggtagatccggcatcaccgtgcccgacctcctcggcagcagatcggcccctcccatagcctctagtgctagatccgacatcaccgtccccgacctcctcggtggcagatccgcctctcccaaggcccccgccggtggatgccttcccatggcctctagcggtagatccggcatcaccgtccccgacctcctcggccgcggatccgcccctcccaaggccgccgccaatggatccgcacctcctattgcctctagcggcaaatccactactcccatggccgccaccgcccaagcctgccgctgttgcagcccaaagccagtcacctccacctcgaccacccgaagcggttgctgctatgtatggggagaggcaaagggaaggtggagtggcgaagtagaggaaaagccaccaggagagagggaggcgatgggagaatgggagaagtcggagtaagacattgtgtcttatagccgcgctccagcccttgccttttatatcttgtcggtattttctcaatcgatagccccgagagctgtaaagagacccataagcaaaaaaggtggtttttttcaaccgggctcttaagcggtccatatgtaaaaattggtttgtctataaaaaaccaattttcacttatgggtctttgggatcccttaattatccattttcacatgtgggtatctttagctagactgcatgtaaaactggagaggatgtgtttacaataatggttttgtagtagcgtggtttgcataattttcttgttttaatttccttgtactttttctcaatagattgaggcaatgatatgaagtgcaatattgtcgatgtatgaatatgtgtatatcatgcatgtatgaacaatatatagatgcatcatattgctttgtatatcttttctggccgggttgatacctacttaccaatactgcctgttcaagatcgatcagcggtgatactctctagtagtatcactgtacattgattgccctctcttcatgttactaattagaaaaccagcagtgacgccgtttatgaactctcctaacgggacggctggtggcagtgatcgttcggtcgttcaagaatgtttttccaatgtaatgtgctaatatagggttcttaattaatgtggacgcaattaacatcttaggccctgtttagatccatttggaatagcaaatagcaaatggcaaaagttttggtggtaaaagttttggtattgcaaaaatactagttggtgtttagatgcatcctaaacttttgccattctagcactaaagtgagagatagaaagaaagagggagtggtcccaaagcactttttggcacaatttgctactatagactagcaaatgccaaatgccaaattgccaagttttgttactagtgtttagatccaaaatagcaaaaagtgctttaaaacggcaacattggatgatctaaacagggccttagcatctcttggaatgcaactatgcaatcatatctttcgaggtaattaaatcaagaaattaacgcaccttttacacataagcactactctctttgttataaaatataacaatgtttagcatttaaaatttcacctaaaatatatttctttcaaccaatcacaatcttctaacattaaaattccctacctaccttctcttttttttataaggaaagagaaatatattactcaacaatatatattgtcgtcacaaataagttgtgagatgaagttacaaccagaaccagcccagaaaaccggagaataactcacattgagccttgttactgcctacctcctcttttaaaccaatcacaataaatcctcatttaattttattaacctttttaatatgtatctttaatcctaaaactttttatattacatgatcgcataaacttcaccacattcttatcatgcatttatgcaatcatgtatatgctttttggccttgctcttttcttcggctctgctaccgatttttagaatgcaattaattattgatcgctcttaagtgtatatttggtcgtagcaaattgaaatataggatggataatttgtctaacttttgctccgtctggatatttcaatttttatgctggcgcatcgatgtatcatgtactctgtactgtgcatgtctgtgtggtactcttgcttgggtgtcgcgagatatttgaattgttaaatttactccaccttcatttaataatattctctccgttccaaattatgattaagaacttatagtatttgaatacttttctaaaatataaaaatttataacactacaaacagtactattatttatctcatcaattattcctcattcaaatctcttctcatcttacccccacttctccatccaaccccacttatttttcatttattgaggggcattaattaaagtatttttcttcttaaccttaacctctacataacaatataaaaatacttatattttaaaagaaatatagtaatagataattctccttttttttctctcaaaaagacatgcaaggcagcaacaagcagccatatataaatgggaacaagtacacaattaagatgctcggaggaaattaaaccagagataaaaccattataaaaaaggaagatatactcccccccttctctctctctatttcaataactgcaacgtcaattctcttccaacattaaccaatgctcccttcgttttatattatcaatcaaactttgagaaagtttgatgaactgatgaagtatataaaaaagcatagcaattggtttcatttcgtataacattgaacatatttttttatattcttatttatgttataaaaactattgctatattttttctataaatttgaaaagcaaggcagaaacaagcagccataaaagggaacaagcaaacaagatgcttgaaggaaattaaaccagagacaaaaacgcgttataaaaagggaagatatactctctctctctctctctcaataactgatgataattttcttgtttctattccctccattttatattataaatcgctttaatttttttttaaaatctaacttcgagaaagtgaaaaaatatagcaattggtttcattatgtctaacattaaacatattttgatatcttttatgttgaaaaaatattgctatgtttttttataaatttggtcaaacctaaagtggtttgacttagaaaaaagttaaaatgatttataacatgaaacagaggtagtattattttttatatactcaaaaccatattgttagattcattttgtatagaactttgtaatagggtagagtttcaaaagtatttgcaaatctgaaaatatcaaagttcaacacagccccatccttttcatatgttccctagaatttcatttgcctcgtataattttttttatttttctactatgtctactatattgattagaccacctactttaagttatttgtgaagtttattagaccacctattttaagttatttgtgattttttttaaaaaatatattaatttatcatgttaataaaataaacaatccgcgtcaataatatgaaaaaaaatgtctcaaacagcgtcaacgttatcggtctattctgatagatatagatatagatagagctagatatacatatgcatatagatagatagatatagatatgcatataagatatatatagatataacaatgtcatatatactgccatctgcaaggtcgtcaccctcggctctacaagactattgcaagagtccaacttttgcacgcatagctagtactaggatcatatagctactaagctacaaatggcgatagtaattttgcttaattaatctagtggccgtcctggactcctggtttgaaaaaagtctagatagctcacaaatgtacgcaagatacatgcatgttacctcactctcaaaaaaatatcattttttatccagctcatatacattaatacaaagagcaattttacggtcattgaggtaccaagaggtaccaaatttacaatagaaaaaatggtacctcatggtacctactcaagaatcgtagaattgctctaatacaaaactaacagactagaatacttttaccaacttttatcaaaatacaatacaataattgtttcaaagtcaaagtttttcttaagacaaacgaattgataaaagatgtggctatttgagattgaggatgttacaatactatggccctgtttctttcagtttgggattattataatctagattattaagtcagattactataagctagattgttataatttatataatttatagtagaataaccgttggttgtttctttcctagattattagagcctagattattgggttttgcaagtctaaagagggagtggggtggcatggtgggtaattttgcacccaatattctgggaaaagctcacctaaatgagcttatcaaattataataagcgggactctagattataataagctacttcaataaggcttatttgtttctttcagcttacttcctatatatatatatatatatatatatatatatatatatatatatatatatatatatatatatatatatatacttttgttattggcgctcacggccttggagattttgtgttgttggcggtaattaggtagatgggctctactaataagaaatcaacgaaggtgcatgcacctcccaaagaggaaacaaatatgaaccagtccagtacttgtactgttcttttttttttccaaaaagggaactgttttgtgttgcttgaatcagtcggctatatatttagctcttattaaatactatctctgtattttaatgtacgacgccgttgattttttatccaatgtttgaccattcgtcttattcaaaaaatttatgtaattatcatttaatttattatgacttgattcatcatcaaaatttatgtaaatattttcatatttgtacaaaaattttgaataaaatgaatggtcaaatgttgataaattctgttggtgggagattggttttgattaattctgttttgtcaagtctagctatgtttattatgtttatgatatcgttttttgagattcctaaaggggttcttcaaaaaattgattattatagatcccgtttcttttggcaaggggatgaacataaaaaaagtatagattgacaagatgagatattatttgtcaaccaaaaaatcagggtggacttggagttcataatttagaaatataaaaccaatgtcgtttaagtaaatggttatttaaattaataaatgagcaaggtgtgtggcaagatttactgaaacgaaaatatcttactggtaaatcaattactcgggttgagaggaaacaaggggattcccatttttggtcaggtctgatgaaggttaagaattcctttttaaatatgggttcctggattattaataatggtgaacaagtaagattctgggaggataagtgactagggaactattctttgaaggaaaagtacccctcgttgttttctatagttagaaggaaaaatgcctcaattgctaatgttatgggttctgttccgcttaatgtttcttttagaggagttttagttggtcaaaatctaattagatggcataatttatgtgcttccattgtgcatattaacttaacagacgaggatgaaatttttagatggaattttcattaaaatggccaattttctgttcgatctatgtacttagctttaattaataatggttacatagagaaaaataaaattatttggaaacttaaaatgcctcttaagattaagatttttatgtggtatctccttaaagggattgttttaactaaagataatttgactagaaggaattggaatggtagtttgagatgttgcttttgtatgaaaaatgaatcaattcaccaactattctttgagtgccatttttctaaatttctttggagagctatacaattctcttttggactttatcctccacatagtatatctcatatgtttggaaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaattaaacttgagacggcaattatgcatttatttgccaacttcaggtggaggttctctattagaattcagtagttaggggatctttttcttttgttggtgtctattagtttgcttagctttgtttctgctttcgtgaactttctgtgtgagttctgtaataattggctgtaactctttgagtaaaggccggaatgttacattccattatctaaaaaaaaacgttgataaaaaagtcaatggcgttatacattaaaatatggagggagtagttgcttagcagtaataagcaaccaagtgggataaaactgttgactaactcaaagaaagtagctgcatcgcggggttgacctgctttccctctctttgttactcagtagggcgtagtttctagcccaagctagaggtggggaaaatgaccacaactgaagaaccgagttctcaaaaaagaagaaagttctaaaaaaaataactgaagaaccgaaccaaacaaagaccaagactagattgaacaggactccaaattttggtcacaaaatcagtcataaactcctgctaattgagtttgataaggttattttggtcatatgtcccaattaaccgaaatgacaaaattttaaccgaaccctaatagaagcctaatatcccaagaagtatcaaaacccctaacatctaactaaaccccgtctttcccccacgctccactcaggtgatgacatgttatcattcaccctagctcccagctaccacctcccttgcctctcccctccatcctcctctttctaccgtccgcttgcattcttcctatcgtgccgtccaccatcagtgtcgtacaactgctaacactttacccctgctgaggacgtcctttgcctccagcctccttcttcggcatcaacgtcacccaccttctccggtgccgctcaccccatcacctactgtccaagcgtcgctgctccccaaccttatttgccttcctctttctctcattccaaggtcacttaaattcctaggtattgtagctcacaatttagaggtaaagatgggagcttgattttctttaggttggcggttggggatcgatatatctccacgtcatccatcacagatccatatttcagctatgtccataacttgaaccgacaaaaaccatatagctcgatcttcaccattttgcaatgcaattcgttctctatacttagggtgtgtttgaggagaaggggattgaggagattgggaagatacgtaaaacgaggtgagccattagctcatgattaattgaatattaactattttaaatttcaaaaatggattaatatgattttttaaaacaactttcctatagaaaatttttgcaaaaaacacaccgtttaatagtttgaaaagcgtgcgcgcggaaaactgagactcaatctcccctatctcccccgaaagaacgatgccttagatgactgaattttactcaaaagagagaaagaccgagaccgacacaggaaggctgaaacactggaattaattaagaagacaaaggtaatatatgttcttggttgcttattagttctgattctgatcgtattgattaatgtaatatgtcaaaaacattataattgggacttgggaactaaacaatatcaaattagaagccaatatatatcgaccactccactcaaattcgaagcaaacattctagccctataaactcaaattcttctctactacaaactttcaaaataagttagctatatgtatagtttcgtataaaagattaacttatttttggaacgggggataatctatagtggttttacgataactcgttcatgtataatttaaccgttgatagttttatttgaaccctaaaccgttaccacaatggtaatcccagggcccaggcaccctggcctaggttacggcctggggccgagcccaattagcaatagaaaccccttattttaaccctagaaatcttagcccataaaatatggcccgaggcctagctgaggagccgttagaaagatagagatagcgagaggaaagacaatgactgtggatcgagtgatttctctttgctggttccatcactcatgctccaagatcccttgcgcatcgctccccaccccgtctccctttctagcaatatggtcgtgcgctcttcgtcatagcgtcacctcaggctccaggctccagtgctcctctgtgctagcctgtaatgatcgggtgaggatgcttcgcttctcacctgctccccactctggtgaggacaccttccccatctttccgaggaggcggcatggcggcatcagccaaccaacaaggacatagctattagaaactcggagcttatcaaaatcctggatccaccagtttacaagattgatggcttgagtgaaagaggagataatcggcacatccgagttaaaaaagatttgaaaaagaggagctccaaaagcaaagaaacagaaagcacttgtgccagtagctagctgacccacgttccggcaacagaaaacatatggaccatagctgccacagtagtgccatagctgttggacggtactctacacttttgataggtactaacactacacaagtgtgtttactccgtccgacgtgtcaacgagaggtctctcaggctgggtgaaaagttatatgacacgttttaaagcattaaacgtagtctaataaaaaataaattatatatttcgcatgtaaactgtgagataaatttattaagcctaattaatctattattaacaaatgtttaatgtagcaccatattatcaaattatggcacaattaggtttaaaaaaatatctcgtaatttacacgtaatatgtgtaattaatttttttctatatttaatactttatatatgtatcaaatatttgatgtgataggtcggatgaaaagtttttgcgtgggaactgtttcgcctcactctctggcatctgctacggccggtggagcccacaggcggtgttcctccctagggccgtgcgccacgtatggtgtcggagctccaccatggaggcgccgtccatatgagtatatgaccctataggacacggcgccatacgcttttacacgtggcagatcacttttacacgtggagtataacgaatgtggaaatcatgtacagccttttcttttttatttagagctggatttttggataggatcttcgtgagaatgggaagggagaagattaagaagttgcgtctgatgagatgagccattaattaaatattgattattttatacttaaaatacgatttcgctagaaatctaccgtgtgactttttcccggtgattttacggatttgctgaccgcacgatggtggaggctgcatgcgtggtcagccggtcgggatgatcttgttcgtactgtgctcgtccctttgggcatgaggagtggagacgatcgccggacgggacgaccttctctgcacttgaatcttgtgcgtaagtctgaaccaagccaaagctaggatcccacactaattacaccaccatgtggccatgcctaacaaatctaccatcgctataaacctgttctattcaattctttttttaaaaaaaatttaacagatataattacaatacaattatagtgtaattatactgcaacttatatataattacactgtaacttatatgtaactaaattacagacatatataactaaaattacatttgtaaattcagttgatatgatatgtaaatgcactgtaattttgataaaaataaagtataagtaaatatgtatttgttattttttttaaaatataaaattacagtcctacataactaaaattacatttgtaaattcagttgatatgatatgtaagtgcactgtaatttttataaaaataaagtgtaagtaaatatgtatttgttattttctttaaaatataaaattacagttttatataacaaaaattatatttgtaaattcagttgatatgacatgtaagtatttagaatataacattacagtcctatataactaaaattacatatgtaaatttagttgatatgatatgtaagttcactataattttgataaaaatattgaataagtaaatttgtattagttattttattttgtagtccgttggatataaatctaagtgtaaaaaaaaaatctggtgatttcttattaaaaatcacccgacaaatgtgtaggcatagtaacttttttaatatatatttttaaaaaagtaccgttgattaggaagcgtacacgcaaaaaaaaaaacgagataaaccttctcccttttcatcctaaacgactatgcttaagtgttgtttcgttgtctttagaaacagaatcggtggcatctcgtcaaaaattgatgctcggtcggtcaggaatcaaccatacttatcaatttaactattttttaagtgtttacgggcaaaagaaacaagaaaaaaaatcaaaattttatatattgctataaatagtaacggtcagataccacttctatacctactttgaaaaatcagtaattttctgatcgtcacgtagccgctttcgtccgtcttgtgcattttcttcagtcgtgcgagaatcctatttgctcacgatcctcttttcgccccgcgcttcctgttaggatacgtataggctacgatagcataaatcaaaattttctgtcgcgtaaaccaggaaccatgcaagtattagatcatagatcgttaccactcgacgcgccgcgcagtggaagaagacgttgagaagtcgaaggaactctcgggaagtagcgcgcgtcgatgtagagaaagtagtcgatcgcatcggctcgaccttctcctcctcgtacgttctcctcgccgtactcccacgctgatcagcaccgcaaaccagcgacgcctctaccggtatccacacgtacagggacggaacgccacgcgcagatgtgctagcacccgcgcgcggctatggttttgctcggggagggaagtgacggctagggtttctcacgtgatgcaatacctccgccggtcacacccctcacgaatatataggatccatcacttgggcctccaaggcccgtaggaatcctattcggatccctatccaaattaaactcatattggatctccatccaatccccttattccggcccattaagcgtgcgaccctataggttcatatatactcggttgtaacccgaaaactccttttcggtccacgcgtcaacagcggcccctagcagaacgtattgacccaccgggcatacataaagatcatatcggctgaacctctagtatatacttgtatgaaccccttacctcacgatatcaattaagctcaaggctagatatgtgtcgtcctctaatagctcaatcattcactcgaacctgttgatagattatataatttgtgattgactcctcaatcacctttggcatggccatgcacttccatattctacaacatcgaggggcccagagatatctctccataggaggggcaaatcccatcttgattatttatatcccactacatgtttcatagcatacccgaaaactacttttataactacccaattacgaagtagcgtttagcaatcctaagaaagctactacatatgttgggaaccatgataatctcaggtctaaggattcagcaccaacactaaatgagatcactgatgacacaacacatatggcccttgcagtatctcatgttgggtctatctaacaacatgttcactaacatgtgtctacattattaatttggtatctctataccatgatctatgagacatgatcatcaattaatacatgtgctgatcatctaaacatatttgtttcacatatgatatttgatcagggatcctttagaaatagcaacacataacataacataaagagtctcatgaaagaatcacatattcattaaccaataatgagttatctatttcaaggaacaatgtcggataaatatgtaaacatagtatgtgatacaatcatctctatgattgcctctagggcatatcactaacagtctcccacttgcactagagtcaatcatgaatgtatcttacacccattgccctagtgtgtgcctcatgcttaggctgagggagtggctttgtcaatggatctgcaacattcaaatctgtatgtattttgcatatcttcacatctcctctacccactatctcgtgaatgaggtgataccgccgtaaaatgtgtttggacttttgatgcgatataggctccttggtttgcgcaatggcaccacaattatcgcaatagaggtccatagggcttgaagcactagtcatcacacctagttgagaaacgattttttttatccaaacagcctcctttgctgcttcagaagcggcaatctattcggcttctgttgtagaatcagccactgtatcttgcttcgaactcttccaactcacagcgcctccattcaggcagaacacaaatctagactacgatctaaaatcatctttatcggtttggaagcttgcgtcagtgtaaccatttacaacgagctcttcctgtcctccatagactaggaacatatccttagttcttctcaagtacttcaggatattctttacagctatccagtgactctcacctggatctgattggtatcggtttgttacactaagtgcatatgaaacatctagacgtgtacatagcatagcatacataatggatccgattgctgaggcatatggaatcacactcatcttgtttcgctcatcagtcgtttgaggatactgattcttaccaagattaatgccatatgacatcggtaggaaacctttcttagaatcttgcatgttgaacctcttcaacactttgtcaatgtatgtactctggcttaatccaactagcctctttgatctatctctatagatccttatgcccagaatatatgctgctccccataagtctttcattgaaaatctatttctcaccgatgtcttagcggattcaagcataggaatatcattcccaatcaataatatgtcatctacatataggattagaaacaccagtgcgctcccactaatctttttgtatacacaaggctcttctttgtttttgacaaagaccaccgctttgactacttcgtcaaaaggaatattccaactttgagatgcttgcttcaacccataaatggatttatgcaatttgcatatctttttagctgattgtggatcaacaaatcccttggattgtgtcatgtacacatcttcatcgagatttccattgaggaaagctgttttgacatccatttgccatatctcataatcgaaataggcagcaaccgctaaaacaatccgaatagattttagcatggcggctggcgagaaagtttcatcataatcaacaccttgaatttgtctgaaacctttcaccaccaatcgtgccttgtagatgtaaacatttccat

SEQ ID NO: 75506 - DNA, 53883 bp, Oryza sativa
  unsure (1)..(53883): unsure at all n locations
gatagctcagttagcccctcgaacgcgcgtagacgccgccccgagctccgccgccgctcggcatggccttgccgccgtcggcgccccctcccggaggccgcctctcgtcgccggacctccacggcgcctccccaccctatctgatcccagaaacgaaacccttgagccccggagatgctcccgccacctttaattgagtcctcgtcgcccctcggtgatttcccctttctctcgccgccggccgccactgtcgaattccaccgctgtcgaactccctctagcgaatccgagccgttggctcgctccttctcgatgccctcgtcactccggtgtgctccccgaagaccaaatccgtcgcgcttgctccggtgaacatggcctccgtccgccatccatctcggcctccccttcttcctcctcccgccggcctgcgtggctgccacgtaggcgccacgtcggcgccacctcggctttgaccgagccgagccggtcagccgcctcctccctcccccctcggacgcgcggtccatggtgcgccaaccggctgcgcgtgggcccgccgcatccctggtccatccggtgcacgcgcatgaaccgcgctcacccgaaaccctagcaccgccctcatgcgccgctcccacggtgagccgcgccaccgacaagcgggccccactcgggaccccacaaggtggactcggcccaccggccctttctctccctcacttaccccgcgcccccttgggccgcctctccgggccggccggcccattagttcggccgagccgtgcctctcctcttgggccgcacccaagccgcccgaggaagtctaaatcatatccctccttcaatttctttccaaaaagggtttaataaattattaaatcctttttcctttagacagaaattccttaatccttagaaaatccatatcttctcaaccgctcatccgattgactccgttaaacttccaataattccgtaaaaattgagatctatctaatggtactattatctagtctaaataggatctttattttgggtcttgtgtagatttttaattgtttgcgtatagttgcggttaccggattttcgtcgatcgcgggttttctcgaagattcgtgaagcttcgtgaagacctcgagcaaggcaaatcaccctttgaccaattgctcctataattggaaaatcattattaatttgtttgcaacttgcattattagcaacacacatttatagcatgcttggcctcggtttgcgtgccaaaccgacggacctacctagtagtcgcactaattcctgtaggctgtactaccctgaatccttgtcgctccacctttgtggtacttcggtatccgtgctctctgagcgcgtataccaactattccacatacaccgttgtttgtcgataatctgagaaatgggtttgagaagcctttaaaacccgacatgtggtgtcggcgtgtttgaaaataaaatgaattgtgaaaactcgcgatgcggatgctgtgcctgggtggcactgtcccgtattcgcatataaggaccgattcctttgggaaattcatcaagcataacaagtgcaaccacatggtggtatgggacaccctggctaagtaattagctgcttttgggaaatcttgtataccaatagaggcggaaagccgggatgtgggggtagaggcatcctgggagtccgaaacagaggaaggcacccgggagtcctaaaaggaaagccggagttggcccgatgttggtcagggagaccctctatgtggcatgaggtaacccagagttagctttggaaatgccttgtcgcgaatctcccttttccagccgtgtgtcatgaacacgggttaggtgatgggagcaagttcgtgttgtgtgggtaaagtgtacccctctgcagaggttaaccaactgttcgaacagccgtgcccacggtcatgggcggatgtgaggtggttcccgttgcgtagatttgtttgcctgtgctttgtgaaaagttgttgtggattgggaatcgtaaccagaatcagcctaagtggcagatggatgacctgagtggtcagaaacgaatctgtgtgattcgggatgtctgcgggcatcatagactaggcttcccgagtggaagcggattgttgtgctgctgggcagctggactctgggagtccacaaaaatgaaaaggctctgggagccgcctaatcaagtgaaatggctctgggagccgagaagtaatgatctgaccttggaggtcggtacattaccaattgagttgttgaaaagcatctcttaagccgaatcgagacgcaagtctcttttcaacccaaacctaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctctctctctctctctatatatatatatatatatatatagttcctccgcccggatgctgaagatgaagaaaagtgaagattagggtttcgtcctggttcccagccgtcgcctgtggtgttgggtgttagaccgttggttccactgctgctgctgttgctggtgtttcctcgtctgtgtcttcggttgtattctcaggctgtcctgagctgcaacctaagttaaggtaaataagtcctctacttattttaaggatttgcaatgattcatatttgtcaccgtgggtaccagcactatgtcctgggactggtactatgatcgcggtttcgtaggaagcggttcgcgccgtttttcctacgacacgctcctgtcaggtgctgttgtacggcggtgccggattggggtgtgacacacgaggtgtggtgcgcttggttaggggggagttatgcgaagggtcttgtcacaatctctcgcatggtaacgtgttaggcatggcatggtgtcatacggtggattgtgtctcgtgggtacaattgtgcatctctggtcagagtaaaaactatttgaatagctgtgcccgcggttatgggcgatcgatcagcttcaccgtgatttgtcccactctattaattaaattgacttaatgaactggtgtagttcaagtggaatagttgggtttgttcaacatagttatagcattgataagtggagatttaatcttgagttaattaaacaattgttttaaactataaatgtttacaaccgtctttacgcaaatagccacaaacctcccattgtctccccttgcatgtctgtatcattggtgtggcttgctgagtacggtggttgtactcagccttactgttactcccccttttcagaagtgttatgcttctgagctgaagacagagttagaggaccaaggcttataccccagttgagttttgcctgtggagtggagctaaagccatgctaggatcacctttttccgctgttgttgctttctttttgtgtgaggactaattgcctattctataagtatgtacgctttatttatgtttggatctgtatattaatttgtcgttttgtgtaccttggctgattcctagacagggacttaatacacaaaatactctagaaatttcggctaaatttctgggagtgactgtgcatgcaaaatgagaaatccattagcacatgattaattgagtttaaataatttcaaacttaaaaatggatttatttcatactgtaatggtacttctacatacaaaattttcatatgaaatgtatcatctagtagtttgagtaccgtgccaacagaaatcgatgaaaaatatgtattttaatcagaaaaaagaacggggcttagagtggttttgacaaacaaacagattgtgttgccactccgataatttcgtgtagagtcgtattcggagacatttaattgtattttttctctcaaaaacggaaacaaatatggcatcaatgttattgggtagatatgaaaaaaagtaagaaaaccgtgtatagatgcctaccaaaagtaggaaatactttttttttcacctacaaaaataaaaacttaaaaaatgcttttcataggcaggtcctaaagagagccacccgtggaaatcgatttacagaaacattcgtaattcagcccgtgcaaaaaccagcgatttctataggcacatggttgtaggtggatcagaaaacgctcgtgtaaatgggttatcagccacctgtacaaatgttttatgtagtagtgcgttttactttttctttttcttagaattcctctaatttattagaggtgacacatggcagcagggtttgtaagaacatcaccaacagcatctcgatatcatttcctatctggtattttggagatttttggttaaaaattgcatccaatagattctcaaccaactctcccaatccttccagttaccaattgagttcgctcccaatctgtctaagggcggcgaggcggcagttagggttgcatgcgagcgtgatctcatgagagcgaggagtgaaaactgatttctgttggaagtatcctaatgggcccacctttttgtttttaggaaaccaattatagctaatgtgttggagggatgttcttggtgatgcatgctcatgtttagtggattttaagaatatggataatatggagattgctacctatcggacgtatgacattttgcaaaaaatcggacggtgtttcaccacatgtaaaaaaatgtttcaaatgtttcatcactcattgaataatgtttcactaaaaaatgttttagatgtttcattactcgatgagaaatgtttcaccacttggaaaaaaatgtttcaatcagataaaacaatgaaaaaacactggttgcaacattaagactctattatgcaacatcgaagaaaacacatcgtacatcatgtgcaacatccgatgaaacatggatgaaacacacaaataaaatagagtgcaacaaacatatacaatatattgcaatgcaacatgatcgttaagaatgatctcatggctctattcagagaatttcataaagggacattacccctttatagcctaaactttgggatcatcgtgctgctgccaaaaaaggctgatgcaaaacaaatttaacaatataggcctatttgcctactgagtgtaggctttaaaatttttacaaaagttggcaccaatagaattacagcggttgctcacaaagtcattcgcccaacccaaacggcgtttttgctagatagaaatatcatggaaggggtggtgattttgcataagactgtccaagagttacacacaaagaaaatggatggtatcatattcaaaattgacttcgaataggcttatgacaaagctaaatggtagttccttcagcagacattacgaatgaaagggttttcacaatcatggtgcaattggatttccaactgggttgaaggaggaactgtaaatgtcaaagtcaatgataatgtaggaaaaaaattccggacatgcaaaggcttgagacaaggggatccaatgtccccaattctttttaacatagtgactgatatgttagccattcttattaaaagagccaaagccgatgtccaaattagaggggtaattccacacttagtggatgatggtttgtccattctccaacatgccgacgatagaataatatttcttgaacatgattttgaacaagcaaaaaacatgaaggccattcttgttgaacatctctcggggctgaaaataaactttcataaaagtgaaattttctgctttgggggagctaaggaaatgaaggatcaatataaacaactgtttggttgtaattctggttcctttccattcagatacttaggaatccccatacactatcgaaaactcagaaattctgattggaaatgtgtggaggataggtttcaaagaaaactgagcacatggaagggcaaaaataactcctatggtgggatattggttcttcttaactcggttctttcgagccttcccatgtttatgctattcttttttgaaatacctcgaggtgtacttcgaagactggatttctaccgatcgagctttttctggagcagtgatagccagaaaaagaaatataggttaacaaaatgggattatatatgccggccaaaatatcaaggtggactgggtgtcctaaatcttgatatcatgaatagatgtttgttgagcaaatggctattcaagcttcttaatggtgatggcctatggcaaaatcttttacccaacaagtacttaaagggtaaacccctctcccatatgtcacacaaaccaggaacatctcaattttgggttggcctaatgaaagtaaaagatcaattttttcagtatggatcttttaaacctggtaatgggatagagataagattttgggaagacacatggttgggcttgcaacctctcaaatatcaatatccttctctgtacaatgtggttcgaaagagacattctactttggcagaggttacgagcacaacaccgttgaatgtttcattctgacgatcaattgtaggaccaaagttagttgagtggaatgatttgatttctcgactagctaatataaccctgtcaaatgaaaatgattgctttatttagtcgctacataaaaatggccatttttcggtcaaatccatgtataatgcgatcatcaattccaatgtaaggatctgtaagaggatcttatgggaggtgaaggtaccactaaaaatcaaagtatttatgtggtttcttgacaaaaaaaagtaatcttgatgaaagataacttcacgaagataaaatggaggggaaacaagcaatgttgattttgtaatacacaagagaccatccaacatcttttgtttgactgtcatgctgcacgttttgcttggcgatgtgtcttctttgcttcaatattccctgcccacaatgcaaaagatatttttggtaactggctaaggggagttcctagacccacaaaaaaaataattttatttggagctagtgctctatgttggtcaatttggcgttgccgtaatgatatagtttttaaccataaaaaaatgcctaacatcatgcaggttatcttcatatgttctaattggctccactcttggtgtatgatgctttcacagaaacaacaggatactatgcgcaatggtgctacacgcttggaattggtacgtagccaaggaacttttattctagtttggatagcgtagtacctacagaatttcgtgatagaatctacgtgattttaaaaaatattatttagtagatcatattatcggcaaaagttggggatttgtcccatctcgccttttttaagctcttttctgttcacttctggactttttggttgtgtgcctatggacagaagccggagatgtaacccatttccattatctaaaataattgcaatgcaacatcaaatcaaaataaagtgaaacagcttactacaatagagtgcaacaagctaaaacagtaggatgtaacatccctaaactccaactaaataaacccgtctccgtcttcatcaaaataaacccacctccatcttcttcatctccggtcgccggcgagtccacctccatcaccggcggcggctgttcttgctgtagcgccactacgcccaccgccggcggggatgggggagataggtgcagaggtggtttacctggcgaggccaatggagggcggcgttggagcagcaggagaggagcccatcggggtagaggaaggtgcacaagcagccgagcatgatgccaacggcgaccgccgccgcgatgcacgaccccaccaccgtcgtgtcgtgccgcccccacccctgtcggcgtggtcgctagcctcctcctccctcttcgcgtggtcgcgagaagcagtgctacggtgttgaggggagagaaagagagaagaatgatagagataaggttgatcggtggagagaaaatagtgtgatagtggttaagtgggacccactcggtggcacatctgattttttgcgccgtatcgaaattccgttgtaaagaattttcgggataatatccatgaaagtgacagagacgtaggcatgagtatatgacacttaatttgtctattcgttgcggaaactggacgagatggaagctgttggctcttcagagtacatccggataaaaatacttcctaaacatacattgttgagagttgcatgctttaatttgtagtagtacgtacgtacacgcaagttttattttaattcatagcataatgcccgtgcttcgctacgggtaaacaaaatttcatactaaggccctgtttagtgcccacgcaaaaattttacaccccgtcacatcgaacgtttgaacacctatataaagtattaaatataggttaaaaaataactaattgcacagattccaactactttgcaagatgaattttttaagcttaattgcttcatgatttgacaatatggtgatacagtaaatatttgctaatgacggattaattaggcttaataaatttgtctcgcagtttgttgacggattgtgcaattagtttttttattaatgaccgaacaccctatacgaaaccctatataatacccaatatgaaacgctaaaactttacgcccctagatctaaacatcctcttaaagtatatttcatgataaaaacaaatcacaataaaataattaataattatgtgcttatactacatttcttggtaaaacgaataacaaaataattaaatcctatgagtaacattcacaggcctcactaacgcaccaagatttttaatttccaaacaaccaagaatttttggatgaaaaaagtggcacgaacgagaccagagctacacgaacgtgacaccgtgttgtgtcgaccaccaccgtcgtcttcttctcctcctatggcatttgaaattgacaaaaatcaagaggagacacaagcggacgatggacgatggacgaaaatcaagccgagagaagttgcgcgctgcggacgacggatctctgtttttttttgtccgctgtatgtgattacgagcgcacagacacaaagggtgtagctctcggtcggattacggacgataaaattgtgacgattggaaaattactaattttttaattagttaagatttgaatacttcagagcagatgatttttgacaaaagaaaaacattatgatcaattatacgtcgccacgccagctgtcacgagtaactaacaaatgaaggtcgtactatatatgtactcacgcagattgacgctcctgggatcagtaatgcccatggtctttttctacatatgtcattttgacaatctagcaacacacaacaataatcgtcatttgatacatattccatgaatgattgatctcttttgcatttgttcgtccctttcgttttcaacttggtactcgtaatttcttttaaagaacaactacttgcaattcccaaacatggagtactacatttgtctagcttccatcaaagtatatatatatgaaacagcaaccttcaattaatttagctctcgttgatcgattgatcgatcagtttgcaggctgtgttggctgcatcaggtcagcaattaatctagctagtcatctacggctagataacccttgcagttctcgtctacacacttctctttgcgaggtacgtatgtgttctctttgtcttgttaaagttaatttcgtaaatataatatagattatttgataaaataatggaattaaattatagattttgaagaattgtgtcaagctggaacctttttttaattctcaataattttgtcatgaccttgatgctagaattcttacagcgctatggctttgcagtttcgtgacatatatgcatgttcattgctaaacctgtagattattcgtagataaatcttcttgattaaatatatatgtttacaataattttattaaactataataaatacattcctgatcaagaagcagaaactttgcagagccgttgttcatcatggcaggcgagcaaggttcagctatggccaacagaggaggccgggcaaatcggaaagaaggggaggacgagctacgaggctggctgatgttgctggcgacgctgacggcgtccatcacgtacgcggcggcgctgaaccctcccggcggcgtctggcaagccgacgacgccgccaaggacttcgtcgccggctacccggtcctcctcgacaagtcgccgtggcgctactacgtcttctactactgcaacgccacctccttcgcgtcgtccgtgtgcatcatcgtcctgctcgccaccaacttctacctgagccataccagtgtcatggtcttcaacgtgctcgtcgccctggacatggccagcttgggcgccgcgttcgtcgcgggctcgtcgagcagcaagcggtttacggctttcaacgcggggctgatggtatgcctcgtcgtgctgttcctcctgtggaaactgaagtttctcatgggtaatgatcaagcaggtcaaaatcctgctagtggaggtgtcgccaatttacaacatggcaacagtgcattataaatttataataatgtaaataaatttctctgatttaatcatgtcatggtagatgtataccggatataatgcctgctgcctggcactttgctatggaacctaatgatgaatttatacgttaaataatgttgaaatatggtatatggatatattttaaaatttaatattatggaaatgatgtcgaggatatatagcatgatgatatgattagtcagtacacgatgtgatatatttatattttgagctttagaagttcataattattattggatgatgttgcggtatatttacatattaactttaggatctaatatttactagcgggtttcaattttatacaagatatactacattaggaatgtttatcgtgtcattacaaaatatttcatttttattggctagaactagattatttaatattaaccgattggatgaaagataatattacaagatgctattgaaggaactagaaatgtaagtgccggttccaaagaagtttaatccatctcacaacatgccattttaaaaaggtaaatcctattccaatcatcctccaggtgaccaaaatttaaaaattctgtagctcatgtatcccagcaagttaggccgtctccaatggacagctcttatctagctcatagagtgttttaatcgatgaacaggaccgctagctcttcttcaagcgttagctcgcacgctcaccgaggcggtgccctctcacaggcacgctcgcccaggcaatggccggcactatgccgagcgcgtatgagctagcagccggctcataccgctggataaggccttagacaaactgagccaatgccacaagcaacagtggcgtacattcatgcacctactcctctatgggtagatctatttagagaagcttctagcatctatatattcttctacaattttcagctcccagatttttattcatgtactgagaatatatatagtttcagaatctatatttacgccaaacttttcatgtactgaatatgaagctgaaaaactaaacttttctagcttccgaatcttaagcactcttagacagtacttaagccagtgacgagcatgcgagtggtttggacggacaaacacatcgtgcccgctctgataatatacataccattgtactcggagacatattaaattttaaattggagtttttttcactcaaaaagggaaacgaatatggcatctctagtatcgggcatatatgaaaaacagtgagataaatatgtatactgcctaccaaatacgaaatattttcttttgagcataataaaattcaaaaattcaattttatggatgggaccttaagagagtcatctatgaaaataatttttaagggcagttggaaatttgcccgtgcaaaaccggtgatttctagatgcacacgcgtggtggcaggtgggtataaaaatgcccgttatcagccgcctacaaaaacgtatatttgtagtagtgtgttttgctttgttttccttaattttttctctaatttattagaaatgacacatgatggtttaaaagcgtttttagtatatttaatgaatttttaagaatataatagatatcccatgacagggacagagatgtaggctgagtataaaatgacgattatggttatatatcagattgacgctcttgggatcagtaatgtccatggtctttttctacatatatgtcattttgacgatccaataaacgcatataacaataatcgtcattttatacatattccatgattgattgatctcttcttttgttcgttcttttcattttcaactttgtactcgtaatttcttttaaccaacaacttgcaattcccaaacatggagtactgcatttgtcttccatctcaagttcgacatatatacgtacgtactaacgtacgcatgagagtatgtacgaaacatcgacctttaatttggctcgttgatcgatcgatcagtttgcaggctgtgtgtagctaagctagctagccatcgacagctagataacccttgaagttcacttctctttgggaggtttggtatgttctctttgtcttgttaaatttaattttatgaatagaaattctttgataaaatcatgaaattaaattataaattttgaagaaatgtgtcaggccagaacttttgaaattcttgattttgtcatgaaatcgatgctaaaacttttggctttcaacgctgcgctgatggtatgcctcgtcctgctgttcttgtggaaacgaaagtggctcatgatgggtcgagcagcggcgaacccaaatcctactagtggagatgtcgccaatttacaacacgacaacagtacattatagtgtaaataaatcgctgaattatatcacggttttacagatatgtatatgtatactagataatacctgcctggcgaactggtgataataggatgtaccaatgcttatttcctccatttagacactgcagaagttctgattgttggtacactttgtaccgtgtccttcccaaaatgcccttcatccactaagcttgggggaaaactgtggagtgtggacgcccctgttcctcattcatctctctacccctctcctgtcctcaaatggcttcgcccttcgggtcggagtcccgaaccccgtcgacgggctgtagcggcgacgacaaccaccaaatctggtcggtggtcctcccaacgacaggcagcagtgaagacgcggtggatctagaggctgccgttgtcgctctgcaatggcctcataaacatggtgcttggcttctatgacctgcgggattggcggctagcacagttgagctcctgagccagaaggtaggaggagcaggctggcgttttcaccatgtagcgctggcgcggcaagcaacgcggtggctgcgacggtgagggcacgcgtcgaggtggccatccgtcgtagatctcgggggaccccatcctgctagccgcactgggaaggtggcatcatcctccccgctacgctagcggcctagcgccagaacggtccagcccggactagaagcggttccagggcaagggtgcttcaactcctttggacgaaggaggcctcaggcgtgggaagtcctccaagatgcgccattcctctggcaagcgcgctcgtctctctcaggagtgtggtgtgtaggagactgaagacgatgggggcaatgttggaagcggcagaaaaagtacctaccccaacatctgcattgtgtactttttcctacagtaatatttcatttggtgggaggacgatgcatctcagtatcacacatcttagcacctattgacagtgcagattgtaggtgcaggcgaacccaagctcaaatctgtattttcctctctctctatatatatatatgtatatatatgtatgtatatttcctctctctatatatatatacagaatcattttcatatatctataactaatataaatattcatatttttccttttgtcacatctaatttcgtccgagttttgtccatacgcaatccgattaagttagcaatagcgatggaaaaaaattgcaaaaaaaaaaatggcggccgccgatgccaccaccgcccgcctccactccgtccaggccgccgcccctcccgcctcgccgagccgcagccgcctccatgccgccggatctggcggaggtgaggtccggccggccacctacacactgtccgacccaccgcctctatgtcgtccgtcaccaccaccgcggcacctcccctccccccgatctcgcggaggggaaggcgttgccggcccttcctccgctgccgcacagagagagagagggggagaagtggagacagtgagggtgggggagggcatcgcggtggggagagggccgctgccaccggatctacccatcggagggcgccaccgcggccactcgcggtggagaaggccgccgttgctgccgctagctgtgggagagggcaccgctgtggccgctcacgatgggggaggacgtcgccgtcgccgccactgctcgtgatgggggaggtagccgccaccccgcgtcggtcgcgagatcaccggccgccgctgaggatgatggggatcgcggtagggcggtagctgtcgccgtcgccgccgctgctcgcggtagggcaagtagccgccgccccgcttctgccgcgagatcgccaatcgccgccgccgctgctagcggtagaggagggcatcgccccggccgctcatgatgggggagggcaccgctgtcgccgccgctgctcgcggtagagaggtagccaccgctgtcgctgtcgctgctcacggtaggacaggtagccaccgcctcacctcggaccccagatcgccggtcgccgccgccactgccactcgcggtgggagagggaggagaatgagtttagggttagggtttcaacatggaatgttttatatatatctcgagtgatcctaaccgttcgattgaatccgacggctcttaatgcatctaagcagacttgggccacatgggccatgtgcacttaacaggccaagttgtggaagacattcggcccatccttatgggcctaattgagttttatctattctgagttgatttaaactatttctccattaacaaacttaatattttcctatgtttagtttttctttcttcatgttaaattatttatatctaaatggagtcaacaaaaaatttaattgtatatttgtcatgatatataatttaaatttggattaaaaataaataatagagtaaatttcattttggaccactttttattacccgtgttttgctttcgaccaccccttaattaacgcattcactttggatcagataatcttacctttgttgcattttggactaccctaactctcttctcaagcatatgaacaatttcgagtacgctggctccgattcatcagtgaactcccaccactttataccctacaatttatttgacatatgacaagtttgatgtagatagataaaatatttgagtgtgctccaaagtgacacaaaggtaagattttctggttcaaagtgaaaatattagttaaaggatggtccaaagcaaaacaccagtagtaaaaggtggcccaaagtaaaatttactctaaataatattaattatttcttgtatggactatagcctcttttggagaatattactctcttccaatattacttattttataattcataattttttagtccaaaatacaaaaagaaaactaaaatacacaaaaaaaaggtttgcagtacaggagttcggttagtttttctttcccttttcatccaggagtgttggtctgcccctcttttctttccgctatttttagcgctcccactaacacaattttatagatttctgtcgcacactatattgaacctaaaacaaaattcagctctcacaagtacaatgcatagaaaatcgagtataatctcacaattacattatatagattacaagaaaatataatttccggatgacgtgtattcagatgtgtcctttggtcaattccattcatttttcattaggattatgtactttcagaagcgtcatccacaacacacaaatataaagtaaattaattgtcaaaaacaaacatgatttgtttatcactctacatatagccgatgtaatatggtgttttggtaaatcattaatatcaaacttcagtcaccccgccaatacccagtgcaacgcacgggcattttgctagtgagtatatatatatatatatatattctacacccacctcccccaccctacttgggcccaaaacccccctcccacctcagtcaaagcgtcctcccgccggtcaaacccgcccaccactccttcccccacccaccactttgttgctctcgtcttacaggaatcgtgcagtaataggacggtcatcgtgcagtaacaagacaacattatcgcagtaacaacgtcaaaaagtagccatgatggatctagtttcgttaagcgtttttttatgaacttcatggtgcaaacggattggaaatacaagatatgatatgagagaaattgctctctaaagattgagatttacctcttttttagtcctcgtctcactagaacagcatattaacacgacggctaatatgcagtaacacgtctgcttttcgtagtaataacgttaaaaaatagttattatggttctagtttcgttaatcacttttttttacgaacgccatgatgcaaatgggttagaaaaataagacatgacatgtacgttagtactctctaaagattgagatttaaaatactctagatctaaaaaaacattactactatagggccactgttactatgcatgttctctgttattgcaaattttgtcatattgttactgcaaaaagtgcagtaacaacctataaagtttacagtaacaacctataaagtttacagtaacaacctataaagtttgcagtaacaacctatacatttttgcagtaacatatgatgttactacccttttgggataatattactgccgaatcatagtaacaaggtatgattgttacatgtacataactgatttgttcacaaatcatcatatggtaatttggttagaagtgctcgccatgaaccatgagatcatggattcaagtcttgaattcaccaatttatttttattttttctaaaaaagagagaagaaggagggagagaagaaaaaagaagaaaaggagagattagggggatgagagatcgagactttgggaggagggggaggagcgacgggagggagagaggaaggggcgcggcgggagggggaggagcgacgggagggagagaggaaggggcgcgggagggagggaggtgaggacggatggaaggtgggagggggtgtagaatagttataataagggatgggtgtataatagagctactttcatgtatgtagaaagtctaaaaaaataattgatattaaaaagttccattaataaaactataaataaaagctaacaaagaaaagaaatatgaaaaaaaaggaagtagaagaaaaaaaaaaagcttgattcgtatataggaggatcatgtgaaaagagaaaaagggaaaattaggaacaacataatacacgcgagtcctctaatcctcctcgcgtgtcctctaattcttctcgtctagatccatttgtgagattactagggagcgaatgttcgctcgctagcctttccaggaaagtggtgccaacctagaggctgcgcgttctaaccaaattcgtgaagccaaaaatgatggccccccaactattttggagcatttatacggtgaaaatactatcacgcggatgatcgcgcgctcgcacggcagcgaccatgtcgggtttgcttttttatggatcatatgtgattttttttttgttggtccatcatgttttcccattttggcaatatttcttgtgcgggcctgtttgatggttttttaatgggctagacgcatgtcgttctcttcgtgggttgggctcgttacagtgtaggctgaatatatggcccaatcaagtgcttgtgtttttttttatttgattcgaatattatgtataaccatttgacaaatttttctccaaaaatttgacagatgtaattacagtacaattgtagtgtaattacactataacttatatgtaattacactgtaactatagtgtaacttatatgtaactttcaaaaatctctccgtaacatgttatttcggtaaaatggaggtcgtgggaacaaattcttttcacatatgtgtgtgctatgatttgttttcttcctcaccaaaacaaatcgtgtaatagatctaacgattcaaaattatgtgaaacttacatataagttacactgtagttacatgcaagttacagtgtaattacatataagttacagtgtgattacactacaattgtactgtaattacatctgtcaaatttttggggaaaaatttgtcgacaaatgtataggtagtccctaaactttatacaatttatatgaaatacttttacatataaagttttcaaatatttctacgtataaagttttaaatgtttatgtgcataaagtttctattccaaatatttatgtgtgaatttcaataccgaatatttatatttataaatttgtatatcaaatattttatgtataaaatttgtatagtaaatatttatacatagaaagtttctatatatggaagtttttatatataaacttttttaggccaacatcgggcttctccattcgtacgtgggctaattgaaacatgtgggggcaatcagctacagtcgtttatatgacaaatcacaaagaggggaggaagaggagcaaaagtgcggccctctctcaagttgaggatggtcgccttcttccccaaccgtcgtgcccgccttcctttccaacagcccagccgttgtgcatgatgacgctctctctcgtggcctgatcttctggtgatatgataactctcgctttgatcaagtgcgacgtttgcgacgtggctaccaaccagaacaagtccaggacgccgtgcaatcgctacaccacaaatgatatcgtaccaactatgacgcgcggttgatgatccctgcaatgcaaacgagagaacattgcaagaacaagataagatgcagtctaaatattgcgaataggtgattaagcacaaaggaatagttacgattgaagtggtagatctaaccgacccggcaaatcaacacaccaactattgggggctctgaatcaatagtcgccgattaatcgagcgaggactagagacaaggtgaatggcacttggcaaaattcaactaaacaaaacccaattgtttttgaggatgtacaagttatttatagaggaaaataaagctagggttaagtgctaattcgtggaggtggagggggacagttccgagatgggcctagtctattacacggcccaaggcccaagtttggtttcagcaacatcactgccttgttttgaagattcccattgactcggaatgaatttggatatgggactggatgcgtttgaaaggtagcgagataagctttccacgaagtccaagatcacctaaatcggagttggcatgaaggcgctaggtccatttgaagttagtgctgtctccggaggccgaactggattccaaaacttattagactttaatatcttgtagatcctccattcatccgatgtattctttggcaatattttatatttctcatgcttggttgtatgcatatacttgatgatcacatcagtgctcgtcttccacctcacggtcagtggctcgcccacttccccgcctcccagccccgccctcgttcattggcctccccgcacctctgctggtttggcttccgccgattccgcctccgctggcatgccggctgcatctggggaagagggagaaggagaacgggagaacatagagaagagaaggaggaagtggggccactattttttaatcagtagtcccaggggcttcacgagtgaccagaaattctcccaaaacaagaaacctgatgatgtttgttcacacattgctaggatgttgtatttgtaatctatacaaagaaaaaataaatatcgaaaaatcttgatcaatcctggtccaatgaactgttgaaagcgctaggtggtccttgcatgcatggccgatgtggctccatcagtccatgtgcaattctccatcctgtcctgctttggccacactcctgtagaatatccaaccattggatcacttttttgtttttttatggaggttgtggcctgttggccccaaagctgacttggcagccgtgatgacaaatttcatgagcactgcatctcgatagctgacaaaatatgacttcatatatgtgtaaacatgaaatctattgtagtatatagaaatggaagtttgagatttgtccatgtcactatgagtaaaattgatatatcaatgtcgtttatggggaactggtactctaagaaccagtgttattgtggtgaccccaatgagtggaattctattctgtagtttgcagtcaaagtttatcaatcaaataagcactagcaaaacacttttgttaagtgcatgaacgaaaaatatgaatctggatcgtgactagagactcgtgagggcaaccgtgattatcccttatccgaaggaaggtgcatgattccgtttggcctaccaggggtggatatcaagctaactcggtttggctcattaatatcctacgagctaaaaactggctcggctcagcttggctcgtttgaggcctcaactttgtatttcccaccggagcctctaattttgagacggccctgggaaacactcgtagttgtggacggtgctggcggcaggtggcggcgttcgtgctcgctggggtgcagggcgctgggatgccaacaggaggcggctgcacggggcgttcgcaggcgagcggtgccgggggcaggagcgcggggatgccatcagatggcggcgctgggaatctgcggacggccgacactaggcacacgcgagcagcaaggctagtgctacacctagcgcctagagtgagtaggaggggatcagggagaggaattagggtttgatgcttggtagggccattttgggctcgtttttgttgggccttccccatgatggactgatatgtagatatgaagtgttaggtttgggtttctgagctcagctatgttggctcctttggtttgtgagcagctcacgagccggctcattatctctaataacgagctaaaacatcatctcaactcattaagaaatacaacaagccaaaccgagccaaccacgagttgagcgagttaactagttacgagcttttcgtccaccccctagacctacctactggcaatttctcactcttcaatgcatgcgtatcttctttctatccattggacaagcttttggaccttgctaacttggtttgatcgattggtaattggatctcttacagaggggatgtatccctcgttgtaaagctaatttgtcatgtatttgctatggatctctcccactcttgttctcttactaattcggatgtattagttagttactccctccatttcatattataagacactttgacttttttaagtcaaagttttccaagttcgatcgagttttcaagaaaatatagaaacatttacagcatcaaattaatttcattgaatctaacattacatatgttttgatgatatgtttattttgtattcaaaatgttgctatatatttctataaacttagtcaaacataaaaaatttaatagaaaaagttaaagcatcttataatatgacatgaagggagtgagttctttttattacatggaagacgtacacacttacaagcgcacctctttaattagacacatccttgagcaatagatgccactaaatttcacttaatcatatagccgacttcactactagttcattggtcctcactacggaaccggcatatcagcattgacgtattcagaagcctaaagagagaagcgttttccaaaacaattatcccaatttggcatttctttgaaaaagttttaagaggtggtgtttcacactatccccaacggccgaaacctaattatcctatccctaaaatagctcaactaatgtcaataagagaatgaaatttcttaattattctaaaaaaaacaaatatatgtcatatagattgtcattatatcctatatatatatgatcctacaagatttgtgtctcactaaccagttatctatagggttatggacaaaaattgacctctgttactgggctaccatgcttggtgcattttgatactacgtacctgcattttttatactgcatgtattttgatactaccacaaggccaaaaaacatactggttaatgaaatgatgtttgttcacaataggatattggaatatgttgtgtataccactggtttaaagttttgtcatatcctgtacaaagagaaggaccatggtccaggactcatggattgacagatcctgatccaatgaactgaagctctggtccttggcatgcatgtctgatgactccatcagtagtccatctgccaattcttcatctatccaaagtccaaaatgtacatagcacctggaccacccaacttgcctgttgcctccatttgatcagttaatatggttaactaatccatagttttataaagcagtttttctcttcgactaatgtacacatgtcactacaatgaaaacgattttacagacagctaaaagtgcttttcacatgtgggagagaaaatcgtctgaaacaaattaagggcctgttaaaataggtcatttccattagtgggtaaacgaccgtccgtaaagattattttcgtatgtggtattcttaaccctgccacctatagaaatcgattttcacacaggtctgttatatggtaactgattgtgtaaatgaattttttatgccaaataagcactaaaaaatatttggaatcttagaagccatctatacattgtaaaaattgatttctatacgtgaatgcccaagtcaatcgcctaaataaatgatgttacttcttaaaaggcggttgacttaattatcctctaatctgccattgaaaattgatttccagagccccccccccccctcccctcctcttcttttcctctgctatgtagcatgtctcattttcctctactatgtagtatgtgtttaattcaagcatatatattggcatggtttgcacaattgcacactgcatttaatcaaattcggtggttatctttctatagcaaagagttacagtatactgacatgcttggcttcaagcgcgctgttagtttggatatacggagtatattggatggagtgggggccctgctttggcgccaagctgacttggcagccgtgatgactgatttcaggagcactggatctagatatatactccttccgtcccataatataagggattttgagtttttacttgcactgtttgaccactcgtcttaattaaaaaaatttagaattattatttattttttttgacttactttattatctaaagtactttaagcataacttttcgttttttatatttgcataaattttttgaataagacgagtgatcaaacactacgagtaaaaactcaaaatcccttatattatgggacggagggagtagacaggctgcgaatatgcaggggaaagcagctgttgctccaatccaaatttcatcgaagaaagtgcatcattgaatcttgatttttttttgttcacctttgctcctttaatttccaactgccaaacgaaagtaataatataatgcaacttatttggagaaggggttgatattgacaatttttctttccttggtaaggaaaaactgaaacactcagtcggggatgtaatttcagccgatcgatctgtccatagtctatcttgcataacctatgcaaacacattgcgttcagcgttaggtccataatctacaaggtgtcgcagcttagccaattagctgttatctgcttcttcttcttcttcttttttttttgaaccaccctgctggcctgctgtagtgctgttgtctgtttgttgaagcatggagattgtagagggctggattaaatttggctgggcatgggtgagatgggcggctgcattgggcccatccatgaaagttagggcctcaactcataaattatataggccaactaagcaatgggatggaactactaataactactaatcccatggcagaacgtgagtatatgttaaacaacaaccaagctacacaggaaaattctcataaataaactacgatgaaataatatctttttttttagaaacaaagtacaaacgcaggtgctcacaacgtgcgcacactcaccctatgaacgcacacacgcacaccctacccctatgagcacctccggaagactggaccccctatgagcacctccggaagactgggccgacatatcttgagattgacgaagtcaccacaggcacctcgctgtcgacgggtacgtcgcctaccactgaaagaataattagccgtaaatgtgagcacccgtgtcaaatctaggatttgaacccgggtgggctggttccaccacaaggaacctaaccagttgagctatgctcacttcacgatgaaagaatatctaaaatcactctatttaaatttttttattttggctactcctaattagcacgttatgccatgcaagtgcaacagtcaaatcctatcttactataaagtcgacgtccaccaacttataaaggtccaacttataaaggtcaatatactaatatgttatatcatcacacactagtactctcatccttaaagactttaaggatttttttgtgggatgtgacatatcctagtataatgaatctggacatgcttctgtccagattcattgtattagaatgtgtcacatccaaccaaaatcccttatatttacggacgaagggcgtaattagagtatttcaagaaaaggctatatgacatactaactttttcttactaaattcttattaatactgatgtgtcacgttatgagtacatttagacttttgatgacttctaaagctcaacatgcaagtgtgtcacatcatcacacactagcaattattatctagagtattttaagaaaaggctatatcactagaacggtaaccaccatctcaatcgggtgtatcgaggagtgatcctctgtagcgggagatcgtgagaccccctttcgtgagttcggccgggggaaaaagctcgcctctagaaatcacgtatccgttcccaaggctcctagctagctcgcacaccaccaaattatacaggttcgggccgctatgaagcgtaataccctactcctgtgaatgggatttagactgagagttacaagggttcctaaactcgggagaacactcttcgttccctcctccacgagcttaggttttctaagagtcgtcctctttcttggtgggcaaggtcctccttttgtacctcaaggggataccacatgcaccgcctctacctactcttctttcgagtggggacccaccctatcttgaccggaactcgacccgtgccttcgcctggaagctaaaccacagcttgtccttgagtggggctcagcgccatccctcgcctgacacggggaacagccctgtcattccctcatttatgggtaaagacttgtggtggctgccgtccgaatgaccctccgatgggacgggtcatacctacctccactccgccggaagcagacgcgacgtgggagcacggttgtccgtccagtcagacgtgaccggtgtcaggccggtcagacgccggtcacagactggtcattcttgaccatcgcgcgtcactttagcacgccgcatgtctgccccactgcattaaatgtgacaggggcagttggggcgctgcgcgcattaaaggaggttcagcctgggccccctcctcgctcgctccccccgccaaatggcggctgggcgagggcctcggggcaaggcggtgcaagggcccgagggacatgacttggcaccccgaggccccgacccccctggccactcctgcggttcgcggaatgcgggggcaggatcaggctgtagggacacgtggtaagatgtgggaaggtagattcccctcatttcgcatacccccgggcccatatctccgacagtagcccccggcaccacatcggacattggcctcctgaggtcggtctgacgtggtgcctcactacttcccaagctggggttgtgggcccggcagggaatctaagcggatgccgccgagtggccaggttggcatatcaaccacaacagcggtttgaccgccacttaccgcgctgatgatgaggatgcttaaggcgcgaaaatcagggggtcggttagaccacacctcgactccctcgcacgccacgcatgcggaggtactggtgacggttcacccagattgtgcccgtgaccgtcgcacgcccaacgccgagtgtgccgctgacaggcgcgctaaatgcggggcgcggattccgtgggcgacgtgatgagtagttgcaggaaacgatgaggcaactgcaggcgcgagaattgtgggcgcaaccgtgagggcgtgaaacaaggaggcgagcgcgggcgaggcagggataaaaggatacggaggcggggactttgcctccttcctttcgccaactgctcacccgcacactcgctccctaagcccaaacattctcgccactccatgctactccgcacaccaagcccctcgtcgcttctccgccggtcatcatggctcaagatgctggcgacgcagtgcttccggcatcgcgcattacggtggataggcaccttagtctcccccgcaagatcatgccagaaggcgccgccgtgagggcgggggagtcgcggccgcggccacggtacctggagcgatccgtgcacctcctatcctttgctatggcgggattgatcccgccattcttcggattcttccacgaggttttggatttctacgaaatccatgccttgcatctcgcacccaacgtcgtgatgacgctggccatcttcgcgcatttatgcgagatgttcatcggggtgcggccgacgatgcggctgttccagtctttcttcgtcccgtagttgctgcaaggtgcggtggtggggagatgttacttccagccccggccaggcacggcggggcaatacatcgagagtcatctccgcaagaaattggaggactggaagaaggactggttctacaccgcactgccggaccactcgtgacttcggctccccgccggccctcccgaatgatccgccgcatggctggcggtttcggagctgggcgaggagtacgacacagtgcgggatcgccttaggggcctgcgaagcctgggcctcacgggggtaatggtctttggcgactacttccgccgccgcatcgcgcctctccaagatcgatcccgtggcgcgtgggagtacactagacccaacgaccccatgcgcacgcatgtgggcgagcgctgggattgaggcgaggaggatgcaaagatggtgattcggcgggtgctaggtctggacaccgttgagcaaacactgattccagacgggatccttcccctctgcagtgaccgcgaccgggagagtatcttggctgtgatgtcggccatcggcgccggcaggggtcggtcccgccggggcggcaccggtagtggcgctgtcggcgtgggtagcggcggcgcgaccgtaggcgggagtcggaccggcggccccggcgggggtggcagctctagggcacctggcccgagccgcggacccagggtcgactcggccagcgacccaaaagggaaacggaagatgtccgaatctcgaccgccctctcccccgcgcggagggggcgccgagcgcgtggcggaccgaccgccggcgggccacaagcgccccgccacgcctgaggttggacggaagaagaagcggctccggaagataggtcaaacagagccgtgtcgggggagcttcgttgaacccccgaagtggactttcaaccgccctccccacaggtacgactgccggcacccgcttcggtgctttttactcatctcggtcccttgttccttcctcttctttttctttgttaacgcgatcagggttcttctgtagcgagattccttcccatgggatctcggggtccgaccctttgcagggggcaaagtccgaacgaccgaagcggcccgggctttgccgatccagggccgcggggccttcacagcctcccggtggggcccacgggccgcacaccgggtccgaccctgggttcaccacagccgagactcgacccgccgcgagcgatagcggcggcgtctctcccgggggcgactccgaggcccggatccatgcagagcgccacccgggagcggggggcgagggaggtcgcggcccgaaagccgaggctggaggcggccctgagcccgaggccgaggccgaaactaggggtgggcctgagctcgaggccgaggccgaatctacccgagggcccgaagcggggagcgagaggagtagccgctcctccttgcacttggggcgccctcagggctggccgcgtagaaggcgagctgagagcggcccccagtctcgcaggggatccagcagcactccaccgtccgggaggggctcaacgcccaagttcaagccctggcggaagagcgagcggccctggaggcagagtgggcacagctccctgcggaccgcgcgcgggttgacgaggggcgccgcgccgtggactacatggtgaaggtgggacgcaaaatgcgccaagcccaactggctaaaatctaggcgtgcgaggagacgctggactccgtcatgcgggagacggaggaagagcggcaggcagcactgattgcctcaagcgtcctagatgaagcgctgggcgacatccgcttacagtacgaggtccatgccgaggacttgacgaagagggttaaggacgcccgtggtgtcctcgatgcggctgccgcccaagagcagcgcgagtccaccttggctgcccacgagagaatggcggcggaggcggagccctcccttcgccttcgtgaggaggccgcagccaagcgtgaccggaccactctcaccgcgaaagcttcggtggcccgtcacgcggaggagctacggctccgagaagaggcgtgccgggaacgggacgccgcactcgccgagcgcgaagccgaggtgaaccgccgtgaggtggcctcgtgccggctaggcgagcaactcgcgaaacgcgaggaggccgtcgctgggcgcgaggctcagcatctggagagtgctcgcgccgtgcacgcggcgatggcggcgagggcttctgagctggaggctcgggagaaggacctggcggcgggcgggcagcccggcggcgcggagttggtgagccagcttaccgcggctcatagcactcttgccgacctagagcgcctggtgcaagaccaggctagggagatcgcggccctccgccttaccaacgagatcggacccgggcagctctccaatgccgtcgatcggctggagcgcgcggggcgccgagtcagcatctccgtgcgtcgggatagtaagctcccgcccacacagccggcactcgtgctccggctggacgggctggtggcggatctggagaggctggaggaggaggtcggcgagaccatgaaatcgtcgtcggcttccttggcgcgggccgcggtggaactggtcctcgcgagccaccaagcccgcaacccggacttcgtcccatggcccggactcgaggatttccccccggggacctaggcaaaggctcgggagcaagtccgggaggcggccgacgcgatcgtctctaacttcgaggggtcggcccctcggttcaccttcgggcttgcctcggacgaggagagcgggagcggagatgatggtgacgacatcggcggcgaggactaggacgacgttgttagcggcgtcggccttgggggcctgggcactccgtgattatccccacttttaacttccttttgctgtgtgcctatagcggacacttcttgtctttaggccatcgtgccgtcttgtctgtaaatgaagcttccccttcgcactttctactccttcgctttctgcattaaatcctgcggcacagaaagaagaaaaaacaagagcaaaagtatacaattaacctccctgtgatcgaaatgtcgtttttaccccatccccnccaccccccccccccccccccgtcgggctcgttcttgcgaaaaggtaaatccgcactcggtccgtagtacctaagtggtgaggggcaagaccgtcgccccgagggagccgcccagcggcactggccagaccaaggctacgacgaccgggggtcggggacggccgtgtgtaggcccttccgagcccccggggttcggcacaacccggggcgcggcccgcgtttaggctccctttcggtggttttcaggtcacccaacgccacttagggttcggagtaagcacgaattgtcctttgaaccaggacaagccagaggaaagagtgagaaaaagggcgcgtaatggcctccactttaggtggaaaacatttattgcttggaaagggaaaaggatacaaagtaattgaaagtggtagcccccggccaagcccgcacaagccgaggagttgtgcgggggttggcccgagctcctggaaagcaaaaatcgcgacgctatggatagaagcgacggaggtgttcgatattctaggggttaggcaactcggtgccgtcctccgtggttagtcgaacagagcctagccggggaactgtgatcactttgtatggcccttcccacattggcgagagcttgcttagccccagacgcgactgcacgcggcgtaggacgaggtcgccaacttgcagtgaccgagcccggacgtggcgctgatggtggcgccgcaggctttgttggtagcgcgccgcacgtagggccgtgtgccttctccgctcttcaagatagtcgaggtcgtcgcggcgaagataatcctggttggcctcatcgtacagcgcgacgcgaggcgatcctagggaaagctccgaaggtaggaccgcctcggcgccgtacaccaggaaaaagggcgtttcccccgtggcgcgacttggagtggtccgattttcccacaacacggcgggcaactcctcgagccacgaatccccgtgtttcttcagggcggtgtacgtcttggtcttgaggcctttgaggatttcggcgttgcctcgctcgacttggctgttgctcttggggtgggcgggcgaggcaaagcacaatttgatgcccatgtcgtcataatagtcaccgaacagctcactagtgaactgggtgccgttatctgtaatgatacggttgggcactccgaatcgggacgtgatgcccctgatgaacttgagggcggaatgcttgtcgatcttgacgaccgggtatgcttcgggccacttggtcaacttgtcgatggcgacatacaggtgttgatacccgcctcgagccgctttcaatggtccgaggatgtctagcccctagaccgcgaaaggccaagagagtgggatgacctgcaaggcttgggccggctggtgggtttgcttggcgtggaactcgcacgccttgcaccgccggacccattcttgggcatcctgcagcgtagtcggccagtaaaaaccttgtcgaaaggctttaccaaccaaagtgcgtgaggccgaatgggccccgcactcaccctgatgggtgtcggctatgagctcgatgccttgctcccgagaaacacacttcaagagtatcccgttggcagcacaccggtagaggatcccttctacgagcacgtaccgtttggagatgcgcgcgagcttctcagcttctacgcgatcctcaggaagagtatttttgtcaagatacgcccggatgtccgtcatccaaacgacctgacgaggggggccagggtcgaccccctcgggccccgaggcacgcgggtcaccaagggtcggcgcagaaggcgtggtctcggggtccctcggggggttcggtcgcgccgacggctgcgcgagtctttcctcgaaggaccccgaggggagtggggctcgcgccgacgcgacacacgacaactcatcagcgattgtgttgtcgcgtcggggcacgtgccggagctcgagtccgttgaagtgacattccatgcgccgtacttagcggacatatgtgtccatttgtgcgtcggtgcagtggtattctttggatacttgattcacgaccagctgggagtcgcctaggaccaggagacggcggatgcccattccggccgctgccctcaaccccgcgaggagtccttcgtattccgccatgttgttcgtggctcggaagtcgagccgaacgacgtatttgaggatgtccccgcttggcgaagtcagcgtgactccggcacctgcaccttgaaggttgagggagccatcgaaatgcataacccagtgcccgccacgaatgtcggcgtttgggtcctctccatctccggggagggaaggaacgttggatagaacaaggtcgtcaactggggtccactccgcgacgaagtcagccaggacctggcttttgatcgtgtgctgtggttcgaagtgcaggtcaaactcagcaagctcgatggcccactttacaacccgaccagtaccctctcggttgtgcaagatttggtcgagagggtaggatgtcactacggacacccgatgcgcttggaaatagtggcacaatttccttgaggccattaagattgcataaagcatcttctgggcctgtgggtatcgggtcttcgcgtcacctttcggtggggccggtccgtgctgtcaggggcagatgatctggggcacccttgctcaggggcaccggtcattcttgaccatcgcgcgtcactttagcacgccgcacgtctgttccactgcattaaatgcgacagggggtagttggggtgctgcgtgcattaaaggaggttcagcgtgggctccctcctcgctcgctccaaccgccaaatggcggctgggcgagggcctcggggcaaggcggtgcaagggcccgaggggcatgacgtggcaccctgaggccccgacccccccggccgctcctgcggttcgcggaatgcgggggcaggaccaggctgtaaggacacgtggcaggatgggaaggtagattccccttattttgtatacccccaggcccatatctccgacagggtggcaacccccatctcaatcgggcacggtgtccgtcacagcctataagtcacagatgtgaaaaattatctcaatcgggcaaacggctgtcatcgatagctttgacccagacgaatagtcaaactatagcccgtcacggatgacctatctcaatcgagccacaactagcgcccgtcacagatgactactcatctcaattgggcattcactatagcccatcacagatgaccctcatctcaatcgggtgttggtatttcttaacaacattactagaaatataattcccagcaatggcgcaaaaatacttctggtatattatggttatagagttcatctgcaagtgcacgaatataccattgtagcatttcacccgagagtattccaagggtatcgtatttattttatcccgtgggaagatcatgtagagagaacttgactaataatttatatattacttgtaataatcatattctaaacaggggttaagataatccaagggtagagtgacacacaagcattagcttctcattctcaatatatattatctaagctaagtggaaagaaaagagaaagaaaatctattctacttctaatacacataatatacatatattctagttaactgatatactagctaataccctctctccaatgccctcctggtacttcgagaagccacccctgactgccgagttccttacgacatcccgtcatgaccatacaaccggggctaaatacggaggaataccctccccagggaattaacttaggattatatacaggcgcgaaggaatacccgtactgagctgtcaccatcagcggcccacctcttatccgcagcatataaccccaaataatgatatcccgtaatctagacaccacgtctaaactaccagatactactctaatatcatcgtcatgacatacagtaattgcataagcaaacattatacccgcaccaaagcatctcccagataagctagccgtatattcagtataacatgaacataatgtaaagatggcattcatattctcggaaagtatttcaataccataaatgtatatagaagggtattctaagaaaagtacaaagcttacaaaagaggaaaggaaagctactagagccatacccgaactcttccgaagacttccgaactcctgatttctactctattcctattccaccagctagatactactaaactaaacatgagagaaatgagagagctcttgcttgaggtgtgtgagtgaagtgaggatgagagctccttttatagcctcccaatgacggttgtgacggttggaatggtcggtaataccctccaacagtcattggggagccatctcagccgtccagaagaaccctggatcaaatggagctgcggggggttcggccgaaccatgggctgggccgacctggcccaatttcggcaggctgcctcctcttttgctctcatacgcagacttgtgcattttggcccaattcatcgtgtcaattctgagttcttggcccattcatacataagtctgattgccgacatcgttcgattgatttatcgtttgagttgatgtcgattctcctccactttatggttattctctgcaaaaggttagtatacctaatattagtggaatattattattctaacacatttatgcattgcaagcatcactagttctcctctattttggtaatattgacggtcgaaactaatcgataacgaccgtcacaaatgaccctcatctcaatcagacagtaagttaatggccgtcacagatgagtataatccaaaaataaataaattttattttttggctagcatcatgtaatgttccacctctctcaggctagaccagtcttttctgcacactttgtcttcactcatgtacactttgtcttaactcgtgcgcacctaggtcacccatcccgaaattgcttcaggccaagcacgcttaaccgaaattgcttcaggccaagcacgcttaacctcatagttctttggagatcggctttcggagaagaagttgtaacttgttagtatgagtattctattaatcctattaagccctgggccaggatgtcacaccttagcatccctcattcatatacattcattcacatacacaaccatcaacatatttaacaaaaccacattcacataacatccattttgatcacatatttcacattcattcacatatttcacatatttcaccagcaaaaccggggttaattcgatcaaatatatatttagcaagtattatcataaaagaggaggcaaatcagactttaggaaaaaatgaatttctaattaaattttatgatactaaatgaactcataagaaaaatctatcaaaaacaaagtagtagaactcattgagatataccaattttattttggtcatttctccatccgggtttgattgaagtatataaaatttaaattttaaaatataagaaatacaaataaattttcgggtagtaaataatttcaaacgaaaaggttatcaacaacaaagttatataactcatcaagatctataacttttattttgctcatttttctatataacatatttgaacagtttgaatttgaatttgaaaatatgacaacttcaaacaacattttcaaatactaaataatttcaactaaaaaagtcatcaacaaaaaagttgtataactaatcaagatctataacttttattttggtcgtttttctatataacttttttttaacagattgaatttgaatttgaaaatttgataacttcaaacaacattttcaaatactaaatgatttcaactaaaaaagtcatcaacaaaaaagttgtcaaactcatcaagatctataatttttatttttggcatttcttcatcagacaaagtgatagtaacattgttcacaaaattcacatatctctcatctggtttataaactataacagagatatgtaattttttttgaacaatgttactagcactttgtcagatgaacaaatggaaaaaataaaagttatagatcttgatgagttatacaactttgttgttgatgaattttttaattgaaatcatttagtatttgaaaatgttgtttgaagtgtcatattttcaaatttaaattcaaactgttcaaaaaatgttatatagaaaaatgaccaaaataaaagttatagatcttaatgagttatacaactttattgttgatgacttttttagttgaaatcatttagtatttgaaaatgttgttttgaacttgttatattttcaaattcaaattcaaactgttcaaaaagagttatatagaaaaatgaccaaaataaaagttgtaaatcttgataagttatacaagtttgttcttgacaatttttccatttgaaatcatttactactcgaaaaattattttgactaataaaatgaattattatactacagttaactattttgctacaggtcaactcacaaatataaacatttcatatgaaaaatggaaaaaaaactaagtcatctcaatcgggcattagtgtagttaacggatgagtcatctgtgacggacctagttattaccgattgatatatggtcgcacagacatgttagataggcataaaactcaggcccatcacagataacacctatcaatgacgggccatagtttaggaatgagtcatctgtgacgggcctagttattaccgattgatatatggaatattatctcaatcgggcctaaactacggcctgtcactgataggtgtcatccgtgacaggcctgaattttatgcccatctaacatgtttgtgcgaccatatcttaatcgggcactttttcagcctgattgagatgacttcctagtgacggcccgctaattccaggcatattagaggccgtcacagatggaaggttctgtactaatgtatgtactaactttttcttactaaattcttactaacactgatgtgtcatgctacgagtgcaactagattttttataacttctatctacctacctaaatcaaacaattgagatgattgttagtaaaagtttagtaagaaaaatttagtacatgtagcagtgctcggtattttaaatcacatgcatgtgtatcacatcatcatccactagaaattattatataaagtactttaaatatcatgcaaacatgacatatcatttagagtgcaactagattttttataatttctatctacctacctaaatcaaacaattgagatgattgttagtaaaagtttagtaagaaaaatttagtacatgtagcagtgctcggtattttaaatcacatgcatgtttatcacatcatcatccactaaaaattattatctaaagtactttaaatatcatgcaaacatgacatatcatttacaattttgttgtatttttagacctcaatatgcaagcaatgtcaaaacattatctccatatcattttcacattatttaaacatatacatctaccatttctacgatgtataacatgtatgcatctacatatgccgcaacaagcatggggtatgaactagttagataacaaggtatgtaagatctttatgataacttggcaaggaacatatcctatacacatgagcttttcgtataaacaccgtacaagctaactaacaatttttaccaaaaaatgtaaaaaaacgtacgtatattttcaatagtattacatcagaccaatgcatcaggccagattttcttttattcgtgcaacccatatataggtgtcgattcctaaaccagcaccttcgatggcatatcatcggtatcgcttgtgaggtgccagttagggaatctagcacctaagtagggtttccaaccgacacccattacgttttctgtagtagtgtcagtgctacgtttaatccaaccggcattgataggttatttgtggtagtgtgaggtcattcaataactacaacattacatttaattatattacatagcatgaaagtaaatgtaattcattatggtggtaaaaaggatccaaccttttagtctcgccccggccccttaatatcccaaagaatatcaatattaggaacaaccaatcactactacaaacccagaaagctgtggcgccggcgccggcgtaattggtgacgccctaggaggacaacgtgttgtgccttaaggaggtgaaggctgagctccgagacccggacaggctgctctcaatgagatcctgagcagcaagagatgaagaggtgacgcgacgccccaagcgcggcctcgccctccctggccgtggggtaggaccagttcgacgtgtcatcattgcttgatctcggccgccccttctcccctcatccactctacttaggggcggctggatctgctgatgcatgctcgtgggaggccggatccgcgaccacgagcacggggctggctggctcgatgacaataccagcggcggtggtgggtcaagcggcagcagtgagatgattgattttggtatctttatgttctcctctatttgttcttggatgttgattttgtattttagtgctaattctttgattgtgttgttggatagagagtcaggggtgatcgagagtgatgcgattacaacttgacccctatttgaggtcaccatcgtccaaagagacaagaacctatgtcgctgcaatgttcttctctttgtttgttcttcaatgttgatagatttcatcattatgaggggatctcaggggtggttcgtggatggggatcagtagctcgatgcatcgaacacctctagtattttttttattcctagaatctgttataggtgccagttatggggtaagaaccaacacctatttataggtgtcggttctaatactggcagctatgccaatgggcataggtgtccctaaattggtacccagcatctatatgtggttcccaaccattacatatagggtgctctgtagtagtgaaaatgcaagaattagaggggccagccatcatctccatcccaaaatcattaaagaagaacatggaattttgcaattttcatctttggtctttgtccaactaacaagcgaaagtaaaataacatgaattatttcataaagatgggttgacatcgatgtttcggttatttctttactggaaagacgaaacaactgaaacccccttagtcaaggaatcttttcattttgatgcttttagaaaatttatgtcacaaacaaattctaaaaataaacatttagttagctcaatgcatgtggattttgttttgtgtgtatagcacttaggccttgccatgcatgctgatcacctctcggttcaaataatttgcattatcatcatatcttgaaggaagccccagtagtaatcacataggagaagaaaaggagacataatctttaatttagatagtttttgctaattccaaatcattgacttcataactatatgcatgtctgagctggtttggaaaacactagagatcttcatgcgtgagatatatatatatatatatatatatatatatgtatgtgtgtacacacatacatgcacacatacatgtaagtgtgtacacatacatggatgtgaggcacacacatacacatatatacacatacatgtatgtgtttccagatataagtatatgtagtgccgtgttcttgcagtctaattttacatttttagaaaaagaatgcatggtaaaccaccttgaacagcttttcttccacatgcattacccttagtctcagccgaccaattttgacaggtcttcagtactttaacgcatgacttgtctgaattttcagactgcttgtataatgcagtccatgcacgcgaaaaggatatgcataagttcatgcaatattaagtgcttctatatattctatatgccaactttatgtgatgatttcatgttttatatatatatatatatatatatatatatatatatatatatatatatatatatatatctccagtgacgtagtacgtccttgactgaaagagaggacgcaattaatcgatcgatcgataatattctacagagaagacgttttcacgaagaggtacatggactgaacatgtcgttttcaagtgtgggatgagctgattgatttgtctattaattctatttaattagtatatacgtggtatgcacgataacgtactctagtgaatgattgtctctatatatcaagatcatatcgaacaattccgtgagacaccgtaaaaatcatgctagaaactactccctccgttctaaaatataagtatttttagctataaatctggacaaatagttaaaagatgttacattttgggatagaggtagtatatatataactatatatctagaacatggcactggagagatatttatttacctaattaaaaataattttcacaggcgatatccgaactagtaggctttctgaaatggcattgcctgtgtataatagagggtgttatgaaccgtctatgaaggtcatcactaatcgtagatgggaataatattagaattactagtacaagtgatcgggtataggatgtccgatagtcccacgcgaaaatagttttcataggaaatgaatatgtgtctatgaaatctgcatataggtatttagttcgaggcagctatagtatccgcatgaaacaaccatatttagccgctgaaaaaaatcttgttttacggtgagacataaatacaggagaaagttgatacatgaccgtagttttgaaaagtactgctagcagtgagtgttttttcaaacgttcaaaggacccaagcaacctttttcttctgcggttgtacaaatcgagtacacaacggtgaatttgaagaatgtgacgtttcaaccaactcccctagctgatactccctctgtcccaaaatatttaacgccgttggctttttcaaacatatttgacaattcgttttatttaaaaaaattaagtaattgttaattatttttctttcatttaattcattgttaaatatactactactactcaagtttttaaataatattcgcaaaactttttgaataacacgaacggtcaaatatgttttagaaaagtcaacggcgtcaaatatttagggacggagggagtacttccgtcctctgtttaaatataaatacaattgtaactaaaaaaacaaattatacgaaaagttagatctagatgtcctcgttaaatgaggggtgattgagagtgaaaacgtagttagggcaagattgaaagagatttggatgagggtgattaatttagagtatgggataaaattttgattctaaaattgcacgcacttatttattttgagatggagggattatttatcccttaggtttctgatgttgagcataagtattgaactactccctccatttaatattataaatcacttcgaatttttttaagtcaaactatttagaagtttaaccaagtgtagagaaatatagcaacacttatagaacaaaattagttttattagatctgatagtgaacacattttgatagttctttttaaaaaatatatattgctatatttttctagcaaataagtccattatacaccccttaactactcacgttgtctaaaattcaccccttaactttaaaaccgagcatctaacacccccctactatcaaaaccgtttaatttacactcctagaccaaatcagggtggttttcctacttgcgtggcatcaacatatcaatacgggttagtaaaatttttaaaaagaataatggacatacatgtcattgaaatttcctcttctcacaccttctttcctcccccttcttgagattttctcgatacgcctctgccgacgggttcgctccatcacccgtgtcgacgaggcaacgatcacctcagcctcccagccggtaaggttgacctctatctccccaagtgcctccttctccatgcgccggcgagctagaccttcagcttcccatcatatacatgtcttcccaagcgtctccctgactccacgcgccagcgaggtcgaactctggctccaagctacatcttggagtgcctccttctccagggattggtgagctcaagctctcctcccctcgaacccccatcgtctcccgattgccgcaagcttgagctcacgctgtggctcccagctgcgcccccaagtgcctcctccactccatgtgctagcgtggtcgagctcgagctctgcctccttgccgcccggagcacatgctccatgctcaagctggtacgcaagctctagctttgcctacgccttctccccgatttgccggcgagctaaggagcggtccacctccccttttcttcaccaagtgtttcctccatgcgccagcaaggtcaagttccactttccctatcgcccctcgagctcgagcttgcagatcccactcaagagaacttcgatgctggcgcttgtctcaggtgagtcgagatagggaactagggggagaggatagatcagagagaggagaagaatgcctcctgactgatagttgggccctgtgttttcctttttatatttttttactaaattgccatgtcaattgccacataggcgaaaaatcgcctcatattgacttaggggtgtaaccgtgcaagtttaacacttttgatacactactagaaaaacaatttttcatggcgtttggaaaatatttttcatggcggctaagtgaaaaaactgccagcgtagaaaattgcaagggtgggggtcacgggccgccagcggaaacacatcttcgctaacggtcgccttaagctagccgccagcgaaatgtctttgctagcagcccacttaacttgacgccaacgaagataccatatcttcgctagtggtaaggtgatgtggcccacaagcgaagaccacctacatcttcgctggcggccctcttaagctgccgccacctctaattattttctatggcggttcaaactaatcgacatatgttgaccaccaggaaaaatgtaggtacctatatcagccagctacagtactttcaggcaccattaggagcacgattttctctctcttaagaacacgttcatagaggggaaggttttgattatcagccaactacagtactttcaggcaccattaggagcacgattttctctctcttaagaacacgttcatagaggggaaggttttgatcatgaatttttgaaagatatattgcaccagaggttagtatactttctcctactctatttgtcttttttttcatttttattggttgttcgttgacattttgcatggcaaaaagtatgtaacatggaggaacaaaagtatattttatttgctatttggagcttgaaatggacaaaattgtaaagaatattgtgcatgatcgatgttccacatatatatatatatatatatatatatatatatatatatatatatatatatatatatatatatatatatatatatatatatatatatatagttttgatagatttatttgtaggagatctaaactgcagacaatgatgaagaagagaaagaggggtagtttggtaaattttctagttgtatgtagctagtttccatcttattatatatgtagatatttggctagctttaattatgttgtctagattatactggttatatacattaattagtaggattttaaattgacatattgttcaaaatatttaaactaactaagttgtattattttttccgcaattaattaattaatgcatagatagcggacacagcatagatgtataaagagagatcgtgcgtcatacatcgaaggagtcgacatattcatgaaagcagctaagaagagtgctgcatctaagaaaacaaaagaaattatatgtccatgcgcgcactgcaaaaattagaaaatttggatcgatccatctgtaatcgagcagcacttggtgacgcatggatttgttgaatgctacacaaattggtcacatcatggagaccccaagcaaacaagttcccaactaggcgacactacgtgatgtagtgttcagctgggacaaggatttcatggtagtagctgaagaagaagaagtgcatgcagtagaacccgttgatgatgatgatattgttggcgacaatagtcagcacaatacagttgatgatgccggtgatggtaatgtgagcgtagatgatggtaattttgcagatttggaagagatgttgcgtcatgctgaatgtgaggttgtagctgggtccgctcgtgggttgtataacttcgatgcattgaaaaaggcagcgaaggatcttttgtacgatgaggcaaagggttgcgagaaggatttcacattgttgcggatggtgcttgagcttatgagattgaagaccagaaacagttggtccgatattagtttcaacgatttgttggttctgttgaagaaactttttccgcaacccaactccttgccaaccagcacctatgaagcgaagaagcttatttgctcgttgtcactgggtgtgtgaaagatacacgcgtgtgttaaccactgtatcatgttccgtagagagtacgaggatttggacagatgcccaacatgcaagagtagtcgatacaaaacaagccatagcccgtctgagtgtccgaatgttgcccttaacgatgtagaagagtccactccatgcaaagacaacaaaaaaaaagaagattccgcagctggtcatgtggtacctttcggtgaaagatcgattgaagcgtttgttctcgaacccgagggatgccgaactgatgcactggcattatgaaaagcggaaaaaggatgggatgattcgacatcctgcagatgctcgatagtggaaggaatttgacacaaagtaccataagtttgcagaggacccaagaaatgtaaggtttgcattgagcaccgatggaatgaatccattcagtgacttgagcagctcacacagcatgtggctagtactcctaaccatgtacaacctccctacgtggctgtgtcagaaaaggaagtatattttgttggccatcctcttacagggaccacgacaacctggcaatgacatggatgtgtttctggagcctttgttggaggatatgcatgatttgtggaaacatgggatccgagtttgggatgaattcctacaggagtacttcacactatatgcagttatctttgtcaccgtcaacgacttgcccgcactgttttccctatcaggacagatcaatgaggaagacgggccgcgttatttgtgtggatggtaccgtgcacaggtatcttaagggatcgaagaagctagtgtacatgcgacaccggcgtttcttaagaaagaatcactcgtaccactccaaagcagaatatttcgacagcactgttgaggatggtgatgcaccagaaccatggaagggtgataaagtgtcaaaatgacaaaaaaaacgtcaaggttgtttttgggaaggcaaaaaagaaggaaaccaacaagcggaagagaaatgatgccgaagtgccaacaagccatagcgggacattcaagaagcactccattttctctaattaccttccgtactggagagatttagaggtacgtcattctgttgatttcatgcacctggagaaaaatgtcttcgatagcaccattaggattatactagacataccaactacgacaaaggatgggctaaaatcacgtaaggacctcgtgaatatgtagataagggaagagcttcatcctgtggatgaaggcaataatggaaaagtgtagcttctgcctgcttgctacaccttgacaaatgaggagaaaaaggcaatgtgcaaatgcctacgtggggtgagagtgcctactggcttctcctcaaacattaaacgactcgcgtcgatgaaggatctgtcgctttcaggctacaattctcatgactgtcatgtaatgctcacagtattcctcgccattgcaattagagcaatcgaaccagtacacgtaaagatggtcatcacaaagctgtgttatttcttcaatgccatatcacagaaagtaattgatcctgaagagttaggtcctctccgggctttcgctatagagacagtgtgcgagcttgagatgtgttttcctccatcatttttcgatatgatgcaacacctcatagtttatattgtgcctcagataattgcacttgggcccctgtgcctgcatcagatgtggccattcgaacgatacatgtccattctaaaaggctacgtacggaaccgcgcccacccagagggatcgatgatagagggatacacaaccgaggaggttgttgagtgttgcattgattacctaaaagatgggaaagcaattggtttacaggtacctcgatatgaaggtagattatgtagagaaggaacaaaagggaaaaaaagaatccgtgataatgactacaaaaaagtgaaagatgctcatttcactgtgttgcagcaacttgcgatagtggagccgtacataaagcagcacctgcatgaactacaagcaacaaatgtggggcgctctaatgcatagatcatgaaaaaacacaaacatcactttaccgaatggttcaaggacctcggtctaccagatggtgataccacggaagaaagaacaattaaaatgttagctgatgggccatcaagtgtgtacacctcgtggcaagcatatgatctgaatggatacacgctttataccaaagcaaaagaccaaaggagtgcatgccaaaaataatatataatgttgtttttaatttttttaaaaaaaatacatcttcacaggcgggccacgtgtcagaagtcggacggtccctatcttcactatcaggccacgtgtctatccccagaagcctttgggcatttttcctagcgggccacgtagcctaaaatactataagctgccagcgaagaaatatcttcgctggcgaccgtccaagcagagatatttctttactagcagctggcttatattcgctgccagcgaagatatttcttcgctggcggctgccttaatactacccaagtgaagatatgtctttgctggcgggtgtggcttagtcggctgccagcaaagacatatcttagctagcggtatataaccgctagtgaagatctacatttttactggcctttgctttgtgacggctgtgatttacgccagcgaaaatccaaaatggccaccacgaaagatggtttccatagtagtgatagttgagggtagtgaaagtccggttttagagttatcggtaaatttcagacaacaagaagagttaggaggtataaaatgaactttatctcatttttctattaatttgatcaaacctaaaaaattttgacttaggaaaaaaatcaaaatgacttataatatgaaacgaatgtagtagctgttttgttaaggcttggttttaaacagttaatacagcttagctacttctcgttttcaattaccacattttttaatggctaagtgagatgtttcgtaaaaaaaattatgtgtagaagatgctttaaaaaatcaaataaatctaacttttaaattttactaactaattatcaaaaaccataccttaatcgtgttcctcgttttatatatagcaactcagtgaaaacctatgggtcgaaaagaacgtcactagtacagatcctctcatctgtgatggcccatcacatgcctgggcaacgtgggccgtcagaacgaagtcatctcaatcgggcctaaatttttgccattgtagatgtactcgtcggggtgcatattcctaaggccgtcaccgatgacattcatctgtggcgggctcaaagttaggcccgattgagatgacctccactatctcaatcgggcccaaatactgagcccgtcacagatgagtgtcatcggtgacgggctccaaagaaggcccgattgagatggccttaatgcccgttcaccgatgactcttattggtgtcgggcttctatttgtgcccgttagagattagtgtgcgcccgttagagatgacattttttggcccaattgagatatactttgcacactatatatactccaggagtccgttgtctgtagttatcccactgttcactattttggtgggaggttgaagagggcgaatttttgtaatttttttacaaacaaaaacatgaagatcataaaaataagtaaaagggtactaatcatttcctattaatttagtagtacttatgttatgagatgttaactaatattttgttcattgttcagcgatgaattgaagttggatgtacacgactggcttgaggcgtcagtacaaggagtatagagatgacgtattaagttttatgaaagccgcagaggaggataggataagaagaaacaacaagtacatgtgttgtccatgtagcgattacaggaatgagattttgttggaagatgaaaaggaagtacacgctcacttgatacaccaccggggattattcatggagagatacacatgttgggtgaagcatggagagcaagatctgggtactgatggtgcagctgcagacggaagtggtaaagacaatcatgaagaaggagatgaagaagagcataacatgtttgtcccatctccattgggtggtgaaatggttgatgtggaccctgatatgctgcaagacatgttacatgacgttgatgacccaactatgaacgagagagattccatgaagttaagcaggttggtcagtgactcggagactcctctatacgcaggatgcaagccaaagcacaccaaattatcagcaacattagacctaatgaagttgaaggctagtagtggatggtcagacaagagttttacagaacttttgggaatactgaaggacatgcttcctcaggaaaacacattgcccgagacgacatatgaagcaaaacagattctgtgtcccctagggttagaggtccggagaattcacgcatatccaaacgattgcatattgtaccacaagcaatacgcggacttagtgcttgtcctgtctgcaaggcttctcgatacaagcaaaagaacagtgcaggggagggaaagaagtcaaagcggggtggtccgatgaaggttgcgtgttatttatcaatcattgatcgtttcaagagaatatttgtcaaccctaatgaagcaaagttagtacgttggcatgccacagagagaaagaatgacggtttgctaagacaccccgcagatttgatttaatggaggaatatcgatcgaaagcataaagactttgttaccgaccccagaaacatgaggatacgtatgtgctcctaagagcatgtttaatagcagagctcactgctagttataatagttataaattcattctagacctaacattatgtgtaataggttagctttaattttccctcatctctttttctcacactataaatttaatatatatatatatatatatatatatcttgcagcatgtgtagagttagttctttcatgagagctaaaaactcctaatttttctttattttttcttttatgtaaacctatagcttgtatatactgtagctcactgttatccttcctcgatcgcgtcagtcaggtttgaactcgagacttctgatttagtacgttacataaggattaacctactggagtggccaattcacttttagttcaacaataattcaattccagcggtataggcgacaagggttgtcatatcatctcctttaatcaaaaggcgtcgacctgaatcatatcctgtctcctaattaagcatgtgggaacaggagagcaaatctggtgctcccttctctaaagtatgcaaataagtttctaataatgtttatgactatacatactactccctccgttctaaaatataataacttttagcctttaaaatttgtctaaaaatataacaacttcttcaccaatattattttcttaaccaatcacaatccaacaccattcaatttttctacctacctccaccttctatccaatcacaatcttcttctatttaattctaccaatttacttaataaccgtgtataattctagaaatttttatattctgtaacggaggagtaagaattttcttgtaaaagaaacgactcatgactaaggagaaaaaataatctcattctaattttcattaccactgtgatcactgattcacttcactcatgtctaactcaatttttggcatgccagtttttttttcaattttttccacacttaattttatgggttaattggatccatgcaactacaaatatgtcaaattagaaaaacaccactactactcgcgatatcggttgggtgccactgcagttttgagaaattggatccatgccactccgtcgcgttttccgtccactccccgttaatgccgtctcttcggggcgccacttcatattttcccgtgcatggacgacgccaccgccgctccactcgacggaggtcagcctcgccattgatgatgccatcgcggagatcgaaggcggtggcggctgggacctagggtctggatgcggccgtcgccgtgtgggacgggaagaggggggccgatggcagcggcgccggtggtgccgactgcatgaagctccataggtcgtcgtcgctgccgatgacgccgccgttggcaccaccgagcagcctaatggccgcagtggagtagtaggcgaggccgttggctgccgaggcgtcggcgtcgaagcagagctggtcctcgagaggtggcagcttcacgaagccgtggccgccgagcatggtgtcgattggccggaggtacctcaacgctggcctgcggcgaggtgagctcatgctcctgcttacttgacctgcccatgtactgcaggatctcgtcggcgcatggtctccctgtcggcctctagcgcctggagcggctgcacaacgccacgaagctcgcgcgcagcaacatcaagagcacaaacatactgctcgactaagccagcaaggcgtgcgtggctcacggactacggcctggcgcagctgggctcgtccccggcggtggccgcggcgagctcgatcggcggggtaccgcgacgtgtacgcgttcggcgtggtgctcccagaggtgctgacgcggtgcccgggcgtcgcggcgagctcggcggggtactgcggcgttgaggctgtcggagtaggcgcgcgtgtgggacgcaataaggcggagccaagcgcgacgcggagagacggtgtcaacggagagtggatggaaaacgcggcggagtggcatggatctaattttccaaaattatagtgacacccaaccgatatcgggaatagtagtagcattttctaatttgacatatttatactgcatggatccaattaaccctaattttaatatagtctatgtatatacatagtaaactatacttgttagttagcaatgttgtgccacttcgcctctcgttggtttcttgttggcttatggaccgtaagttaactagtaaaatttaattttgagtaaatttcactttagcccatttttattacgatgtttcggtttagattaacatatttttattttggaccaggtaattttacctctgacactttgaaccaccgttagctcttttactcatctgcatttaactagcttggcacataaagaaataatctatatacagctgtaggagtttatttaaaaaaatcgacatacttgaaattgtttatacgcttgagaagagagtcatggtggtccaaaatacaacaaaggtacgattacctggtagaaagtgaatataaaaggataataatacaaagtgaaatttcggtaatcaaaatatcatccaaagtaaaatttactcttaattatttatacttagttaattttgagggtttttattgtagtttattttcaacattgatttttaaatcactaaaataatggctataaaggttttatgtacaaattatcgtctgtgcttcgttcctcggatgcttctatctcttcaggaaaagaaaaggatgcgtcggatatgatctccgatctcccttaaacagtaaagaatacagcgacacctttgctttaattagcttcacaccaaactttgaattcttttttttttcaaaatgaaaggacgtaacagcctagccacaacattaattttgttataatatattcaaaaaagttgcaaaagaggcattattaccaaattaactcttttacatacacattcatgtttacttttcctaattaagttgatgcacgaaaatttggaagccaatcatacttatttttatatttcgaagaaaaaacaaaggaatggaatcctccaatttcaatctaaaatttgtccttcggtgctaatatgtactccctccattttaggttataagatgttttgactttggtcaaaatcaaactgctttaagtttgatcaagtttatagaaaaaaataataatatttttgatccaagataaatttattataaaaatatatttaactattaatttaataaaactattttggtaatgtaaatattactatttttgtctaaaaacttagttaaatttggagcagtttgactttgaccaaagtcaaaacatcttataatctgaaacggagaaagtaatatactacatctgaccgtcctaaaatgaaattgtttctggtttgtctaggttcctaaataaaatctatattttagaacgaaatattattatgtttattaatataatactgcactcctaaagctagccaagtcgatccaaatccaagcggctctagctacctatagggtagcttagctcaagctttaatttggctcattgacggcacacttgctggttgtactagcattttttttaagataatgaaataaaaattctgatctttgcttcaaagttataacaacttattacaaaattctctcaaagagagcaaatactcaggcaaccataagaactgaaaaaataaagccaacacacaaggaaaagccaattattaaattctatttgtgaatctccgttcgtagttggcgaaaatctgcactgcataaccataacttctaagctaagacatgtagaatcatggccggccctaggacagtgcggggcctccaaaatatgtatactatagtaacaagcctgataggctattttgtgcattgagaagatgctgctagatcagattgttattgacactatcatcactgattttgtatctagaactattagaacaaattattttaaatgatctagagatatttatttttggtattttaaacttattagtgtgaaattcgttaatgacaatgagtttttaaatattaacttgtatttttatggtgaatgggggccttcattttttgttccgtactgggccaccaaaaagtcagggccggccatgtgtagaatataagaactccttgttctcttcacatttttgaaaatgtgcccagaaccggagccagtgggatgttggttgtagctagctaggcgtccaataggagatgcatgcatatgtacactagatctggctttcattcactgattcacagcatgtgttgtgcacgccgtcgtgtcgccgatgacggccggcccccatgactttgagagatgcttccatatgaaaaacagagcatgcttggtttttgcagcgatccagatttcgacgtatgcatgcgaaatggcagcatatgcaacgcctgtctccaagatgtactcctacactacttacatatttaaattttgcatacgatccaaa

SEQ ID NO: 75507 - DNA, 24609 bp, Oryza sativa
ccccccccccgcccgtgctgcgcacgtgctcgcgctgacgacgcgcgcccgaccgcgtggggcccacgcgtcaggccgccgtcgccttcttcctccagccgccgcccggcttccctctctcccgtgaaccctactccttccctccctcaaatccgtgtgattcgctcatgggattccaaaattaaataggggaaattaatccccattgaatcctcttcaatcccccccaatttcccccttgaatggcgcccccaatcgccgggaacgcccgcgtcttcctcggccgccctccattgccgccggccgtggttcccgccgccgttcccgctcctcccgtggccggctctctcccccatcctataaaatgggatcctcatcccccgttatctcgttttagccccatcccgagcctccccgtggtccctagctctctccccgccgccctcctctctctcccacgctgccggccgcctccagccgcctgtgccgcctcgaccgtgcgccggccggccgcgccgtcgcctcctccagcgtcgccgctaccccctccaccccggcctgccctccgtttcccgcggagacccccggagctacgtttccgccgtcgcccttccctttcctccgcaccggccgcctccagccgcctctatctccctgcctgagcgccggtcaacgtcgccaccacctccctcggctccgcgacgccgccctcatccccggcatcacctcctcctcgcccgaagctcgccggagtggcctcctcgccggcgtccagtggcgtcgccaccacttctccgtctccggccggctgctgttcgtcgccggtacgccgaccgacgtcgccgtctcctccgttgacgtcgcagcgtcgccctccaccccggcctgccctcggtttcaccggaacgtcgccgcgaacatctccgtccgcctcgccggagttgtttggccgcccgtccctcctcgcccgtgcaccggtcggccacacctccaccacctccggcatcgcagcggcaaggtcgtcctcggcatcgtttcccctccatccaaacccctccgcggtccatcatcgtcgtctccgatcgttctcgtcgtcgacgtcccatcggtcgcccggctcgtcgtctcgcggcgccgcctccgtcgtcggcaccgcagcggcgtggtcctcgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgccgcagccccatcatcgtcttcgtcctcggctccgcgtcgtcaagtctcgtgccggccgtgtctcgccttcgttcaaggatcgccgccgaagtcgttccctcgccgtccgtctccgccgcgccgttcgtcgttgtcgttcccacgcctcgtcgcgtggtggtaaggttctctctccctcgctgccccgtccctgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtcctcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggtttgcggtcgtcgccgaaggttcggaaggccgttctctctgagcaaggcaagtcccatcatccttgaacatattgaatcccagtttataaaattatgttgctttaaattattgcattatcgctttatttaaattcccgcgtgatcactgttttatttagccatgcctatttacctttgttatgaccttaatattattgttattgatattattaccttgttcaccctaggaaaataaaaccccaactagtgggtactctatttatggttccactagtatgaatttaggtagatgcttcgctgattaattaggtaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggccgcaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttgtaaatgctgtttactgcaaaacttaacccctatattattaccccttgtacccccttgcattaattattcatctccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgtttatttttgattgccaggcctgaagcgcctttgtaataatgtaaatattatcgatataataaagatgtgcctgttatatcatgtttgtgtggtgtaccccggcttttcctgggacggggattaatacactagcgttcgggaaaaggcaattttcccggtcgtgacaacaatggcggtggtgatggtgaggatgatgaggcaagtgatgatgggagtcctctcgatcccaccatccaatttatgctaactttgaggaatgctcagcaatacactatcctccgacatcatgatcaattccggaggcctaatgattgtaatgatccaaggttccatacacggttccaaaagtccgtgtatgagcaagtgtatgccaacaaagccttcgccgaacacaagtggatttcttggaggcacattggtgagacaccggagtttgtggatttgcaagagatgttctgacccgttgggattgatacgattgtcaccatgaagcaacattttgatgaagatctcatatctaataggttaaggtgtgttgggccatattttgtatgggtatgggctattactctatattgtgtgttctttatcgttttgttgaactctatgtcatttggacccttcatggtcttgtaatagcctatgtttatttgtgagcccttttaggatgatgtgtgacttatgtgagttgaatggttaagtgatgtgaacttgtgcgatgatggatggtatatgtgatattgatatatatgtgaccatcttatgctcatgaatgaatatttcttgaagttcatattgagatattgctcttgtgtttgtgatatgttgaaatgtgaaattgaaattggctccatatttgctattgttgttatgcatatgtttagggggagcttttgcttgtcattgcaatatatctccatgtgctctgtgtttaattatatatatttgtggtgtttgtcatcaattaccaaaaagggggagattgaagcatctaggcccacggtattaattttggtaattaatgacaagcactaattgtggactaaccattgtgtttgagctatttgtttgagttaggttcacttaattgtgtgcacatggatgatcattgatggattaaaattgacggcgcaaagcaaaaggaagagaagatggtagactagtgttttcattttaaatttatcgaggcgttgggcgatcaaaattgtgctagtttattaatagctttgtcgtactattaagaggggtaatgacctagcaaagagatgattttaattgccacattaggtcattatgcatttagacttgtgctttcatttcatcacacacacacaatcatttatctcactgttttcggcctgaccagggccggtctgaccgcggcccaagtgccggtctgaccggccagggcagccggtctgaccgcagggtctaggccggtctgaccggcgggtgcgggccggtctgaccgaccagccatatggccgggatggtgccgtctcggtgtgctgatcccgagccgccggagccatattcggtcagaccgagctgatggcggtctgaccaagccgaggccggtctgaccggccaccccatgtcggtctgaccggctacggctgtggggcccaatgacagccgttgtagagtagcacagtttgaccggccacatacctccggtcaaaccggcagagcacagagttgggggatttcgcccccaacggctagttttggttggtgggagtataaataccccccctccagcagcaaggggactctcttggcacccaattcaattgcatacaccccttgcacctctctcacacccacttgagttttgtgttcatacatctagtgtgttagagggttaattagccaagagtcaagtgcattgcttccatttgtagagctagtgtggcacttgattgatcatctccacgcagggtcattgcttgttattcttggaggttgccgcctcctagacggcttgtggaggagttgcccggtgatctctccgagaagattgtggaggaggtccggtgccggttgtgagtggtttggagttcaccaccttcggagtgaaggaagaactaccctagtgatcgaggcttgggtagtcctctccatgggccggctcccgccttgcccaccccttgacaaagggggcgtgcggtggcttcgtggttgagcggcggagttgggctcgcttcaacggggagtaggaaaccggcaagtttccgaacctcggtgaaaaatctctgtctccttgtctcatttgattgtcacatttacatttgtacaatttatatttttagagacattcttgagatcatatcaccctaggattgctaaacattgacataggagtgtgatttactttcctagagatataattgagccactgtcaccctaggtttgcaaaacataacttagttacttagttagagttgaccctcaccaagcctagcaacttatgttagttttgattaggtgtcatttagttttaaatcgcctattcacccccccccctccccctctagtcgacatctcgatcctacaggtgtgtgtgtgagagtgtggattcgagtttgtgtgggtgcttcttgtggtcttcgtaaagatttgtgagcacttgcatcatctccaggagttccttgcatcatcttttactcttggaggttgaggactcctagacggctaggtgttgctcccgagccactgatctacgtgtggttggccgggagaagtttgtgaatgccagatctcgcctccgcaaggaaagagatacctcttagtggaaggaggggtgcttagtgcaacctcttgaggaaagggttagctaagacccggctcttagtgagctcttcaatagagagtagaatccccttaaggatttgaactccgggaacaactttgtgagcttcatcttggtgatatttcttcatccctctcctctagctttgcttgcttgtgccgctattgatctagagttatcctcttttgttcgactgctctgagtattttcggaagttccaaaaattcttgcttagttccgaaaattcttgcttccgctttacttaagtttttaaattagcctattcactccccttctagggctaattgaccctttcaaaaatgttctctgttgtttagtgcagatgtcccggatgagctacgggagaatataagacaggctttgcaggttgaatcaactgtttttgagacgaaatatctgggattacctactctggagggtaggatgaaggctggaaagttcaaaactttgaagcaacgttttgctaagaggctcactgactggtctgaaaaatatatgtcgtctggggctaaagagattctaatcaaatcagtcgcacaggctatcccgacatatgttatgggagtatttaaattgcctgctactgtgtgtgatgaatatacaaaatgataagagacttttggtggggagatgacgaaaacaaaaggaagattcactggacagcctgggagaacctgatcttaccaaaatatatggggggattaggttttcgggacttacaactgttcaatcaggctttactaagaaggcaagcttggcgtcttattcagtatcctgacagtctttgagcgagaattctaaaggccaaatattatccgaactgtgatctcattgatgctgttttcccatcggatacctcacctacatggaaagctgttgaacatggccttgagttacttaagaaaggcttaatttggagaatcggagatggaatttggaaggaccagtggattcctagagaatccagctttggactatcacgccagagtgggagatgccgcctcaggtgggtttatcaactgatcaatcaggagacaaacacctggaatacaaatctcatccatcatgtttgctcccagtatgatgccaatgaaaattttgaagattaaattgccgcaagtcagaacagaggatttgctagcttggcactatgagaagacaggatttttctcagtccacagtgcttaccgactagccttgacaaatcatatgaatatatctgagttgggttcttctagctccgagacaagcggagaacgaaaaatttgggcaagcatatggactacactagtgccgcaaaagattaaaatctttgctaggagattagccagggaaggtcttactacaatggttaatcggaagaagcgcaagttggaggtgaatgcaacttgccgtatatgtggatatgaagatgaagactgctttcatgctgccatctcctgtacccgagctgttgccctgagatcactgttacgggaggtatgggagatgccaaaggagagttgtctgatcaggagtggaccggattggctcttaatcattcttgattccatcaatccggagggccgggcaaagttcctcctgcttctctggagatcatggtttctccggaatgattgtgtgcatggctatgggaaagcatcagtgcagggaagctcaattttccttcagagctaatgggagtccttaacaatgaccaggattggtgggaagttagatgagaaaggaaaaggtcccttattctgcaacagagtgttctgaaggagaactgtaaccaaacccctgccattaatgatagatggactccaccaccgacgggctagacaaaggctaatgtggacggttcgttcgtccagagttcaggctgcgcgacctgcggggattgtcatccgtgatagcactggttcggttctgcttaccccatggagggtcattaatcactgtagctcggctgaggaagcggaaacgattgcgtcttgggagggtgtaaacctgtcagctgaatgggtgaaacaacctttgatccttgaaacagactgtgcaaatttggtatgtttgctgaagaaccagggaactgatagatcgaagctgtgccatacacttcatagcataaagtctttgttggctgttttaccggattttagaatccagaagactaggagagaatgcaatagcgtagctcataatctggccaagttagctatgcgaacaaatcactcagcagtttggcgcttgcaggccccttcatgtattcttgaggcactcgctaatgactgtaattatatcaatgagtgatcaataaagcattctttcccccaaaagaaagcatgagaaaaactgtacagtgtttatggaatatttacaaaaaggggaaaagcgtgagtcctaaggtactatgctacaaagaccctttgctcctgccaaggtccaagtttttgcctcctctttgatcttggcgactagatttgttgccgatagctttttgagttcgaacaccgattgatttcaccatttccatagtttctaagaagtcagaaggataaggctacgcaagccttttttttggtacctacggggtgaaagccaggttcgaccatcactcgtggatcgtcacagggttcctccaatttgttggttcgatttgatcgtaagaaatcaaactccaaaccttctggtgtatccacattccgccatgaggtgtaggcctgtctccatggtatgccggcaaagaggccagcgggcagtaggcattattttgccatccacgtgttgcgagtcggtctgatgtccatactctatttttgtacgattagctatgcaaagaacttattttctcagtgcctagggcttccatatgatcgtggtgtagtttgtactagtagatccaaggaattgccttaggctagaccatgtatcatacacgtgtacccaaaaagaccaaacctatataattagagatttgctaggaaggtaactgaccagacctatatataattagagattcgctagaaagataactgacgataaaattcgatccggtcacatgtggagcgtacagacgcgcggtgaaataaaaggacatctccgcttagttacttttctgtttttatacatatatttttagatatacgtttcgtaggtttttatcggagaatacatttaggagttaagacaatcaaaatatttttaaacagtccttagacttaccaccaaatgctaactaagtcttcgggttgatgccatgcattttagttacgataccccaaaatttatatatatataataattaattatcacgaaattaaatatttagtaaatattgtacaaattatgaaaatagtaaaaaaaatatcactgctgatttactggttatttaatttccggataattaattattataaataaaataatgggtacaattatttcacaaccaaactcaagaaaactttgatggactggtggggtatataagaaatcggaaatcatagcaaacacaaaccattgaaaacatattggaatcattctaatttaacaaaaatgagatgcgccaaaatgaacactcactcggttatacaacacatttgagacgttggacagaattgtgaaagcatgatatcttcaaggtcagcaagcccgaaacatacacgtctgaaatgatgaggaagccaacctatatcactttattatttaagatgttaccttacaaccgcaatgataactagtataaattagtgttttgccggtatttagtcatcagattcaccccctctataaattgcacaaaagaaaaaaagaaaaaaacttaagagggcaaaaaattacataattacatttacatggaccagaacatcttccaagatgtatccgtgctaaacgtgagcctgatattaaaaaaaaaagaatagcaagaaagtcactaatatataaactacagtaagcctaaacgcaacaaaacctactcccagagcttttcttgatcggttcccacttatttgactgttgcttgaagacatcccctcaactatctccttggccagctctgtttaaaatgcttttttctaggtataccttcagctttcacgcaagacatccacgaatttttcagtcagctagcaaaagaattagtttcgtcatctgagactgctgggccgctcatatacttcaatagaactccaggccacaggtgggcagcaaagcaaggtagaataacatgctttccaccacagcttgacttagttgaagaaatatggggatcccaggacatccgtgagatcaaaatctcccctctctggcaatggaggaaattttaattcagggaaagatttctcaaagctctccaacaactgcaccaaaaaaatactgtcagttatgcaacctgtcacttcaacactcactatcacacaaagaataacacagaaaaaccagcaaatgccaacacggtaaacatgcaaatcatgcactgcaaagaaaaactgtattaatactgatatttctaggatattatgaaagagaacacttatctcagactatctttcagctaccctacatagcaaataaatggaaatgcttaacactcaacaactttagaagcatgggaagacaagggaaacacacatttattattctcaattgcaccattagacaaatatttcacactgaaaaaatgctttctgaggagagatacaagcagaaacaaattaatttacccaatactctcacctggtaacatgcttagcaacaaactaacgcaattgttattagaggcattctcttcctctcttttattagttatttaaactatagtaactatctattgggaatgccctaattatgctaggaggtgcacataactcacatatttcgatggtctcattctcatattaatccatatatttgttggggaacttgaaaaataatccaagcaaaattacttaaggagcaagaaaagtatgccagaaaaaaaaatctgatttttcttaagtgatattctgaacaagatagaatggttgttaaatatctgtgataataaccgggataagaaaatacacacattttcgaggataggcgtatcatagagttccacaaacttctctcgtagtattttgttcattgtatcaacatcacaagcatgtgtccaatacgaatcatgcactcctgcattgattttaaaaaaatgttgcgactaatgtacttctccttaagcgcttaatgcaagggataatataaacacttcccagaacacagtaaaactggtacctgcaaaatttagtccttgccttttgcaagcaacagcggtcatcatcatatgagaaccgtcaagggagtgcacgaaatttggaggaaaagcagtcctctgccgcttcaccataacctggttgagtgaattttagtgtaaagtatcaagtattctaaagatctattagattccaagatacaacagcaagtgatgaggaaaataatccatttgcgtccacagttcaataacccattttctgcacaattaccacagggattgcacaggcagtgaactgatcagtaagcaaatgagcaaaacatggcatcagtctttgcagattgtacatagtgctgatgttgaatgatgattggagtaccacagttgatgcgatgagctaataaattgcagttgccggcctcagcttgtttaagcagatgtgcaaaatataaaaatataatggctgttcaccttgatttggtaatgtcaaaagttcaaaccagacacttaacaagagcatacttgtggactcaaaagcttgttttctcataacacatgtgctaaacaaaactaagttctaagcgggaaatctgaaaaaaggcactagcacccggtagtcagtgactggtggaatgtttttataaaaaataaaatagaaaccaagtgaggtgtttactttgaggaaaggatatgggttaatcctagttcatccgatcttaacatatgtccacgatgaatgaaatatcaggaataaagccgtgacacaattcattagatgacccattgatgggaaatctggtccattccttaatcaaaaagtgcactacactactacatgtcatcatcacacacacttcgaccagcaaccagctgatagcgatattgtcagaatgtggaatatagtccaaattgataataccttatctgtttcacgttgaagagtcaggacttgtaatgatgttttaatctgcaaagagaacatcaagaatgccactttaatatcagaacaacagaaggcacatgttgccttattacatcatgtctgaggcatattgcaagttggcaacaataaaataaatacttataacacttacaagatgcctcccaagcttgcgatatggttgaacaactgggagtccaagaggggttgtccatctcacaggttcattttcacaagcaattacctgtcataaagaacaggtgaggtaattcacaacttgcgtctttcctaaattgcaataccaattaaagaggtaggatgccactgtagaaaagtgacatagacatggattttgttgatgcaaaaattgatatagacatgaattttattgctgcaaaatgtatttacagcatcaaattggtataatgcagctgtcttaggataactatcgtaccttggcacagtcaccaagccagttcataatgctgcgggcagcttggaacatctcaccaagtgctgtcagagtaacctatcaagcatcaaaaataaataaataaataaatattatatggtcaatttaattacacttatgtaggataatgaaataaaacagttccactgaataagacattcgaccttagcagcatagcatgatgcactaaaaagttctgaatcatcacaaatcatgtctctctcctttaatcttctttttatttgctcacgtgctccaacataagtgacaccatacacagatgtcatcacagtttgctttaccaatttcctgtcaacctgcaattgataatcaagcaggtaaaagattaaagggtaaactctaatccatggacctctcaacagcaaggttatgtatcaaccgaacagcatcaagcaccaaaacacccttctatcactatttcataggcagcaaacttttacataaacagatcaattaagtgaaagaaaagaatcccgaagtaatttcttctttcattccctgagcactgatttaacaaatttccaaaatggctaataagacaactcactgtgaaccattttgggcaaaattggatgatgaatcggtacttatcattcaaaaatatgaaataaagtgttgtttaggaacctaattagccatttttaacatatagttatcgtaaatagcattagagaatttaatagattgtagcaaaacatcagatggcgattttcttgaggactaatgttttcaggcctatattcatctgaaaaccaaatctcttcgattttgagaacatccatcctgctagtcatgtgagcaaatacaacaggaactaaaaaatatatgaagaactacctgatcaagtagcagacgtgcgcgtgctgcatcaggatctgtagcaggatcttttagcgcatcgttcttcataatttccaccaccctagcacaagtacagaaactatgaaccactcgccatcttaattctaagatatggcatcagttgcatcaagattgataaactagacctgatgatcctcaaatctagatttaatcaatttttaggcactagtttaaaatgactaagaaggacctcaactaaatatcaattttgattgtgtatgatactgtacattagaatattggcctattccagtgaccttgttacagataaataatagtgagcatgaattgtatcagtgagtacattttctaatcaaggattaaaacttatatccaatattgtacatcatgataacaaaccaaattctcatgcatctctatgatctggtaggacccaatttggttatatagttctaaaaattagaataatactggaatacttgcttactcaatgggaagtgttgtaacctgcagaaacaaaattctttctgctaagccatggattaaaataacacactacatctttgaactaatctagaattagcttgtaatattgcattcacgcaataatttggaattcaccaaaaatgaggaattcagtgtgcatgatgcacagaatgcaaataggtacgggtacagcatatgctatgggtctgtttggttgcctggtcaggattggcttgcatgagcggatgtaaaactggactgtttggttgcctgatctatgctcccagccaggcccatctcatgtaaacggctcaccaagccaaggcctgatggaaacattctctctcctctaggctccactcacctccccttcctcatttgcgttcatctttctctttccccctctcctcggtcatcctgattgagcttgccaatcgactgccgaaaaccagggaatctcagcaccagtcaccacagaagcgattcccggttcttccactccagatccatgttgtcactaccgcacatgtgctcccgtcaacagtatcatctgtgcatgtgctcttgtacttgaggcaaacctagtaatctggggataggaagagaggcagagcttgatgtctacgtcagaagtgtgctatttggatctgctcatggtggaaactggtatcaaggaggcagtgcatgcctccttgcgttcctttctggttttcccctcttgtgatttttttcgctctagcgtttgatttatcatgtacctagtctgggcggagtaaagttgctaatggtcaattctcctagctttttgggtttatttgagatcaatcttggctagatctgttaattatgcataatggttggaatttgacattaaaaactactccctccgtttcataatgtaagactttctagcattgctcatattcatatagatgttaatgaatctagacacatatatatgtctagattcattaacatctatatgaatgtgggcaatactagaaagacttacattatgaaacggaggaagtaagtgattgaaatttttgcaccgaagctaagaactgcatggatctagcaattggtggcatatttgtttgattcctcttggatttatctcatgtaccaatttgatttgttacttcaattaaccatactatgtcttgtagttactactgcttgctgtgtatctgatattttttttcttttttgaatccaagcaagctggtggtgatatgcagctggagaaggttgccacaatcatgttttttcctacaagaactactgctacaaaggctatccaacactagatggctaataaaatgtgtgtgtactatgtagttagtgctaatgagccagtcaaaactcaaaagtattctcaagacatgtaaatgtgggaccaagaaccagtggcaggtatatcatcattgtctttcttctgtgtattcagacccataacaattaattagtacaggtaactacaggtgttaatatattgttaacgaatatacaatagctaattcccatgagcaaagtgggtaatctcaccacccaagtgacaaggcaaccaaattcaatgttcatgcaaccaaccaaccaatcaaaattttatgcatgcaaaaatctgaccaccctcctttcctagccaaccaaacatctcaaatcttaatcaaggcccaaaggatacaggcaaccaaacaagccattttttatctgcgaagccaggccaaggctagccaggatgagacatgtgaaccaggctgggaaaatgcagacaaccaaacatgcccagtatgttgcaatggagcattgcatcctaccataaacaaggtgcaatgctaaacacaatgccatccaaacatacctggtagctattccagtataaacatctgcaggcttctccccggcaactaagttcacagcaatggctcccaactacatgaaattgataagaaaatcattaactctactagccaaaaaaaaaatgatgatgatgatccatgcctgactaaataatccttatgaaaacaccaaaactattcaaacacaaactgaccttatcccttccaagagcagcatagtgctgcaggccattacaagaaccatcctgaaaaaggaaaatgttattgtagttatgattaaacatggaagtgaatcttagcgaaaatcaaaactgtgttgcgagtagactgcatttagaaggattaaaacataaacaaatttaacaacacactagattttgctattctgtctaggaaattagtggtggaaaacagaatccagtgtgaggctggcaagtgagccatgtgcgagttttcactatcacatgaatgttattctccctctccaactggaaaaaaatatataatttactcaacaaactaaaaaagaaggaagcaatgttagacatcatttttaagtctgtttatcacgttgagtcaagtcagtataagaccaattcagcgaagtgagcaactagtcaaccaactacttgtggttcgaaagcagatatggaatgcctacaatatgcatgagatatgttagactgcatcagttacctacctagtcgaccaaccaattatgattaggaaataacttgcaacaatgattcaagtattggaaagttataactcacaacaaactctattaatacaaatagatgataacaactgagatgaaccataggaaatgggcgtgcagtgccatatgaaaaatgtatcagtagcaaaaaaaccatatttatgagaacaagagccccatcaaatgatcactacatagctatattgcataaataaggaatttaccaattgatcattgctctctaaagcaaatgagagaaagttaaggtacctgatgcacaggaatatgtgagatcatcgtttctggtgaggggcttcttaaagcttcagtgagatttatgcacactgcaaggcattggaatggatcctcagctccaagccaccatcgtttgccttcaagaggtctatcagctgagtcaaatatgtcctccaagtgattctccgtgaatgcaattcggccatcatacgataacttgtcaacaccaccagcatataaatttgctagatgtatctttagccagcgcaagcctgatttaccaagcggacgaccttctgcaaactccaaaactccacggcaaagatctgaacccaagtggttcaggtaaggatgcattggataagcacggcctctaaaatcaaggttgtgtggatagtagaaaccatcttcatccttcattttgcgagctacctgttaccaacatgagtattcattagatgaagcaatgaagtgagtaaatgatggttacccgttatagtctcttacggcaagttttagttctacatcacatctctgggagtgcctttcactattttccttcttggctgctctcaaggtccatctccatttcttcaacttgtcttcatcttctgtgtcaggcttctctggtaaagcaacctagagtacatgaaactttttagttgatatctaaaactaaagtatcttgataaaaccaccaccattgaatctgagtcacatgctcacagcattattatgagaataaatgacaactcacatcagtgcgatcgaccaagtcagcaagccggccaccacttgaccatattctgtcgacaatactaagaactcttttgttaaccctccacttggtgctcccaagagtatttaaggcctgtgaccaataatgcattaaatggttgaaccacaaaagctcctcttggcatttaggtggattatgatagatctcatttggtgcagctgttttagaggttttggtgtttaaaaattgcttttcttttaatcaaagctgcaaatgataatattattgtgttccgaaaaacagaactagggttcctgggaggagctggaggtgcgtccctgggggtggagaacgttgccgacagggtgcagaggccgagctggggaggaggctggcattgggtgcggtcaggggtggaacagtgggtggaggcgagcattgccagggtgagaaggtgggtggtgtcaatggcagttgcaaacagaggcgaacagccaatcatagtcatgagatgcagaggcaagcagaagcgagcagcatgtggaatgtatcgtggggatggggatttgggtgggggggagggggggttgtatttagggttatgacccagacacccagtacacttatggcaattcatgttaacagagtggatatgtagagtatagagaattttctcttcataaaaaggcatcaacatgtcaatgtccaagagcatatgaacaatagaagcaactgtaacataacaacaggtgtgctcaaatatcttatgattgtatcttaaaaattattaatataatttgcataaaaattatgagcaagttaaatgaatacctcaaacacagattgcatttgttcccttggagctcttctgacagcatctctctgttgtctagctccatgggtgcgcatcacataggatggtaaaaataaatgtgcacccttgtcatacctatagaatatttgcatgatgtcaatagagagcagtctgcttcatattcagagtgtcaatgcaacaatggcctcaccaaacagcaccaacttgcactgaactaatcagataggactagaaaaaaatatctcgactattaggtgcaataacatattatttaaaatataccacatatctaatttgttaaaatggatagtatagcagccaaagaactccaagaaacatagataagcaaaaggtaccaacccagtccaactgataggcggaattaacataggcatataaggtatgaccatatgctttgcctgtcaaaggaaaaacattattcatgaggaaatcaaggaatgcaagatcagaagagtcttttgacagaatcaagacgatagcagaaggatccactcactgttctatcaagcccttgccggaccagcggatcacacttgatcacaccatatcgccgactactcttcctgtttgattacaatgatgagttaggacgaaacaccaaactgcttttgtaaaagaagatataaaattagagttgccattattactgttgctctcttgccacagttctcatttcatgtgtgaaagcaggacggatatcaggtggaccatctgctgattggctagcaggtggttgtatgtaggctgtctcaatcataagctcaattaaacgactaccaacctaagcagcaagacatagaaactatcatcagtcaaaatagtgttgtaatgaaacattatattaaccagattcagcaagagacacgtacttttgcatgagcatcttgaccccatggcttggagttatcttgcttctttactatatttcttacttgccgtattttttgctttttcatcagatcagtgactttctttcttagacgctcttgttctttggcaatgtctgaatcacctccttcttcttcattatccatttctttattgctttttttctttgtcttctctagaaatttgtggattcgaacctatacaggaacaaagggcaaagacatatacatttattcattagcagcagcaatgttattgcataaattactgtcgccataattggtgcactggcaacaataatagtttagtcgaaacaaaatattgaaaattgaaaattaacatattctcaaaatatttaagaaaataatagacgaatgagagccaataaaggtataatttcatggcataactttgtttggacaatagttggaatttttttaactaaattggtgggttcagagggaaacatgaactagctagataatcaaagctctgcaagaatactaccaaattatatctgaaaaacacgaacactattctcagttatggtagaaaaaattctgcatatttgacaaatatttttacctgaggttatttgaaggagccccactgctagcaaagcacaattctaaggaactaaccaaatcatataggcttctgatgaggcctatattaggaggctcttgatctttatttcaaccatggttcaataatagttgaactcatacacacatacttctccaataatttcatacaaccatacgtctccaaaagaaaaataaattggtaatgcaatcatgataagctctaatgatgttaagcgctgaaaactgcaggaagaaatatatttaacttaatagtattgaaatatagaacattttgaattctgccagcgttcatcctaaaggtccaatggcctatggtcatatcatatctccgcacctaccgtggcatgtcgtgatgcgtgtaaaatattttgtgacccaaggactgatacccctgaattatgttttgttctcattcctaaaagctatcattaaccaataactattcttgaatggagcgcagagttgaaaagtaaaacaaacaagaagatacagaactcagccacagccgacaaacctcatgttctattgcctcgccgatctggcacgcagcctggatgactcggacacttccatcgccgctaccggtcatgagtagacccatgagcttgtgcatggtgatgacggccatcatatcagccgggagcatgttgaaatagcgggcatgggaggcccgcgcgccgcgctcacccacgagctcctgctcggcaatgatctggtctcgcagtggctcgaaccagccaagaaagagcgacttgacatagggcaggttgggcgccagcttctgctggcacatgtcagcaagcagctcgcggtactcctcggcggcctgctcccacgcctccgtctcaatctggatctgccgccggcgcagcatcgcatacttgtggtacccgaccccgtgcaccgccatagcctcggccgagtgcttccctctcccggacctcctcctatgcccctcctgccccgccgccggaaccgccatagcctcggccgagtgcttccctctcccggacctcctcctatgcccctcctgccccgccgccggagccggggcggagacgctcgggtccccgcgggcgatctccccgatcgcgtggtgcaactcgtcgacctcctcggaggagacggactcggcggcgacggcggcggaggaggacgcgaaccgcggcagcgtctgcgacggcgcgagacgctgtgaggcggcagggaggaggaggaggaggctgcggtggagagggtggggcagcggggcggaggaggagaggagggcggaggcgaggcggcgggcggggaggcggcgccacatggggggcgctagggtttggcggcgggcggtgaggtggaggtggagaggaggagatggcgaacacgagattggtgcggtggccggagttggggaggagggcatcaacaggagggtggcggaggaaggggaatggcgccgcgccgccgccgccgccgccaacggaaggaggggggtgcggttgggggagccggtgtttggttcgatgcgggggctttcgcttaaaccctcgtggcacctgggtggttgatcttgaggggtttaggggctcagatttttttggccttctcatcttcgttaaacaacatgtaatattgtaattatacccttcttgcttcggatttgttacattctaacccctcaggcaagccaaacctcatctctggctctctgctgacaagtgacaaatgtggcttagttcaagatttcttaataatattattcatgaggtgattattttttttacgaaatttaaaatccaaacaacatcaaaagttttagaattttttttttgtccttttagatgagatcatgtagtgagcaagtagatcatgcgccaagcagtgattatattaggagatcaatcagtatacgatataatcgagtatatcgattgttggtagtggatgacaatcaaaacaattaggaatgtcaacgagctgatcagctcgaccgagccaggctacataggctcgagcttgagaaaagctcgagccaaatctataccaccttgagcttttaagtaggctcgctcaagttcagttcgagtatacaatacttcctccgtttcacaatataagtcattctagcattttccacattcatattgatactaatgaatctagataggtatatatgtctagattcattagcatcaatatgaatgtgggaaatgctagaatgacttacattgtgaaacggagggagtaatatttattttttataatatttttttataataaacaatagttttaggttaatcatattaaaaagtaaggacttgtcgacgtttgatgtcgcgattccggtatttgcacagtatggggatcgtttggtaccaggatatatgcgagattaaggtaaaagagacggagatgaggatttttatataggttcgggcccctgaattgtcaggtaatagccctacatcctgttggccgaagccgatcgttgctcttattcaccataatcacaccagtataatatttggagtagcctatctaactgttgtcgacaacagggtagtcttcctcctcgagttcgtgcccggcgagatcagagacagcgctagatccctatacccggcctctgtaggtaccggatagggtcagtccaggcatttctctgatgtcgatatccggcggtgtgtcttggcgtatattggcttgtatgttgatcttgtgtcttgatctattgttctgtgtcccctctcctcctagggggccttgtattttatacccataagtgtccccttgtccaagagtagtccttgtcgtttccatgtagaactctggttgtcttcccttctccggaactccctccatatccgaagtcagttttcgtataagacatggtatgtggtgggtcctgccgagatttagtcaactactattaggtatgtggtatccatatagttgtttatcacatgaatagataagtatttcagaaaaaaatacatgcaaaaggccaaaaatattgaaatgtatagactaacttttatgttattccaggatagagaaaaaaataactatataaaacttctagtatggccaatcattataactctttgagtccacaatggcattttcagtatttttgaaaaagtattcggccaaatggcatattgtaaaaagtatagaaatatcctgatggtaaattattgaactagagcaaacttaatgtgatagaatagattatctcttaattaaacatagaaaggttaaaaaaaataagtcaaaactaattaccttacacaatttatacagttcatgtcattcgaggaattaataagtaagtaatacacgattgatgaggctagatctgtctctaacactaacactaaatgttgaaattaaaactaagcaattagggacatggccatattctagtcttgaaaacggaaggagtaattatgaactgtgtgacctaagttcgacgacaacgctacggtgagaaagatgaagttgtggagatcgtggatcctcccggaatcaacttgacatcattataaggaaaaaaatccatcttgcctccctcaacctcaactgtagcctgagttcgctttacatcccttaactataaaaccaagagactacctcaactattaaaaccaatgcatagtagatagtttgcataatgatttcatccgacatggcactttgacttgttcatggtgatgagtcagtttataggacccacctttcactgaaccctattcatatctctccatccctctcattgccctctctgtgcatgtccaccaccacaacctgcacatcgggcatgttcgttaccgacttaccgtgatcccttacatcaccggcaaagcagcctccaccccaaaagccacacaagaccatatcgcctagagaggaagactatgataacgaggatgacatgccaccgccgccagtgcgcatgagcctagagtcctcgttgtgtcagtcatcgccatcccctcctccaacgtcgccactacctccgcccactgaaccaatcactacatgtcgcgttgggtctagggaaattcactggcggagcagacactgtggtcgtgcatgtcttcctaatctacttcttttcgattttgctatatatttgtcgataaattttcccccaaaaatttgacagatgtaattacagtacaatcgtagtgtaattacactgtaacttgcatgtaattacactgtaactatagtgtaacttgtatgtaactttcaaaaatctctccgtaacatgttatttcggtaaaatggaggtcgtgagaacaaattctttcatatatgtgtgtgctatgatttgttttt

SEQ ID NO: 75508 - DNA, 57345 bp, Oryza sativa
gcggcttgggccaggcggccggcccagtaggatagaaggggagccggcctgggtaaaagaggtagaaggagggagtgggccgggagggggaggggaggcccgggagaggagggaaagagagggaggagagggagacttcggccgcgggccgaaagagagagaggggagactttgagctgggcttggcccaaaggaggaagaggattatttttaggttttctttttattgaactttgataattgttgttgttgtttaataaatatttccggtgctctgaaaattcaagtaaaatttgagggctcattttagaccaaggagaatttaacaaaaattctccaggccacattcgaatttttcttgtacgtattttagtgtttgccaatttctttccgaattttaattaattctattattccttttagaaaatgaattttatttcgggatgaatttatcaggacgtgacaattgtcatcaccaccatcactaccattgtcatcactacttacttccacctcatccccctcaacattttccatattttcatcctcactttgaacatactcatctccgcttgattcctcattctcactgacgggatcgggcgtgggctcacgacgatcacgacgagtgcggggaggcatagctgaaaaacaggagcaaaggatggataagcaacaattttagaaggcacttggcaagatggaagtaaggtgtgcactgcctgtcaggggcggtcagaccggatgacataagccggtcagaccggggtgtacctgctggttagaccgcaagatgcacgctggtcagaccggcggctcgagcccagttagactgccgggaacaagccggtcagaccgcctccttgttcccggtcagaccgccactgacaagtctcatgccacaaaatttccacaccacacaaatgattctaaacatactaggacaaaatttgcacatgatttgagcatggatatcaaggtgtaggtctatttcatcaagattggaacaaagggggaaaagtacccttaaccctagagattaaaatagaccgattgagagcaatgcacaagagggagagtgatttactggttgaaggagttgaatcacaccaagaaactaccctctattggtgcaaatcgaagaacacctcttccttcacctagggttccatgccatggatcacaaactcaataaaaactcaaatcagtccatggaatagagagagaaagaggaggagattcacttacggtgtaaccggagagaaatctatggtcaaaccgaatggattttgatggagggaggtggctagggtttgggagaggagagaggagaagaaaattcgagatggagaagtgaggggatgagaaggagagagagggagtcgggttggagaagaaagggtaaaaaccctgggcccacctgctaggccggtcagaccggccctatgtggctggtcagctccaggccggtcagaccgggcctatatggccggtcagaccgcccgctccagccgactgtgcacaacccttgcacagttcggctacccccacacaataaaaaacaacaaaaatttgatttttggagcaaatttgaaatgtgtgagttgaaatatttccaactatttataacatttgaaaattatgaagatttgcaacaaaactcacttgagtgctaggaggtgaccttttatggtctataggggtttttgggcgaatttgatgttcaaacaactttcgaaatgtttgatttttgagataggtttgaataccaaaaacatttcaaatcctcttctctaccaactttgttttgaaacttttctcaaattccttctcaatctcattttggccaaaactaagaatctagtttcttcaaaagcgggcaaaaatggcattttcattcaaaaaaacatttttcttgcaatatgaggcttggaaaacatataggaaaccttttgaaacattttctaagagatagttttcaaattacattgattttgtaaaagttttgacttatgttgacttgggcattttgaaaatactactagcaccactagttgatttgctcacatataaaaggaagtagagcacatgcaagagtgcaaaactcccccttaatgtgacatgcttcattttcgtaatgaagaaccaaatggcagtaaatccaaagcataagcgtgaatgagagcaaatatacacaatgcaaaagaagcaaccatggtgcaccatctcaagccacattagagaaatctatgacatttaactcattcctcaacctgcaaaagcgggtttcatcaagaggcttggtaaatatgtcggctagttgatcctcggttcttatgcggctaatgactatgtcacacttggcaacatggtctcttaggaagtgatggcgaatatcaatatgcttagttctagaatattggactgggttattggctatctttatggcactatcattgccacatagaagtggagttttggtgaaggatataccatagtccaacaatatttgtttcatccaaagcaattgagcacaacaactacctgccgaaacatattccgcctcggcggtagagagggctacggagttttgtttcttggatgaccatgacacaagggatctaccaagcatttggcaactaccggatgtgctctttctatccactttgcaaccggcatagtccgaattggaatagccaacaaatttaaacttagcaccttttgggtaccacaagccaatagtagaggaatgttttaaatatcttaaaatccttttcacggccactaagtgacactccttaggagcggcttgaaaccgtgcacacatgcaaacactaaacatgatatccggcctagatgcggtaaggtaaagcaagctaccaatcatagaacgataaagctttaaatctaccggtttacctccctcatgaaggtcgagatgcccattggttgtcataggtgtcttgatgggcttcgcatcctccaagctaaaccttttaagtagatccttgatgtacttggtttggctcacgaacgtcccatccttgagttgcttgatttgaagtccaaggaagaagctcaactctccaatcatggacatctcaaatttcctagacatcatatcaccaaatttcttgcaaaatacctcattagtaaaaccgaatatgatgtcatcaacataaatttgacacacaaagaaatcatcaccaatgatctttgtaaaaagggtggtgtcaacttttccaattttgaaaacctttgacaaaagaaaatctctcaatctttcataccaagccctaggagcttgttttaaaccataaagagcttttgagagtttgtaaacgtggttaggatttttaggatcttcaaaaccgggaagttgttcaacaaagacaagttcggcaatttcaccatttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttgtgtgaaaccttgtgccaccaaccttgccttgtttctcaccaccaacccgttctcatcttgtttgttcctaaagacccactttgtccctatgacattgtggtctctaggtctttcaaccaaagtccacaccttgtttcttgcaaagttgttgagctcttcatgcatagcattcatccaatccggatcacaaagagcttcatctacttgtttttgctcaagacaagaaacaaacgagtaatgttcacaaatcgaagcgacacgagatcgagtttgaacacccttactaatgtcacccaacacttggtcaattgggtgatccttggaaagagcggtgtgtatccttggtggcataggtggattttgtgccttctcctcctccacctcaacttgagcttgacttggcgtagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttattgtagacccggtatgccttgctatttgaggcataacctagaagaaacccttcatcaacaccgactttcaaatttggttagtctaacaccctttcgataaatataacacttgcaaccaaaaactcgaaaataggcaacatttggcttcctcccaacaattagctcataggaagtctttttcaagagacgatgcaaataaagcctattggttgcatggcaagcggtgtttatggctttgttgacataaaacacgaggcctgggagatctgcttaactccagtgcaggtccaaaactcgccttcgggtatgcaagtgtgctagttgatttgatcctgcaatcaacaagaaataaagacaaagaaatcatggttaaatccataaacgatagccgatcggctaggtgccgatgacatatcatttatcttcgggccgatgtcatatgtaaatcgatcggcagttataaatagataataaagaactaaatctactcgatcggctgtagatattaacaatatataatcctgatgtcgatatatatttaaatcaagtgattgggatagatcggtcgtcgtgccgagacagtataaatcacttagaccgaaatatatattaacaacaaagctatatatgttcatagcatagccgatcagatagatctagcatgtatcggctaatactccgatacaactccatgttaagatattaaaacaagcagaatataccaaacaaaagcttaatatacttagatgcaataagatcttaatataaagggcaggtttaacatgtcaacgaaacatatagagcaaatataattaaaccagataagatcagttgaaaccccgatactaccctaatcggcaaccagaaggcaggctagagattgatattctaagcacgacttaatagatcaaactcaactgatgcagcattaagtatgaaaagaagaacaatatctacacaatcaagccgctggaaatttcatagagtggtagatatcttatataatctaaatcaacgtcgacatctaacctaatcggttgccctctgccaacagatgttagccgattgtgggttagatggcggtattgctagagattatgtaagatatatgataactcgacgaattacataaacaagattagagtatcataaagatggaagcactaatcccgagaatgcaagccatcataacaagttttacctcttgttgaagatcgaaaccgatgcagctcaacttgaaagcaagaactcgtcgaaataaaacaaaagcaaaagggtggcgatgcgccgaaattgtattgaacgtgtgtgttaactgattacatggggttcggggtctatttattcccgaaaacaacaaactatgtccatatcggacacgactcttatctctaacaaactctaagataccataagtctttgcggcagacttttgcccaaacatatctctaaggaatttacataaaatatcctaatcaatagatacaattgccttctcaggactctatccatgcgtggtaatcatcttgaagcttatcaactcaactcgatgtcgtacacaagtcattttgccggaatcggctgtatcacttaacccagtctgactcggacttagccgatccaatcatagccgatccggactccagccgattcctactctgtttctgcaacgatcttcatctttggttccacttcgatcttatcctcatctccgatactgatataaccaaatttggttgttaacacatgccccccaagtccggaatatttggtaatgtttcggatttgccatataccactccgagcaagattcgcaatctgtcgtttcccaaccgttatcctcagcgctttaaatactaaccgtcgccctaaaaaatcttcaccccgttacttccgttttcaccgccgaagccaaccttctcctttctctctccggccatttctccgacgctcgaggcgatccccaagtgatttcgtctccggttagacctccgcccgcgccatcggcatagtatgctgagataagttctcaccggctagatcccttttcctcgcatgaaatcgatttccccttttctcatcttgttttcttcttcttgattcctttggatttgcagcacctttccaacctagttgctattcccagcctgtcacatgaaaaccactactttcttggtccaatcggcaatcttgaccccactgattttatcatcggtgaaaccagcataatcccctttagattagccaaccctaatctgggtaactagaagaatactttcaagtcttggccatctcttgagaaaaccacccctgagaagagttggaccaaatggtaccagcacgtatcgcctagtaagaaagttcactgggatgagattgggatcggccaagcgcttgccctcaccatagccaattctgctaaggatgaacctctgatggctgccgccacctatttctggtccaacaccatcaacgccttcttgttcaaccaagggccaatgactccaactttgatcaacattaccatgatcatcggtttagatgtaacttcatcggctaatcctatgagtatgaacaccaagaatcaattcgatttcaggacaaaaagcataggtggttggtctggctatgtggcagcatatatgggccaaggatctgttactcctcgagaacatgtggcctttttactcatgtggctagaaaagtttcttttctgtggatccagttgcagccctacgaacaactggcaatttgtagccgaagccctagaatcaaagagacaatttcctttgggcagaatccttctcggctatctataccaaatgctgaatgatgcatcagccaagatagctgttggctcagtagttggagcaggtggaccatggtggctattgcagacttggctaaatctgatggttatgaaagttatcaatcgaccatctgtgacagaagctgaatttctaaggttagagctgattgtagacgatgatggagagtaacgtactcatcgtagatgcatgacatatgaagaatatgcatccacaccagctgatgctggtgcaaaactatcggctgaactactcaaggattggttctgcagcttttatgaaggctttcaaaaagatgcccgagtctggtttccttatgaatattcagcagacctcaaactaccatcagacttcagatttgaagacatcaaccatgaaagataccaaaaagtccgagaagttttcacagctgcaatcagcccatgcatcttacccgtcggcattcaccaagggagaaacatacaagtcttctatgaattgtaccacccaatgagttcagctaggcaacttggattgggccaactcccaatcggcttattctttgccgacaagatccagtgccgaggagaaatctcatcaactctgatgatggatcggctgcttaacctccaaggacctcctctgggtagtattgaaaatatcgaattggcaggattcaagagcagaaactttgacagatggtgggggtgaatggaagctgcatctatttcatcaaacggcctcgatatacatgacagatctattccttgatgtcataccccaggtaaactttgtcattactaaactacataaatgtcagccgattcattacttgactaatcttttgttcctgttttgcagacaacagaatcttcccctccacatcaaagcaatagtggtataaatattcaatatgccccaggtttaattcctaatggaggtggaccatcccctcctgtcattggctataatgcccccaagacctcaactcttcttcaaggattcatcagagaaccagccgatacaggtaagaagagaagaacgaggttatcggccgcagatacattaactctagccccaaagaagaaggccaaactcaagaaacctaaaccaaccgatgatctgcctgtcctggatccatctattgagcaagctctggatgaagaagacattgaggataatgttgatcaggctgcagccgaagtgagtgacacagaaagaacaccatcggcttcacccaagcagacaacgccgactccttctgcccccactcatctcttaagagtaagcagctcccttcaatatcttttgtaattatttcactttttggccgattactcatagactttgtagctgcagaagaagaaaattgttgtaaagaagaaatcggcagcaccaattttcaaaccagctccaccagtaagttattcttaaatttactagttgatttcagcggattttgtataacacttgtttcttttactgcttcatcctcctccttcttcccctgtacaacaatcgtcgagtgaccgaactccatcggctgtggggagtcatcatattgaggcagaagtacaaccaactgctcctgctatcccagtacttttcctcctgatgcaaaaaattagatcgactatatctacttagctctcaatcttcctgaaattgtttctgcaggttttagccgatctcttctcttttgacattagagattatcttaacgaagaaacagaagaagacaccaccagcaaatctttggttctcttgcccgatgacgtgaagaaaacactcgaagacatatctcatcggctggaagcatcgtcactagacaacttggtggtaaactgtgggccaattaggactcgctacatgaaatccgagctctaatcccagatgagctagccgatgttcttactccagcagtctatcttgaacaacatcaattcaagctggagaaggccaagctaagactagccgaacgtcgggagcgcaaggacattgaagccacaatccaagccaatcgacagcttgttcatgaagagaagaccaaacttgatcagctatctaagggtccgattaagtccaatattgatcggctcgaagctcgcaagattgagctcttggcacaacttgaagaatgcaatgccgagctggatatggaacatagaaagttggccgatctcccaaagtctatcgaagagcagaaagtgagactcaaatcggctatcaagaatgttgccgatctgaccaagtctttgaaaatcatccgtggaaccgatgctcaagacgcccaagccattgaagaagtagaacaaattaggcaaagggccatttcggctatccaacaattcttgtctcgatgactttatttgtaatagacctcataaatttttgtaatcggtcaagatactctagtactttactatcctgataatccttcgtgccaattaatataacttctaaattcgctcaaaaatttgcaattttccatatatgtgcccccctaattttacaatgtcaaaagcattgataaaattataaaaaatgactaagggcgatataacaatatcagccatttgtacatcggcaaaccacaaccgattacaatatgaaaacaactaaggacgatataaccatattggccactgtacatcggcaaatcacaaccgattacaatatgaaaacatctaagggcgatataaccatatcggccatctcaaggcgatgtaaacacattggctatcatgtatcggcaacatgggggatgctaattggcgcgtacgcgccgcaacgtaaagtcgcgcgcacctgctccctggaatacggctcagccttgcgttgaatgccgctaatctatagagattagcactaatcccttttgtttagcactaattagatttttttatagaatgataaataaatagttgagttgaaaattttaaatatgaattggaaggtttgaaaattaagtttaatgtttgaaaaataagagagaaaatttcagatttagagttgaaagtttcaaaattgagttaaaaatattttcaaatcttgagttagaaagtttttaaatttaagttaagagttctcaaatcttggcttgaaagttttcaaatataagttgaaaattttcaaatcttgcattgaaagttttcgaatattgagtcgaaagttttcaaatctaagttgaaagttttgaaatcttgagttgaaagatttcaatctcgagttgaaagttttcaaatatcaagttgaaaatttttaaatctgagttgaaagtttttaaaatttaacttacaaatttgaattttgagttaaaatttttttcaaagttttaagttaaaagttttcaaattttgaccttaaaatttaaattttaactcgaaagttttcaaatctaacttaaaaatttcaattaaaaaaatcttctgttaattctataattatccttaactaaacgaattagttacgttaacacgttgaaaaaaaatctggaaaaaaaaaatctgcgcggcgtgcacctcgccggcgcgtacacgccggctagcttttctgcggcaaccttagccgatcatgcgttaacccaaaaacttgggtaatatttcttcaagtatttgccatttagtgctctgccataaacttctccatcaagtccttgcagtatgtaagctcctttggatacaactttatgaatttggaacggtccttcccaattcagcgaccacttgccgaatttgctatctcgagttccaatcggcaaaatcaactttcatacaagttcaccttccgaaaaatctttgggtactaccttcttgttgtaatgccgagcaactcgtactttatctttagtaacctttgcaagggctcgcaaacgtgactgaaccagatcttccctctcatcggccataaggttataatactcatcggctgttaaatcattttgtaattccgttctcctggagccaattctaacttcccatggcaaaacagcctcatgcccataaacaagtttataaggagggacttggatcgatccatgacaaaccatccgataagaccacaatgctttggccaaccgagtatgccattgccgaggataatcagaaatcttccttttaatcaacttaatcaagcttttgttagatgcctcggcttacccgttagcttgtgcataatatggtgaagaattcaataatttgatacccatgctatcggcaaactgaacaaactcatcggacacaaagatcgaaccttgatcggttgtaattgttttaggaataccaaatcggtagattacatgctcctaaacaaactgtatcgcatccccataatcaaccttcttcaaaggaatcacctctacccatttggtgaaataatcggtcgccaccaatataaacttatgtcctttactcgatggtggatttatcatgccgatcatatcaattccccaacctctgaatggccatggcttaatgataggatgtcacgccctgaaaatcgcctattttaataattcattctttaattcatttttagaaattattttaaaagcttacaagttgaactctaataatctaggaaaaatttcaacataaaattgagctagataaaatttcagtaaatactttgcttgtttatctattttctagatttttctgggaattatttgagcaaggaaagtatttttaataaatgaaacatcattccactaattattttaattgaaaaagtctttaaaaccctcccgtaggccgttgggccgtttccggcccaactcctctctcctcgcgcgcgccatgcagtccaagtcggccaaagccgagccgccgccccactcctcccctcagccgccgacatatggggcccacatgtcagggttgtcttcaacctccggccggccaagccgagaccgagccgccaccgttccctaccaaatccgccgcctccggccatctccgagtccgattggttgaggggtttttttgtccctttgttgtcctctatcttttccccccaagaatcggagctaattgctttcttttttatccgaatcaaattcgttttcgagtttatctctccaaactaaccctcagattttccggctcaaatcctctcgtttggagtccgatctctctaatccaagcctatataaagcatcccctagtcgtcctcttccatttgcctcaagttttagccgcagccgtcgcccgtagcaccgccgccgccgacgccgtttcagccgcgcctcgccgctgctgtggccgtcgccgccgccttccgtcgctgccatcgggttcacacggtggaggagcaccccgtccgccccttcgcagccgccgaagaccgccgccgtcggacctcgtcgccggccgtcgttcgtcgtcgtccgtcattgtgctttgtaccggtgagttcgcgtcgtcgtcctcttcgcagaggtgtcctcggatagcccggccaagcactctatcgccggtggttgcgtggagccgagctatggccggcgatgatgccatcgatgatgtcataactcttcttattattttttctttagtagattaaaatcgattaaacttagaaaattcataactaaatcatcataactcggattcaagtggttcaagttgctaaattcataaaaaatcgagatctacatgttaaaaatatccacatgtactgtttatgcttgtttttgtactgttttgttgattttgttcatttgctagtttccgacgttctggaggagagcgtttacgttgaggaaggttcagaagcatttgaggaagctcaatgcaagtcacatagatcccaaacaaccctttgagcatgttgaaccagtttaaagctaatgttttatttcaacttatgcattattttcgaatgtcatcaggtggtgagcctttcccaattaattatggccgaagatgactttattttcctatgggttataatttgattagctagaaccttatatattggtttggttcagctaaatgctatatatataattgcttagtcatgcttagaaacattagctcattaatgggatgaatcatactacattattaattatggttatatttaatggtaactcacgatggttaatcgtgttatgataattaattaataattaaaacctgattaaaggtgggttgtgagcacatggttttgatggtcgcgctcatgacaattaaggaccggttcacgagctactgttgtgaaacatttaccgtgccaaccacaagccagcgtgggcaacggctttaccttttgtatagcatggttcattatggggtgccagactgagaagcagcgagaagtccgtgggggtcgctggggagtccatgcctctggttgtagagggattgattatgatcgaggtgtggtgcactgtggtgagttgtgttgtgcgaggggtattgtcacagttcctttccgaggtatcgtggtggtattgaggcgcatggtaacatgttgtggagctatgtcttgtgggtacagtggtacatctctggccagagtaaaactattcgaatagccgtgcccgcggttatgggcgggtctaacaatgtttttcgtgattagtctcaccctactcattactggtgataacttgtgataattaaattgactcctggtttggaatggtatattcctggtatggaggtttgatttgtacaactggggttggctgttcagatgaggttgggcctatgcaacataggtgtgttgtatagtgtttatttaatattgcttaattacttaactgttttactattctctcaaatgtttattaattgctgtttatgcaaataagctttattatgccatcctttgttatcctgtgcacttgcatatctgctgtgtggcatgttgagtatgtcatatgctcattcttgcaatattcattcatcagaggaggagtacttcagtgaaggtgatggtccggaggattaggctttgttcgggtcaagttgcttgtggagtggagtcgccattgtggagtggagtcgccatagctgttcagtcttttgtttttatttccgctgcgtagaattctattcttttgagaggaactatccaccactgtaaaaatttattattttgcgaatattaattaactgtttgatagtactctattatcaatttgttattgtgtgcctcggctgattcctggaggtggatttaacacgcatgtaagcgtttggaattttggatagaaattctgggcgtgacataggattcatagctgacgccggtgctcgctgaattgctccaaatttctgacaatcttgacatcctttgtaatatctaaaacaatcctccagcattgtcggccaaaaatatcttgcacgctgaagtaaccacttcatcttatgagccgattgatgagtaccacaaattccttcatgaacttcaccgattgcaactttagcctgatcggcactcaaacacttaagcaacaccccatcaattgtccgataataaagctcatcatccaataaagtgtacttcaatgccttatatcttaatttcctagaagccgattgagatggattcagtaaatattgatgcacatcatacctccaatcatcagctgttattgctgcgacttcgaccttaacatctttgatcatcggcttataccccgacgccccttgcgccaaatcattagcttcaatattctgttctcgggacacatgctttaaagtaaccagcctaaattctttcatcaattcttggcacttctcattacaaaccattaatgtatcatttttgcattcatattctcttgccaattgaatgattactagcaaagaatcccccattatttcaatagcatcggcttcaacttccttgagtaattgcaaccctttgagcactgcctcatactcagcttgattattagttgcataaggtttgatagtataagcaaactcgaaacatgtcctcctaggggaaattataactaatccgataccacaaccatgagtacacactgatccatcaaagaataaagtccatggcacaatttcaactgagccgattgaatcatcacgatgttccacaataaaatcggctatagcttgccctttaattgccttcggcgactcatatcgaagatcaaactcagttaaggaaaatatccactttccaacccttcctttcaaaatcggagccaataacatatacttgacaacatcggccttacatatgacagtgcactcattggatagcagataatgcctcaaccttgtacatgaaaaatataagcacaagcataacttctccacaggggaatatctaatttctgcatccaagagccgacgactgatatagaatataactctttcttttgcttcaagctcctgaatcaaaactaagccgattgacttctcaccggccgatagatataatctaaaaggtattcccttctgtggaggaattaaaacaagaggagagttaagatattccttaatattatccaaagccttttgttgctctgccccccaagtaaactgctgattggctttcaatctcaacaatggtgtaataggctctaaccttccagacaaattagaaataaaccttctaacaaaatttatcttgccgatcatctcttgtagttctgtcttgttctctggaggctgaatcttcttgatcgcattaacactcctctgagtcacctcgatccccctctcatgaacaagaaatctcaaaaactggccagccgatacaccaaaagcacattttgtcgggttcatcttcaggccatattttctggttctctcaaagactttccttaaatcagctatatggtcttctatttccttagatttaacaaccacatcatcaatgtggacctcaaccaaccagccgattagatcatggtatatataattcatggctcgttgatatgtagctcctgcactcttcaagccgaaagtcatcacaacccattcaaataagccgattgcaccaggacatctaaaagctgtcttatgaatgtcttcttcggccataaaaatctgattatatcctgcgtttccatccataaaactcaaaatcttgtgccctgacacagcatcaaccagctgatcggctactggcattggttattcatccttcggggtagctttattcaagtttcggaaatcaatgcacaccctgaccttaccgtttttcttatatgaggaactatactagaaacccactcagcatatcggcaaggacgaataaaaccagcatcatataattgtttaatctcagccttgacaggttcaagcatatcagctttgcatctcctcggaggttgttggtgtggcctaacccctggtttgataggtagccgatgttcaacaatcgatcggctgagtccaggcatttcataatactcccaagcgaagcaatctatgaattctctcaacagctctatcaacttggttctaaattctgcagataaattcttactaataaatgtcggcctaggtcgatcacctggacctatatcaatttcttcccaatcatcggccgacataaaaccctgtccttgtttgtcatcgagatcatctactgtgtccttgttgtagacatctgaaccctccacaatgccctcaaaataatagcttgggttctccatcttcaattggctatatatcagaatcagacacttttaaaaaatctccatcccaaacttttccagataaacaatcaagaccatccatctcccaaagagctaaatcggcactggcaacattgactgacctgtcggctagcacaatttcaatcttgtcaccttgccactgaatcaagccttgatgcatggttgaatgaatgcaacaattagcatgaatccaatcccttccaagcaacaagctataagaacccttcccatcgatgacaaagaacattgtagggatggttttgttgccgactgtcagctccacattcaaaactcccttggtttctgatggattgccgccaaagtctttgagcaccatgtttgtcttgatgagatcttcagcatttctgcccaacttcctaaacgtagtgtaaggcatcaaatttactgcagccccaccatcgaccatcaccttggacatcggcttcccattgacataaccatttatatacaatggcttaagatgccgattctccgtcccctctggcttctcgaaaactgcctgctctggtgaaaaaatcaacttagccgattcttcttcaacttcgtcaatatcttcttgcttaatcccagattcggcaggcaatgtgaaaaccatgatgaccgaagcagctacaacactttttcctttggccaacctttttgcttcatcggctgtggcttcctcagctacaggaacttgattcttaacacgccactcctgcttcggctttgtcttcttcaaccgatggttgatttcctgctcgacttcctgaaagtgctccctgctcctcaatctttgaacccttctcttttgattctccgtaaagataccggaaggacaccattgagttttcctattttcatcgtcctcctagccatgatcttggttcactagacccaacctttgatgaacaggaagtcttgtctgctttagccgattgcccctactatatgatcggcttgagctcttcgcaacataactgcacccaggacagtcctcaatagacggcagcctcatacgttcattccagcaaaatctaaagaactcgcaaccccaatgaggatcaaagccatcgtcatcttcttcataatgcttctcctgctacttttcatacctcctctgatatttgttgataatcttagccgaatttacctgaaaacctcttgcacgacccctatcggttgttcggccagctgtatgcaccatattaacaggaaaggattgccatcaaccttcatcggcctcttagagtcatcaaatttgattttgcccccttcaatagccgcttggatctgctgcctgaagaccttgcaatcattagtcgtatgagacccagaattatgccacttgcaatatcttttcttgcccaattcctcagccgatggaattgtgtgaccagtaggaagttgaatctgcttcttccggagtaacaagtcaaaaatcttgtcagccttagtgatatcaaagtcatacctctcctcttttctagagttctttacccattggcatggtataatctttttgctccttacccattcggctgcagctatctcagaatcatcatcctcatcgtccgacccatacatgtaaggacatacatgattaaccttcctagaattcttcctagcctctgcaaatctttgttcatgcaaggttaccttctgtgtgagatgggacaagctttcaaaatcctcagatgagaatttctccctaattggagcaatcataccctgaaaagctaaatcggctaactgggcatcagtcaaacttaagctgtagcacttattcctcatctccctgaatctctgaatatactcatgcacaggctcatcatgtctctacttgatcgatgtcagatcggacaatttcatctcgtgaaccccactataaaaatagttgtgaaactatttttctagatcggcccaactgttaattgatccatatggtaaagaagaaaaccaaataaaggccgatccagacaaagataaccggaacaacctaaccctcagggcatccacagccgatgcttcaccacactgggctaaaaatcggctaatgtgctcgtaagtcgatgtactatcttgtcctgaaaattttgaaaattctggtgccttaaaccgattgggtagtggaaccctctcaaaccattcaggatagggttgtcgatacaaatttccagcatctttcggcctaagcccaaactgctccttcatgacatctgcaatcaaatctgcccatggtcgttgttgaggtgttccttgaggttgctgtggcatagcctcccatacatgtcattcacactctcatgaggcaacatggagaatgtctcatattggatcttgaggaaatgaagcttggcatccttgtactcgcttctggcctcatggatctccgccaacttgttccaaatctcatatgcgatctcaaggttgctcactctatcgaactacttttggctcaaagagttgaacaaagcattcatggcttgggcattgagttggaggttccggtgatcaatcaacgtcaagggcgtgtcggtgatagcaaagcctatatccacaatactccaaatatggaagctcatagctttgaggtgagtagacattttaattttccaagtggagtagtttgtgccattaaacttgggagccttccttacatggttcacctcgttcgacatcttctttctaggcgctgaagcccaatcaagagagaccaagctctgataccacttgtaggatcgagatgtcgactagagggggggtgaatagacgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaagaatgtctctagaaatgtaaattgcataaatgtaaatgcgacaatctaatgagacaacgagacaagagatttttcaccgaggttcggaaactcgccggtttcctactccccgttgaggcgagcccaactccgccgctcaaccacgaagtcaccgcacgcctccttcgtcaaggggtgggcaaggcgcgagccggcccacggagaggactaccccaagcctcgatcactagggtagttcttccttcactccgaaggtggtgaactccaaaccactcacaatcggcgccgggcctcctccacaatcttctcggagagatcactgggcaactcctccacaagccgtttaggaggcggcaacctccaagagtaacaagcaatgacccggcatggagatgatcaatcaagtgccacactagctctacaaatggaagcaatgcacttgactcttggctaattaaccctctaacacactagatggatgaacataaagttcaagtgggtgtgagagaggtgcaaggggtgtatgcaattaaattgagtgttgtatgcaattgaattgagtgccaagagagttcccttgctgctggagggggggtatttatactcccaccaaccaaaactagccgttgggggcgaaatcccccaactctgtgctctgccggtctgaccggaggtatgtggtcggtcagaccgtgctactctacaatggctagttttctagccgttgtagggatgtcattgggccccacagccgtagccggtcagaccgacatggggtggccggtcaaaccggcctcggctcggtcagaccgccatcagctcggtctgaccgaatacggctccggcggctcgggatcggcacaccgggatggcaccatcctggccatatggccggccggttagaccggcattgaggcggcgatcagaccggcctagaccctgcggtcagactagtgcccttgccggtcaaaccggcacttgggccgtggtcagaccggccctggtcaggccgaaaacagtgagataaatgattgtgtgtgtgatgaaatgagaggacaagtctaaatgcataatgacctaatgtggcaattaaaatcatctctttgctaggtcattacccctcttaatagtacggcaaagctataaataaactagcacaattttgatcgcccaacgcctcgagcaatttaaaatgaaaacacttgtttaccgtcttctcttccttttgctttgcgccatcaattttaatccatcaatgatcatccatgtgcacacaaataactgaacctaactcaaacaaatagctcaaacacaacggttagtccacaattagtgcttgtcattaattaccaaaattaacaccggggcctagatgcttcaatctcctcctttttggtaaatgatgacaaacaccacaaatatatataatcaaacatagagcacatggacatatattgtaatgacaagcaaaagctccccctaaacatatgcataacaacaatagcaaatatggagccaatttcaatttcacatttcaacatatcacaaagacaagagcaatatctcaatgtgaacttcaagaaatattcatccatgagcataagatggtcacatatatatcaatatcacatacaccatccatcatcgcacaagttcacatcacttaaccattcaactcacataagtcacacatcatcctaaaagggctcacaaataaacataggctattacaagaccatgaagggtccaaatgacatagagtttaacaaaacgataaagaacacacaatatagagtaatagcccatacccatacaaaatatagcccaacacaccttaacctattagatatgaggtgactaacctcactaccactagtcctaacccacaagacataaagcacacctaaggacatttttctcccccttttggcatcaagtaccaaaaatgtcttcattcttgaggaggagaaggaggatgcaccgaagaggaaggatgaggagcatcacggtggcagtgatatacaaaagcatgggtgctctccaacatttggactcgagaatgcaatgcacccaccctagtttgcaaccttcccactgaagtattcaagttgccaacatcggtacgcaagccacgaacatcctcatgaaaagcttcatgcccggtagacaagcgttggatgctttcacttagggtattaatagccttaagtaccggattgaagtattcattgggttgcgttccaaagtaggcatattgtggatgaaagaaagcacatggatcatacccatgaggaggaaggggggttgcacttgaacaccaaatccgaatcaaacccgggttgaaagagaaatcgagaaagtaatggctcaaatgactagagagaggagcaagccaagggcacacatgtttgcaatgagagcagcagccctcacaagtgaggggagtgggctatttatacccacagctccaaatctgcccattggagcgcaataattctgattatcgaaactttcaaaaaattccagatctgaaaaattcgaagtcaacgcacttttcggaacttctgaaaatacatccgaaagtacatctgaaaatttctagaagcatatttggttcgcagacattttcggaacttatgaaagaacttccgaaaatttccagaagcttaaaatcggttatgtgtatttttggaacttccaaaaatacttccgaaataacttccaaaaatttccagaagcttaaaatcggttctgtgtattttcggaacttctgaaagaacttctgaaaatttccagaagcttaaaattagttctgtgtattttcggaaattccaaaaatagctttcggaacttccaaaaatttccaaaacccaagagagaaatgcttcgaagaaaaatagattttgagcacatgcatcaccccttatatgtctatgcatcatcccccttaatagtacggctttcctatgactcaatgcaaggtaaaagatacaatatatcatttgatcattgctgtattgcatcgtggcatcgcattcaatggggtatacatcacattacaagacgtcgaggacataacgaccttcacatttgcttgaataaaaaagttagacctctctaatcgcattgtaatcaatcatcaaaatcattaggggcctagatgcactttcaattttgttgggctcaacaactatcaagtgcatctctgatacttaacgatatactaacaaatagtcaccgattactgcaaataagctttaaagaacagcaaactatcatcagcaaacaacaagtgtgacactcccagcgcacgacgacagactttcaactcatttagttgtccctcctctaccacctgacataaaatacgagaagggccatccgccacaaataagaacagataagggaacaagggatccccttaccttagtacctgtgaaggagagagaatccagtaaggaaccattaaaacaaacctagtatttcaccgttgttacacattccataatccaattcacccgctgctcgcaaaaaccaagtttcatcagggcgtagcttcagaaagtcccaatcaactatgtcatatgcttttgctagatccagtttataggcacaaaactgactaccattccctgaagctctttgcatagagtgaatacactcaaaagcaattagtgcattatctgtaatcatacgtctcgaatgaaagcactttcagttggggaaatgatatcatttagaatgggtcgaagcctattgaccagacacttagataccactttataaatgacactacataaactgattggactgaaatttttcaactcaaccggctgatttatctttggaatcagaacaatgtatgtattattcacccctccaggcagaagtccatatgagaaaaacgtcctaacaccagcagcaatctcctccttcagcacaccccaagttcgctgaaaaaaccgggccaggaacccatctggtccaggtgccttcaacggtccaatctgaaaaagcacatctgaaatttcgtcatctgaaaactctttgcagaggacctcattcatggcgtcatctactgctggatttatgagatcaattagttcatccgataccactgaatcatctttggtatgtaacttttggcaaaaagaggtagccatcttttccatttcccccttattctccacatatctatcatcccaatcttttaatttcttgatcttgttcttcctcggacgccaagctgcttgccggtggaaatatttggtattgcgatccccatcctttaaccaggaaactcgtgatcgctgcaaccacatcatttcctccatgtacagtagttcatccatatgtctgaatagaccattgatttcctctgcattgcccaatggatcaccgactgaaagtccttccactttcttcctaattccatccagttccttagtggcagagccaaacgatttgcggctccattctctaagtgttccaaaactgagttaagcttttttgcaacctctcccagatcatgcgctttgattctctgctcccatgcaagttgtatcacctcaggcagagtttcctccctttcccacatgatctcgtacctcaaacaacgattgcttgaaggagtttgctctttctctaccctaaggaggatcgggcaatgatttgatcttggggagaacaaatgtgtcaattttgcatccgagaaatggttcatccaactgagcgacgctactgcacgatctagccgtactcatacattttgatcacctttttgcttgttattataagtccatggtgtgccggaaaaaccaacatcatgcaagtcacaatgagctagcacttcccaaaaatttgccatcatcttttccgaccttcttcttaaagaaaaatgttcaaaagactacattatctcattgaaatcacccatcatcaaccatggtgcattcgaggatggttggatttgcagaatcagttcccacattaaatgtcggtcttgtgcttttggttcaccatagatgaaggttcccctccactgaactgcatctcctgattccttgattaagacatcaacatgtgcgtggctcatggacaggagatctaccagcaagccttcttcccagagaagagcaataccacctcctgacccatcactcatcatagccaaacagttccttaaacctagtctccacctcaacttactaatccttggttcatcttgtctagtttcagataagaacacaagcttaggcctatacttctgcataaggcagataagttcgtgaactgtttgaggctgcccaagtccccggcaattccaagccaaagcattcattgctcctggtggggctcgccatgagctcccaccagatcttccttcgccttgcaagaattctctaccttatcacggcaactagcctcatagtaggaggtgttcaaacttgggtgttcctgttgatgattaaaatccacaacggtagacttgagcgctatcatggctcttggtgaaagtttgatggagcccttctttgatttcccaatatcacgcccccaattggccacctttggccttgatatcttccctccttctttaatggctaatcctttcttcttcttctgaagccaatctggagactttttgctggctacattgagattagtctcagcagtactgatcttgattgagttttcttcactaagctcataattagagcttaaagacacatattctctactacaaggtcctctggcctacaagttcagattagaaggcaccccgtctacctgcatatgctgcgcccctttttcaagggccaaagaaaccattggtgcaagagtttcctgggccatcttctcttcatttgcatgcccaactttagtaacttctgggtctaaagattgtcgtcttgggcttgcaaggttagaggcgctcccagccgataaaaccttgtctttctgagcaccacagaagtttaaaactctagcaaccttttggggagctgcaggaattgaaagcagtcgaagcgcagaccatttagttggtgaagctctgagttctttcccaaaacgcaccctattcaggttggattaatcctccaggcattctctctccacatgtccaaaacggccacaagaaaagcagaaaaacggaacattctcatactttaaagggaatatcattaatcctcttcccttcccacgtgctttgagctaaactttgagagcctcagctaatggatagtccactcttacccgtaggtaatctctcacagcaccacccacctccaaaactttacctagcttttcacccagatggtgagcaaaacccgttatcatcattgcctctagaagatcataaattcggacctaaatcgctaaagattcaatgacaacttcagaagggcgacataggccatcataagagacaataatgagagcatcacccttgtgtttccaggggcctccattcatgacacgataaaaatcaacctcatgatcaaaatcaattaggaatctattttcacctagatcccttgcagttctaaggttttgcaaaccccaagctgtgctcatctcatcaaacagacccttgacattataacgctgcgctgaataaaatcttgcaagagccaggaatttacatttcatctcctcctcaactttgccagatccacataaaaaacattatcttcttcctcaacgatatcctcatcatggttctcctcgaacaaaatgtcacgcccggaaattcactagtaatttccgaactaatttgtgcattaaatcctcgtccaggaatcagccgaggtacacaaactgacaatttaatatacaaattcatcaatataataacgttacatacttacaaaagaaaagaaaactgcagcggaattacggtctagcgaagctccggctccactcccataggcagctcaactggggtataagccaaacgtcttctccttcgcaacttgtcttcaactgaggtttgattgattattgcaaggtgagcatatgacatactcagcaagccacacagcaaatatacaagtgcacaaggataccaaagaatggcataatatagggctcatttgcaaaagaagcatttagcaaacagtaagaattgtaaaacagtagagtaattaatcatcaatattaatcaacactgaacagcacacccatgctacacaggcccaaccatcctgaacaaccatacccggctgcacagatctatctccaaaccaggaatataccattccaaaccaggagctaaattaattagcatcaattaccacattattattaatgaatagtgtgggactaatcacgaaagacattgttcgacctgcccataaccgcgggcatggctattcgaatagttttactctggccagaggtgtaccactgtacccacaagacacaacccaccgtcatggcaccgtgtccgcgcagacacgtcaccatgatgagtgattgtgacaagacccctcgcataactcaacctaaagcagtgcaccgttcctggatcataatcacccccttataaacaaggcatggactccccagcgacccccgtgggcttatctccaccacttctcagtctggtgttccgcaatgagccttcttatacaaaaggtaaagtcgttgcccatgctggcttgtggttggcacggttaatgtttcacaaccgaaactcgtgaaccggtccttaattgtcatgagcacgaccatcaaaaccatgtgctcacaacccaccattatcaagttttagtaagcacattaattaattaaccaatcacgattgaccatcgtgagctatcattaaatatccatcattaagtaatagtgaaacattagttatcccaattatgtgctaatgtttctaagcatggctaagcaatgatgtctaacatctagctgaaccaatatataaagctcaactaatcaaattataataacccaaggtatcaaggaatatagagtaatcaatgcaaacaggccataacaaaggaataagttcacaccacccggtgacattcgaaaataaatacacagttgaaataaatagagaatttaaatataggatcaacatgctcaaaggaactgtgtttgggatctgtgtgacttgccttgcaataaagggtcttcaattaatcttcttgaatacttccaacgcactcacgaaccttcgaaacgacggaaacgacaagctaacacgcaaaacgagaaaaaagactaagaaactccaaataaatagtacatataaagtaaacaaacatgtagatcatgattttagatgaatttagagacttgaacgacctcattccgatttcatatgaattaattacaaattttacaagattaaattccaattaaatctattaaagaaaagactattccaaattaattaaataatttacaaatgatttataactgagataaaagattaaaacaacctccggaaaagattagattatatttggtagatgacatatattaaaaagaaataatatgccactgaaaagagaggaaatgatttatattgattttggatggctaagattaatcttgacatagagttgaccaagattggatggcttggattgatctggcaagcgggcctcacgagataccaactcaacgagtcaattctacgtgacacgggatcactctaatgatcaaccgaaaccggcgaacggaatcggcggctctgaacggctctaaattaaaggacgactcaacacggacaaacgaacgaagcacggggaacacctcgttcgaacgaacgagcgaacgactcaacaacggctgtggctaaactggtggggtaaacacgattcacggtaaagcccaggtacggcaaacgataggctggtaggaacctagggttgcacctacggctagacaactcgactactgagcaacgagctaaagcggtggctaggtttaagtgacacacagctgcgacatagcggcactaaggtgacttggctcggctaggcggcggctcggcggaaacgcaaagctagggttagggtgacggcacagccgatagcgatgcacgacagcggcgcggcgactgcagtacgtgcactagggcagtggctacgcggtggctagcagcggacaacagcgggtgcggtgcacggcaatgaccggctcgacgctagggcggcgacgcggtggtagcaagcggatgcggcaaagcgacggcaacgctgcacggcgtgcaggcgcagcagcggtgacgcagcaaaggcgacgcagcagcagcggcaacagcaagcgacacggccgacgtggcagcatgcagcagcgacacggcacgcggtatagcagcagcttggcagagccagcgcagcaagcagcggcacgatggcagcaagcggcggcgcaaggcggcggcttggacagcagcggcgatgcaactagggcagcgacggcgcatgggtcggctgcggtggctaggcacacacggctacgcacgggctaaggctgcacaacagcgactacacgaagacacgattgcagctacacaaagattaaacctagggaacagaaaagaggcctcaccggggaagaccgaagaggaagaggcaacggcgacgccagcgacaacacacggagacgacgacgacgctagggccaaacaagattagattaaattaaggccctagggaaaaacctacaccggtgaacggtatgggagcggcggttgccggtgaaccacggcacaaatatgcaaacggagggcaccaggagaaagagcgcgaggcgacggtccttaccaacacttacgcgacgacggacggcgacagaagatagccggtgaccagcttggaagggcggcgaggtactgtacacggcggtgacgactttccggcgatgagagacgacaaccgaggggtggacaggcttcacttcgcagctgcgaatccaatggaggcgacggcgaagcttggcgatgacgggaggagcagcagggcttcgccggagatcaaaacgcgacggcgaacttcgggttgacggcgacgatggagctccggtggattttggtggcgacgaaggggcggacggggtgcagctccttcttgcgaacctgacggaggcaacggcgagcagcagcggcgaccacagcgacggcgcggggcggctggagacacggcggcgacggcggcgctccggttcacgacgacgggctacctccgattggatttggcgcaaaacaacagcggccggggtagagctcgacgttgcggagccgatggaggtggcggcgctgatcggcgacggccggggcgatggcgatatgcggctggagcggcgccggcgcttggagagagaaggagagcgcggggagaaggtttcgggcggcggcagaagaaggaggaggtggcggccgaaagaggagagggagggggctctatatatagccatgggaggccgggatcgagcccacaacgacgggaaaaactcgggaaagtctagggttctcgccggaaaaaggaaagattgaaccgcgaaattggaaaggatctccatagaaacttttggggattttttggggaaaagaaagaggagattgagaggattccattcccgcaactaatttggaaaaaggagcaacgaggtggccggattttggaaggggatcggcgacactgtgcacggcacgggagacagtcggctggaggaggaagatggagtactgtagcgaggggggggggcaaaacaaactttcggccgggctgagaggaagggagggaatgggctgaattcggcccaagactaggaaggatgattttattgcttttccaaataaattaaccaatgaaatgatctttcaattgttaaaaatacttccaatgctcaaataattccaagaaaactcttgaacatacttggacactcaaagtatttaatataataatatccagataatttaatgattaatttattatttaaataattactgaaatgttctttgtataattaaaattaggaattgagctccgaaaaatatgagaaaatttcagagaatataattattcatggagaatttaataaaaattaaatccagccatgctttatatttaggaaattttatttcccacatttaacttcacttgtaaattaataaacatttaatataaattctattaataatttattaaataatttataaattctgaaatggaaaattaggctgtgacacaaaactatcgcaccgttatgattatcttccggtttagatgcatgaccgaaagaaacaagtcaagcatcctccttctccacttgatccttgtccaccatatgcacttcgcccttgccggcgtcttcatggtttgacatggaagcccacgtcctgcctgtcgacgatgatcaagaaacacagatgttcctgagtaaacatcgtcctaccctagacgtcccactaacaaacggcttcgggcgggtagaatcctcaccggaatccccttgatcgcccacaccgatgttagacggcgacaccaacgcagaacaggttacaagaaacaaagaagcaacaatacgtagagttagggttaccacgtcacttgcacagaaatttgtcgtcaaccagaatcttccaagaatcaatcttggcagtagcagattaaaacaacccgagtcgctcccgtcaagatacgtagcagtagttgcaatccaaaacagattaagagaacttaacacctacgaatcacaaccaaagatcaaacgagaaaccacgttgatcttggctaggacttgtcagcgcttcagattagagatgagcttccaagatcgcctcctagtcaccttccgtagattgcggacacgttgttagctgatgttgtcgttctattagtttttctcgggaaatttaactatttaccactcttgtgacatggcaattaacgatttgccacatcctgtcaatgacatgtgggcccttatgtgtctatgacatgtgggtctagtggcaaatcgttaagcaacatccgtaagagtggcaaatagttaaaagccccgtttttctcctgctctattcaattaaattggcactgtcttgtgctggttcattaaaaaaaagggaacaattgagagcgccttgtggcctgatggaggcggagtgcgagcaccgggagtcgcgcaaggagcgagggactggcgagtaggggtcacagtgcgatggtgatgctacttgctgtcacgcccagaaattcacgaaccagaatttctaagctgaatgtgcattaaacctctatccaggaccagccagggtacacaaacgataattgttgacatatatatccacgacttacaaaaaaaatataaaagattacaaatgcagcggaaaagataaaagcgagctaagcctgacgacttgactcctgcagcgggcgactccattccacaggcacccttgatggcagcgacgaaaccaacttcctcgaaacagctccaactgagaagaacttcaactctgatgtggggaacagagagcaagactgagtactacccactgcaattagcaagtcataccagaaggggaggtatgatgcaagatatatccaaaggaggctaaaggttcttttgcataaaacatgcatttaaaagcagtagttgaaagcagtaaaacagttgtagtaattaattaatattaaccaatcactgctcaacgctacaccacgttgagacaggcccaaaccaccacctaaactaaccagttccattagctaactaggggtgagactaatcacggtgaatctgattgaccgcccataaccgcgggcacggctattcgaatagttttactctgatcagagatgtacaactgtacccacaagacacagccccacaacacgtttctgtgcgccggcatgccaccacgacataccagaaagagaccgtgacaggacccttcgcattaccccctctaaccaaacacaccacacctcaggtttcacccccactcctcgcaagacagcgggcagtcccctctcatgcctaggtgaatccgaaagccacataggccatcgcagggcccatccgaactccatcacgctcacccttgcctggatgcgtcagctagaggaaagccatactacatgcccagccgttgcccacgctagcttgtggtaagtacagtaagttcttcaaggacatcccgcgaactggtccttaattgccatgggtgcgactcaaaaccatgcacccacagcccaccatttagtatattttagttaaccaacactagagcggtggctctagtccaacaccaatattagaatttgaaatctatgcattaatgtagttctcccattgtgtgctagttgagctaagcattgctaagcaatccctaaccgaacatctaatcttgttatatccccaagctaacaaaggaacaagataaccaatagtatggctgagacaataggtaattatcccatagtaacattataaaacaatgcagtatttaaggaaaataatagagcatttgcaatatgggaccaatatgtttaagtgacaagcatgacttgccttgctctgcggctggagggacctcggcgactatctcgaagtacaccggagcgtcgggagagcaggaatctatgcgacatacaaagcaaacatgtcacgccctgaagctttcccccctttttcttgctttaaaaattggttaaataaattgcccgaagaaattatcttaattaacctagagctgatttcctatctaatgaatgcaattaataattggaaatggcattgtggaatttttcttgggttccccatgctccaatacattaacaggatttttagtggaattttcagagccttggaaataattttaaccaattaaaaatgagcaagggcaattttaaatcccaggaaaaatcctttcttctttttctttttctttttcctcctttttcctcttcttgggccgtcgacccacctttctcctcccgcgtgccccttgctgggccggcccgctcctcccttcccctccccgaagtcctccctcacgccctctttctccgggacgccgacaggtgggccccacctgtcggggtcgtccccttcctccagccgtcgaaaccaccgcgcccacctcctccgctcctcccgcgcccacaccgcgccgctcccgcgtcctccccacatcgccgccctctctcccgcgtctcccggcccgcacgcgcgctcgcaaggggcgggattcgaatttgaatccccccattctctctctccaccccacgtcgccggcgaaatcggaggctttcccggccacgacggcttccccctccacctataaattgctcccccgagcctcctcttccccttcccgctctcgccgccccctcccgtgcctcctaccgagcccgcgccgctcgccgctagcgccgccgcttgccgccgcctccggccgcacgccgccgtcgcaagagccgtcgcctcgccgcgcaatcactgccgctagcttcgccgccgtgagagctacctcggccgccgctcgctttccgttcgccaccgccgtaccgctctccctacacgccgctgcctactaccgcctccggccgcgcgccaccaccgctaaagccgccgccgcgccgtgaaaccgttgccgtcgcgctcgccagtgtcgcccgcacctcggtcaccactcggttgccatccgccgccgccggaacccgattccctcgcatcgccggtgaggaccccttccctccccctcctttcctttcccttccagcaagcgccgagccacgccgccgttccggccgtgcgccgtcgccttcgcgccggccgccgccgcctcgccgtccgccggtcgtcttcggaggccgtgtgccgccgccgccgccctgccatggtcggtcggcttgagccgtgccgagccaccatccactccccctcccgccttgtgccgctgcccggtgggcctcacagactggtggaccacccctccccttgagccaccagccggcgccccctccctctccccttgtgccgctgacaagcggggcccgcatgtcggcgccgccccccccctttgatgacgtcagctctgggtattattgcgcaataaattaattaaggattttttctttgttagtaaaaacatagtttaccttctaaaattcataagtaattcatccgagctccgtttaagtccattcaagtctcagtaaattcataaaaatgcaaagaatccattaaaaatggttttgttccctgtttcagtagtcttatagtatgttttgcttgtgtgctttgtttgtcgtgtagatttcggccgtttcgtcgatccgcagtttctcgaagacgttgctgaggtctcattagtgcgagagcaaggcatgtcatgcattatatttgatcatattgtaccctatttacaaatatcccgcatttctattaaatgttgcattctttttcaatgttatgtgggatgggtcctattactcagccatatattgtttaccatatgccattgataactggggtatcaaaatgattagatgttggtttaggaaatgcttagccatgcttagttcaactagtacacaaaaggggatcacattattacatagactctgactatgagcatagttttggtttggtgccaccgcaatggtgttagttaattaaaatacaccgaatggtgggttgtgggtgcatggttttgctggtcgcacccatggcaattaaggaccggttcacgggaaaccctgggagacttaccgtgcttaccacaagcaggagtgggtaactgcttgatctgaagtatagctcgaccctttcctaggcaccagtggcgagggtgggcgtgatggagttgggtcggccggggtgtccggttgtccaactgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttctgggtacagttgtacacctctggccagagtaaaactattcgaatagccgtgcccacagttatgggcgatcaaccagattcaccgtgattagtctcaccctagtttagcttaatgaactggtgtagttcaggtggttggttgggcctgttgcaacgtggtgtagcgttggacagtgattggttaatattgattaattactacagctgttttactgctttcaactactgcttttaaatgctagctttatgcaaaagaacccctagcctgctttggttatatcctgcatcataccacctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcaccccgctactgaagtcaagcttctcggtttagctcgcttttatcttttccgctgcatttgtaatcttttctatttttgtaagacgtggatttgtatgtcaacagttgtcgtttgtgtaccctggctggtcctggacagggatttaatgcacattcagcttagaaattctggttcgtgaatttctgggcgtgataaaataatacaaacaggctataagactactgaaacagagaacaaaaccatttttaatggattctttgcatttttcttgatttactgagacttgaatgggcttaaacggagctcggatgaattttctatgaattttagaagattcactgcgtttttactataaacaaaaaaaatccttaattgatttattgcgcaataattaaaccctggagagagagagggtggcacgggcccggctcaagccggctcggcggccatggcgcgcggcggcgcggtttgacgcagcggcggcacaaggcggcgaccggcggcggagagcggcggcgacacggcagtgcgggcaacgctagcggcggaaaatgagcggctaggcagcggcgcggcggctaagtggcgcgggagagagagagagaggaaggtgaggagttcctcaccggtgacgatcaatgatggtgagcggcgggatgatgatggcgatgagtggccgagcttcgggatcacctaaggaacacaatgggaaagattagagagggagagagagatcatagaggacggggacgccggccgaaggcggcggccatggcgaagctcaccggcgtgcggtgcgaacggggctccagcggtggaggggctgacggcgtggccctcgggctcgcgaatccgatggcggcgatggcgcggctcagcgcagcggctagtggcgaccgaagctacggcggcggcggcggagaggagggcgactgtgctagggcgaaggagggcacgggggagctcggcgaaatggggaaaaagagagagggaggggcggtggtgcttaaataggggaagagggggctcggggaggctgggagtgggctgatttcaccggagtagtggggaggtggagagagggagcggggcgcggggaagacggcgacgccggcggcgtggcccgggaggtgcgggagaggcaggagcagcgatttcgggcacgggcggcgccagccagaggttggggacgggcccacctgtcggtgacccgaggggaggaggggctcgggcggccggctgatgggccttggacttcggccggcccaactggtagggggagggggaaagagaatgggccagcggcccattaggaaaaaggaggggaaaaagaaaaagaaaaagaaaaaggagaaatgaattttcagggattaaataattgctcgtgctcatttttatttggttaaaattatttctaaagctctgaaaattccactaaaaatcctgttagcgtattttgacacgtagaactcaagaaaaatttcacatgtcatttccgattattatttgcatttattaaattaaggtttctctcttgccacttcacaaataatttctcgagactatttattaattaatttagacttgggagaagaacttcggggtgtgacacttgctccctccatcccacgccatggcttcgttgccggcgagcagccggaagggaagaagaaccaagggtatttttgtgtgagatgtcattgttttcttttttgacgtaaacatagtggcattgtggcgatggcaatggcaaaatctcggatttctcgccgtatggtatggtacggcagacagagtacatgaaaagtggttttgctttgcttggtcgtctccaaattgaccatggcaatccaatcctattcttactcgggtcgggggtcagagcgcaccgcatatcgcatcatttttttcgggcaatccaatcgtataggtttccactacatactttcccatttttttcttacactttggttctataaaacgccgcacatgacgtcgaaagtcaccccgctatcgcagcaatccaaaatccccaacccaacccaacccaacccaaccgcactatcacgccactcttcgcccgcccgcccgccgccggaatcgccatcgcccgaccgccgccgcgttcgtgtccccacaggcggcttctctccctgcatcaccatgggttctgacttcaaggcaatccccttgatcggtaagattcagattcagattctggaatcctgcgtgggattcttttttttcttttacctgctttgccaccaccagttgcagttagttcaattaaccacagattacgactgcttgtctgcaaaggatactagatacagcttttgtagaattttgtgtaaagatacttggtgggatgagatgatatatgcttgtactttgaaatctccatttgaagaattcctctatctttgttcatttgtcagacattagtccccttgtcggaaagattgatgatccgagcatggtcaatgacgaggatttgctgcaagttgtgcaaatgttggacgatgcctgcagggaggctggattcttttatgtggtaaaatttacttatttacttactagcctacttcagactttttagcatcagtttactacaatgggtacagcagactagctacacaatatcaatcctaatcaaatggtgtctgtatgttactaacagaaaggccatgggattgctgactcgctaatgaagcaagttagggatgtgacacagaagttctttcagcttccttatgaggaaaaactcaagattaaaatgacacctcagagtggatacaggtgtgatataaaatgacagcttcaacctgtttttaagtttccaacatttttccttgttccacattggatccttctaatcctccttcctgtataacataactttgttgtctttactgtcagagggtaccaaagagttggtgaaaatattaccaagggtaaacctgacatgcatgaagcaattgatgtaagtttaattttctctttattatttttttatcatccattaatttgttcctgagttaatccctggaagaaaaaacatcacagtgctacacgcctattgaacctggtaaatatggagaccttgctaaaccaatggtaggatctaatttgtggtatgtatccaactctccatctctgtttttttcctacagcactgtattatttgacatatgcgagacagatattatgtacttgactttgatataaaacaataccccagttttgatctattgcatattttaataatactcacaatataaataatttagcttatagcacacctctatttggaagaatgtgagggaataaaatttatatttacaatattttatctagtaccaacatgtattatgttacaatatgggtagaattatgaattatagtaaagaaaatagaagttatggctacaattgtacttgcatacttcaatgtatttttgttactagaagcatattaaatagttggtactaggtaccacagaattattgcttgttgaattacttcagctattactgaagaagttctgaactttggtagactgcctttgagtattttaggtcagagatctatcaaaattcaaataaccggttcatttatttttatgcaggcccaaatatccatcaaattttgatgtactgctggaaaactatatcagccttctaagaggttaacttctatacttagtttaaatctttatttgtgcatgtatgctattgatccatttattatttgttacttatgagtgacagcatttgttatgaaaatttacttgtagatctttcaagaaagatcatgcgaggtatagccttggcgttgggtgcgccagttgatgcttttgaaggtacaaccgcaggagatcctttttgggtttgcaggctgatcggttatcctgtatcaactgatattccagaagagcagcgcactgatactgggtggtgagcaaattgtatctacgtttttatttggtaatatatcctgcaaatcgtgtgtattgagtgtagagtcatctgacactgcttttcttttacatggcatccattctacgatcaattcagtggagctcacacagactatggttagtacatatctttcaaaagttctgttggaattgaactcatatgtggaaatacgcatatatgtttctttgattgatgtattgtggaaagtttgttttttctttatttgtgttttaatcctaaaaaatcagtagaggttatatcaaaaccatggggatcatatttatcatttgttaaatttgtaggtcttctgacattggttaatcaggatgatgacatatgcgcccttgaggtacttatttcttcaccatctaatacatatcttataggaataagtcatgtctttgccctcgaactctactcagattccaattttcaatgtggatttaaaaaactggttgtttatcaccagaaatctggacaaatatcattggttaccctattcagagattgttttaattgagatattttatggccacactgtttgtttgcttggtggccttttctccttgcaatttcttatcgccaaagttatttccatgttatctctgtctagtaataaagaagaggggacgtagaatggatagaagataagaacttgatttcagattgttttatttttcattagagtgcagtgcatctgagctgggcatctttgtacagaatttgactcatataacctaacaagagatacttctctacttttctaacattctacgcatcttctaagatgcattagtaattaggagtatgcaattagcatcttacagtttcttcccactgtccatatttagcctgaaacagggtgaagcaaacaattttgatccgtttgtaatatctggtgaatatgtttcaggtcagaaaccaatcaggtgaatggatatatgccaaaccaatcccaggaaccttcgtctgcaacatcggtgacatgctgaaggttcttttcttcctttgcagtttcactgatatctttatggtcatcaaacatgagacgcttatcaattgtcttctttggttaggtttggtcaaacggaatatatcagccaacacttcatcgagttgttaacaactcccctcgctaccgtgtatctgttgcattcttctatgaggtatgtcttgcttaatctctagtctcaatcctacacatagtttatgtgaagttgatttctcatgttctttcttttctttctgaattttgaatgctacagtcaaacttcgatgctgccgtagagcctgttgagttctgccgggagagaacaggtggtgttgccaagtatgaaaaggttgtgtacggagaacacttggttcagaaagtcttgacaaacttcgtcatgtaaaatttgtggaaaagaacatgcattgtactccaatgtctgatcgcaacattcgtcactaaaataaaatcatttgtaaatttgtcatagcacagtagaacagtcatattgaagaatggaatgcatccttaattgaaatcacaagcgatgtgaataatcttttcgtgcatggcatagatgtgtagatcatggaatgattgcagttacttcttgttacatgtcccagcacaggaggaagatgagtagcaaaaactaaatcagaaagaaaaaatctaaaatcaagttttcctaatagacgcacacttatgaaaaaactcacgagcaaactaccgaacacggacgtagcgggcttaaacataagcgtgaccaaggcactaccttttctgtcttatatactccctccgttgagtttcatttaaaaatttaatacaaatatgaaagtatataattactagaaaaatgcccgtgcgttgcaacgggtgaaaataatctatctattaaactataaagatagcttaaaaatgacacgatatttgctttgaccacattgaaattgttacattaattaatagaaaaagataatagttgtatatacattatagaatgattgtatttatagtaaatgtcacaaaactaaaattatttggttaaatccaattatgtttttaaaatatgttactgaaaggaccttgatgtcgcctagaggggggtgaattggcggtttttaaaaatgaatacggaagctaaaacaaaacagggtcggattgtctgatatgatatcaggtcggatagtcctatgtgatcggattgtctgaactgagatcagactatctgacctacacaacaactatacaaacaagagaacaacctaagagttctagattatacacaggcaaagaggtgagctcagccaacaacaatattagcatagcacaaagcaatggaacaagaaggtaaagagagtgaagatatcaccgaggtttacacgccgatgtatttcccggagttcaaatccttgaggggattctagtctccgttgaggggctcgcaaagagccgggcctttttcaaccctatcctcatgaggttgcacaaatgcactcctccttccactaagggtatctctttccttgtggaggcgagatccggccttcataaacttcttttggccaaccacacgtagatcggtggcccaagaataacacctagccgtctaggagtcctcaacctctaagagtaataagcaccacagaactcttggacaaatcctaatgctcaagatcaagagaaacacacactaggctcccaaactccaaatccacacacaaagatccaagtcacaaagaacaaggaggatttgagatagagagggagagagcttaaagatccaaagcacttaacacaaagctcaaatatggggggttttaagaatactctgcaagaggatccaaatatgggtgttggaaagccaagagggaaggcagttaaaaagctgaagcagttggctgaggcaagtggaattgttttcccatctgattctctatcttctactgatttaaatcctgatatatcttgtgaatctgaaagtgatcttacctctgttatacctgctgattgtgatatatctttgcttcaaaagataggatctgagatgtgtgagacttccgggtttcaagcttggtggacttgggagatgttcaggtcatcaagccaaaagctattggaccatccactgatgaagcctagttctgtcaaacttttagggctgctagtggcactctttaggggcatgtgtttatccctatatcagcccttttattttgtgtttaagttatgtaaactctatgctggtactatgcgttggtgtgcttgggatctgcatggattattcctgcttgttatctttctctctttaagactagttatcaaatgaattcggttatgagaaattggaatgtcctccgctggaatgttagaggtctaaattctgatgacaaatggttagccattagaaataaaattgaggaaagtggctgtgttgttttttgccttcaggaacaaaaagatcctcttttgatcattcttatataaagaagtttgctcccaaacgttttgacaagtttgctttctctccatctgttggagcttctggtggtattttcgttggatggaatagttcaatttttgttactttcacctcaaaccattctggtttggtatgtactatagtttcagtttatggtccttgcactggtcctgaaagaaataatttcctgtcctggctccaccagttgaacattccagatgatgacctttggctcattattggagactttaatttttatagatcggttgcaaatagaaatagaccaggtgcagacatgaatgacattttcctgtttaatgcaatgatcagtgatctgggtctggttgagctgcccctcaagggaagggctttcacttggagtaacatgcagcatagtcatttaatagagcaattggattggttctttacctctactacttagaccttaaccttcccccataccatagtaaaaccacttgctcgttctacttcagatcacataccttgtgttgtgcaaattggaattgacatccctaaagctgacatcttcagatttgaaactttttggatagagcatgatggtttctttgatttagttccatttggcaaaatcatgggtatgaaggtaatgcagccaagaatatttctattaaattgaagacattgagaaagggtttgaagaagtggagtaaatctgtctctaaacttcaattgttgattaaaaattgtaatgctgtcatagcttttttggactccattgaaaatttgagagatctcactttcttgaatggaattttagaattcctatcagaaacaagctgttgttatacctaaagtataaacaaatttattggcaaaagatgtgtaccatcagatgagccaagtttgggggtgagaacacaaaatttttccatgctatggctactgagtcttatagaagaaatgcaataccttctttagtagactcttctagtttagtctgtacaagacatgaggagaaggctcacatagcttggagtactttttcttcaagaatgggttgttcccagtttgagtttatgccttttcagctgcaagattttttccatgcaaatcaatctcttgctagtttggatcagccctttggtatctctaagttggacaaaattataaagaatttgcctatagacagggctcctgggcctgatggatttaatgggatgtttgtgaagaaatgttggccaatcatttgtcaggattactacagacttgcagctaaattctactctagtactctggacctggatcctttaaaccattcttttatcatcttggttccaaagaaatctgtgcccgaaggtataaatgactataggccaatatcactcatgggaatctctcttaagattctaacaaaaatcctggctgatagactgcaaaaggtgatattggagttaatcagtcagaatcaatatggtttcataaaagggagaactatacaagactgtctagcatggaactttgaattccttcattagtgccatcactccagaagggaaatagttcttctaaaattggactttgagaaggcttttgacactattgaacatgaagctattttgctagtaatggaagccatgggttttagtgctacatggcttggatggataaggaagatcttttcttctgcttcttcttcttcagttctgatcaatgaggtacctggaaaaaatttccattgcaagaggggagtaaggcaaggtgatcctctgtcacctttactctttgtattaggagctgaacttctctaggtcattgtcaacagagcttatacaatgggtcttctatcaaagccttttccatcagactttgacccaaatttccctattgtccaatatgctgatgacatcctgctctatttaaaagctagtggtaaagagctctttactctaaaggctttattgcaaaccttctagctgggaactggtctgaaggtaaattttaataaatcttgtctcattccaataaatgttgatgaagggaaagctcaaaacttagctgcagtctttggttgtcaattgggatctttgccatttacatatttgggtttaccccttggtaccactaagccaaaggtaatagattttgcacctttagtggatagaattgaaagaaggcttacatcaaacgattccttcctgtccaatggagatagatttacgctggttaattcagttttctcttcactacctacttattacatgtgtactctaatgttgccaaagacagtgattgatagcattgacagagcaagaagacattgtctttggagaggttctgaggtcaactccaataaaaaatctttggcagcctgggataaggtttgtaagcctaagagaaaaggtggcctgggagtgctaaacctttctatccaaaatcaagctttgctcatcaagtttttggaaaagttttacaataagaaggatttgccctgggtcaatcttgtttggtcctcctgttatggtaactctgtccctcatctgacaaacttgaagggctcattctggtggagagacatttgcaaattaatggatgtctttagaggtattgcaaggtgtcatctgaaaagtggaaatacatgctccttttggtatgatgtatgggctgatcaacctcctctttttcacactatgtcaaagctttgttcttttgctcaaaaccagaatgcatctgtctctgattttccgtccattgaggccgaaggaaattttacactacctttatctgttcaagcttttcaggagtttcaagagctcacttcttcccttgtggatatcgagttggttaatgaaaatgatgcttggtcttatatttgggggaatatgaaatattcttcacaaaaattatatacactgaatttcagagctattaagcctccagtccattttctatggttatggaagtgcaaagcagtttcaaaagtaaaggtttttgggtggctactcatgatgaatagattgaacaccaagttcatgctagattataagaattgtgctcctccggattgtgatctttcttgtgttctttgtcaatcggtagctgttgaagacttaatgcatctgttctttctatgcccgtttgcccaaaattgttggagtcttttaggcattacctgggatactactcttcctttggaaggaatgtttataaggggcaaattggattatcaggggagttgtttcatggagaaattcctttatgctgcttggcatatctagaaacaaaggaatgggttcatcttcaagcaaaagatcccctctttcatcacttggaggcaactcttaatgggtgacctcttccttttgttgtttagaactactgcgagatatcacggtgtaatcataagttggattaatatgttataactttgttcttggtttctttaataaaattattcaaacagcgggggccttccctgttctgttctcgtcaaaaaacaaagctcaacccaaaacaagttttgaatgaaatgtatttgggcaaccctagaaaagggttggtggggggtttatatagatcccccccaaaatgtgaccgttggaggggaatctttcaacccacgtcggatagtccgatacaagatcggatagtccgatattttaaacctccaaggcaatgagaaacagagaacggagttccatgaaattttggactttccgagacatcagactatctaatgttaaatcggagtatccgatattttagaagaaaaacttcgtcctcaaacagagactcaagttccatgaaattttggagtctctgtgtcatcggactatctgatccggcatcggatactccgatacttagaaaaactcactcgataggattttttcaaatcaagatagagagtgaagttctgtgaaaaatcggatagtctgatacatcggatagtctgatttcaaatcggataatctgatgttgctcaagtaaaaatgcaataactttttactccgaactccgatttcgaagatcttggactctatagaaagctagttttgtgtgctatcaaacccaacataaaacatggcctaaaaccttcaagagatgttaaaaaacttgcaaagaaacccggtgtaagtgttgtgacaagtgaaacaactcaggatttaaattttggcataggtttttcaactcacacaaagatgaagcattttgagcactagtattcaaccaactatatgcatgtggtatcccccttaatagtacggcatcctaaactcaaatgtaaaaggaaagttataccaataggaataccttcacaccaatttctttcttcacttggaggattaccaatgacaaggtcatttgatcatcgggaagatctcatcttcttgatctttgacatttcatctttcatttctcaaatgattgatgcggataattcatagcttcaaatggcctcgcacggttcatcacgacacagtcttcactcgcccttcaccaccggattcggttcgtcggcgccaagccccttgcttgcccttcaccaccgcatggtccatcgcagctgagcggctcttgcgcttcaccgtcttgccataggtagtcactttatacccgcatcttcaatatcttctctttaattttcatctatcgataagtccatttcctagcttcttcatcggactaatcacttgcctatacactcaataagtgcattagtcccttaatcgtttgtcatcaataaaccaaaacccactaggggcatagatgctctttgaatctccccctttttggtgattgatgacaacacgattaaagcttacaaaagattgataataaatgattttgaatccaaaggttagtttgagctcccctaaatgtgcgcatacaagtttatgaagtgaacacatatgcacataattttgaaattgtgagagctcccgctaactctttgcatccatggggtgtattgtgtgtgaaggagataccaaaattaaaacaacacacacaactaaaattcttggcagattcaaaatgtatcaaatgaaattcttgatgccaattgcaaaaacttgattctatgccaattgattccgttaccgattgagaaagcatgagtaatcaagttttgtaaacaatttcaagtatcaaaagataatctcaattgcatgtggcatggtgatcaaataataagcattcacaccaattgataaacactttcaaatattctctccccctttctcatttactctttgcatctttaaagcatgcatttcgataatttctctcaaatatctcatcctttgatcaatcttttctttctccccctttgacatctaacaccaaaaagggcataagtagggaaagaaaagcaaagggatccttgatgagggatcatcgagtatttacctctcaattttatatttcatcacttgtgattagaaaatgaagatcaatttcacataaagatcacaagtaaatcaataagcattgagatacaaattttgcgcatagaaagctcacatgcagaggttttaaagcatagaagaaaaagtcttccctttagtccttctctcctactttggcatttaagcatggtaagaagagaacatgatatacaatgaagaggatcatcgagatttgaatttgccaaaccacttcttcacaaattcaagtgagattcaagagttttgttaaaaaaaaaatctcacccaagattttcacaaatgagttgcgcatgtatgaatctaatagtttgtgctaagaccaaaaattcacatagaatgaggtctccgagcacattgattcactaagaacaactttgtgactaatacttgcttattgactaaacaagcatttcgtcacaacattttgcaaattaggctaattagcaaggaatgaaacttgtcctagatgcacagacaaggcaagtgatccaatcataccaatttagataacaagctatggatcatcgagttaccttccttgtgaatttttgagatgcccatacgataaaattgatatcttgaagccaatttgaatttggcaccttgatgggcttgatgaaatctcttccttgatttgcttgattccaatcccgagaaagaacttaagctttcccatcacgaacatgtttaactccttgatcacagtctgcgtcctgatagtgcttgtgctcttcttgtaaggccatgacccgattcgttttagcatgtgcaccatcttccttctaatagttcaaagacaacaatagagagtaacattcacaaattttgcaaattgagaatgaatagttactccctttttgtatgtcatcgaggatgttgtagggatgatctcgttgaacgatgtggtgaattcttggatggtacaccgatgggacttaagcttgcatggtgtaactttgctcttgagttgccctaggcatcaatcccatccacttgtgccggaagcatgtcttcatgttcttcatggttaattgcggtaggttgacttcagttgtttgaggttgatcaagtagtccaccttgatcatcatggagttcttgtggtctcaccttccaaactgtcttcgaagatatttttaatatcctatgagactaatcataaaaatacacttgataacaagttagtctcaaaaaacacaaaacataggatataccccccctaaaagtgtgcatccaagttcttaaattacttgtagaaacgcacttgtttaatgaaaacaaatggggagtgtagcctatattttagagaaaggcacataaaggattctcaagaaaacacttgtgccaaaatataacacacattataaaatgagcatgtaaattatcggaagatattggattaaagcatgacaatctaccatatgaaaaactatttgggttacccgtgattcttgcatggaaggataacctttaagtatgcatgttcttgtgagcttggagcctccggcctagattcttcgggtgaccaaggaatcttcacggagtctccggggtatccacccagagactccgggctcgatggcatggtgatagatgagcttgattgcaaatcgagcagtcttaccaaagcctttggttccacaataaaatctgcaataaatcttgtagataggtcatagaacattacatatctttcattttgggagttttacccaattctcaaacaaatagaagccacaaaaatcacaaagatttagaaaactgaaagtttcaggatttttagattttggaactcaaaatgagcttggaaagggcatcataacaatatccaaatgactttagaaaaatccaagtaaatttagaagtgaagtccaaccatagaggatcaaaagtaattatgtaaactccttccaatttgcaatacattgagagatataaaaatcacaaatcagccaaaaatcatgaattttctgaaaatttcagcaatttgagcaaagtgagaaaaagtcaaattctttccaaattaaatcggaatgatgccaaaccatgcagaaatgatcatttcacttaatagaaacttttccaaaaataatttctcaaaaagatttttctatcaagagaaatgtaaaaaagagttttgtaggccattcacgtcaataaatctcaactaaagtgtcaaatcacatccaaataagatttttatgaagtttgacatttggaaagccttagatgggttaaagatactaattcatgtcaccatatgcttttgccaaatatggttaaatcaagatttttgatgaacttcgcaaggctgcaacatttgaatggttggtcttttctaaaagctttgaactaaagatatgtttgaattgactaaccctaaaagttttaaataggaaactttttcaaaaactcaatagattttgatttggggtaaaatctcacttttagcaaaaacaagatcgcaatagattctttcggaaataagaaattttggctccaaaagcattgtaaaacatttcaaacacatgttacacttttgaaaatatttccacaaattttggccttttacataggatttttgacttttgaccaaatatgctcttttaaaaaaacaatagatgcaacttttgaaaacttttatgctttgagagcaaagggatacatgaatgtggtttgcttaagttcaccataatgtatctcttacatgaaaaaaaaattaacatttagggataaatcacaagattgagcaaaaagatacataaaagctcacttttcaaaaacagtcctccaaaagtcaagaaatagcaaatgagaagatattggattggaatgcatatgtatgagcttgacatacctccatgaaccaatatatatcaagatacatggttctagtggcaaaactcactcgatactacaatatgaccaaatagcattttaaagactaccacaacatcgatttgagccaaacacatttagaggatgcaaatgacaagaggttatagatttccccctaaacgtgataaccaattacttaaattcaacttattgcatcaactatgaaatgttcaagaaaagcattatgcacaagtataacctacacaatgttaggacataaatatttaaatgtaaatacttgttaccgagatgacattggttcttgatgtagaacaactatcctcatatttgactccaattttgcatattgtgtgaacttgattttccacaaatgagtcaaacctccaatgcatctccaagtacctatttctcactttagcacattttggtccccaaaacattagatccataaaggttagtcacaagagacttaggcacccaaatggcctttgtgctagtgtgtggcgaacaaatcaccctagtagcacaaatgtcatttttggcattcctaagcaaattatgatcaaatgagagacttggcttaggaatgttacccatgggacaatttttaccaatatgtccctttgcccggcaattatagcaaagtcgacttttgcttctatattgcttttcggtttgcttgttgccggtttgcctctcacttgatgttttgcattgttcatccaatgtgcaagaataccttgaggcaaagtgtcccacttcggtgcacttgaagcacttgatgtgaggaatgtccttcttcttgtttaacttatttcctttcttccaagggcaatctctaacatgatgtctcactttcttgcacttgaagcaagtaatggaactcttgatcatcttttgatttcgtcccttgatataagcattgatggacttgctatccctttgatggatcttggtgcaagccacggttgattcctccacaagcttcttcaccatgccctcatggttatcttgagaaggttgagcaatgcacacaagtccataatctatttgcttctcccttttgcctacacaatccaagtcacatatagtgctcggggaaatatttgcttgggagcaactagggttagtacaagtgagatcaacttgaacatgaggctcataggattttaccattggaactatcacctcatgagatacctctagcatggcatgagaatccacaagattctcatgagaacacaaaagttcatcatgtttttcttgtaaatccacatacttgttagtgatctcgtcaagttgagatttaagctcttgattttgcttctccaaagatgctacacaagcaatagaattagtggcacaagcaaattcattttccaatttttcatacctcataatcaatgaagaatgaaaatccttaagtttcttgtgttcttcggttagactcatgatatcttcattcttcttaatgaggcatgcttgttgcttcttaatggtctccatgagctttatcacaattgtaatatccttcttgctcaagtgatcaaactcgaagtcaccatcttctcccataaagcaagcatgatctttggaaatagaagatgagcatcttggtgaggtggattcttcacttgtccgctggcgctcatttacttctcccttctaaaggttagttccacaagtactatatgaagtagagcatttatccatatcatcctcacacatatacttggggctaggtgagatgcatgagtcaacaacacaatagaatatgacaaattcattatcggtgttgttggaatccaatgggagaattggacgatcatcaaccttacacaccaattcattaccttcaatgtagtcatgtgttgatgataaggtggttgtgggatgattatcttgatcatcgaaggtagtcgcaatttggtgatgaagttgaacactcctcaagtgcttcttccaaaaagagtacatcatcacatttggaatcatcacatttggacttgtcgtatctctccttgagtgtggttgtcacgcccggaatttctatccaaaattccaaacgcttacatgtgtgtgaaccctcgtccaggaatcagccgaggcacacaataactgtcacaccctgaaaattcaaaatatataaattgttgtttaattggaattttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtttcttttggctttggaccgaaagtcggcccaaaacctttctctctctcctcggcccagtccggcccagtccgccgccgcgcgcgcgcgcgtccgcccgctgacaggtggggcccacctgtcagggtcatcgtcaacctccggccgcgccgcccgaaaccctagtttcgcgccgccgccgttcctttccaaatccggccgttcctttttgtttccggtgaaattgattgaggggaaacaatctttgggatctcctctaccttttctcctttggaaatatcggctaaatcggtttggaatgtgtttgattcgagttcgaatcggatcggtctctttccttcaaaccccgatctttccttctcgtcgccggccgccgtgggccttcttcgtcgcctcctagcccctttaaaaggacccccaagctcttctctacccgccgccaccttcgccttcgcctctcgtcgtccgtagcgccatagcgccgtgtgccctagcgccgccgtcgccgccgtcgctccagtcgtgcgccgccgccgttctagacgtcgccgtcgctcgggaagaccgccgtcgtggtcgccgtcgcgtcgccgtcctcgttcgccctttcgccgtcgccgaagatcaccggagcgccatcgccgccgtcgacccgaagaccgccgccgtttcttcgtcgtcgccgtcgccgtccgttggtcttccgccgctcctttggttaccggtgagttcgccgcgtcgcgctctacccgttggtgctctccgttcgtgccgaagtgccgccgttcgccggcgagcatgcgcgcccgagccgccgagccgccgccgccggtggtgacgtcaccgccgacgtcatagtcgtcctcttccgtgagccgccgtggacccgatcgatctcggccgtccgttttggatggatcgatctcggccgtccgttcgcgtgaaccgccgccgtgcgcccggtccaccgaaaccctagccgctgacgcaataaaccctcttttccttttcaaaaataattcattattacgtcataattcaattaaaatcaatttaagtgttttaatccgatttaatcttcaaaaattcataactaattcatcttagctcggatttagttggttcaagtctctaaatttttctaaaattgagatctacatgttaaaaatatccatatgtactgttcatgcttgtttatgtgctgttttggtgattttgcttctttttgtttagattctgttgtttccggagagtctgttttcgccggagaagaatttgaagagttccaaggccagcaaggcaagtcacacagatcccaaacaaccctttgagcatgttgatcctgtttaaagctactgtttctattcaactattgcatttattttcgaatgtcattgggtggaattaacctattctttgttatagcccttttgttcttgattactttattccttgataccttgggttattataattagactagctgagctttatttatattggttcaactagatattagatataattgcttagccctgcttagaaacattagctcacttttgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaaggtgcgctgcagtggattgtgttatgcaaggggtattgtcacaactcctttccgaggtaccgtggtggtattgaggcacgtggtggtattacagtggtacacctctgatcagagtaaaactattcgaatagccgtgcccgcggttatgggcgggtctaacaatgtctttcgtgattagtctcacccttctcaccatagtaaatgatgctataattggaaataatttgattagctcctggtttggaatggtacattcctggtttggagatagaactgtgcagccgggatggttgttcagaatggttgggcctatacaacagggtatgttgtatagcgttggattaatattgattaattattacttaactgttttattaaattctcaaatatttgttaaatgcggtttatgcaaatgagaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttattttatttttttccgctgcttagatctttattgattgagaggaactatctacctctataatgatattttattcgcttattaattagagtaataattgtactctattatcaatttgttattgtcaccatgtgcctcaataccaccacggtacctcggaaaggagttgtgacaatatcccttgtacaacacaatccactacagcgcaccattcctggatcataatcacccccttataaacaaggcatggactccccagcgacccccgtgggcttatctccgccacttctcagtctggtgctccgcaatgaaccatgctatacaaatgataaagccgttgcccacgctggcttgtggctggtacggttaatgtttcacaaccaaaactcgtgaaccggtccttaattgtcatgagcacgactctcaaaaccatgtgctcataacccaccattatcaagttttagttggcaagtaattaattaatcaatcacgattgaccatcgtgaactatcattaagctatcattaaataatagtgaatcttaagttatcccaatagtgtgctaatgtttctaagcagggctaagcaattatatctaatatctagttgaaccaatataaataa
